United States Patent 7,868,149 (PLANT GENOME SEQUENCE AND USES THEREOF) - sequence listing, part 8

SEQ ID NO: 3563 - DNA, 13112 bp, Oryza sativa
  unsure (1)..(13112): unsure at all n locations
agagaaaggtgctctcacagctggtacagtagttcatcaccttatattattagctacacgtaaaacgagaaacatgattagcattttaattaggtattaattattaaaaaaattaaaaatgattttatttgattttttaaagcatattttggcccggtctagttctcaaaattttttgttttggggtgtcatatcggatatacggacacacatttaaagtattaaacgtagtctaataacaaaacatattacagattccgccaagaaactgcgagatgaattttttaaacgtaattaatccgtcattagtaagtgtttacttagcaccacattatcaaatcatggtgcaattatgcttaaaagatctgtctcgcaatttctgtcagaactatgtaattggtttttttcacatttaatactctatgcatgtgtccaaacattcgatgtgatagatgaaaagtttttgttttgtgaactaaataaagtttttatatagaaaatttttgcacgaatattagtttgaaaaaacgtactgatggaaacgagaaatagctaagctgaaccagctgtttagaacacggccctaatgtctttatttgattgatcatctggcatcaatcaatcggctcagtcgctaacaacaaaatactaatactccctactccctgtgtaccataaaaaagaaatctaaaattaggatatgacagattcttagttttaaaatgtattatatttgtattagattggttttcagacagatggagcacatctcaataaaaccaatttaaaattggatttaacataattctatattggttttttgttaggacagagataaatttagaattgaatttaattagtttttattgggacggagcacatctcaataaaaccaatttaaaattggatttaacataattctatattggttttttggtaggacagagataaatttagaattgaatttaattagtttttattgggacggaagaagtagagcgctgcaccctcctcaaatctcaatgatcagtatagtagcagagagatagagagagagccaaaacacacgggttacaaaactccaagcgccaaaaagaaaaagaaaaaagaatgtagtagtaggctgtagctggcctgcactgcacgcctggagtcgtgcagccagaaaggcaaggatgcacacttgctgccgctctcgcctccccatactcagtacagtagctaggaagaaggcaaggaaagggcatggcgacgctgccggacatgggtgtgtccgccttcatcaacatattgggcgctttcgtcttcctcctcattttcgccgccttccgcttccagcccatcaacgaccgcgtctacttccccaagctctacctcactggccagcgacgccaccaccttcaccttcatggtttcgtcaacctcgacctatgctcctacctccgttttcctcgcatgggtccccggcgccctccgcatgtcccagcccgacctcatccaccacgccggcctcgactccgccgtctacctccgaatctacacgctcgggttggttcgctccctcntacacctcccttccttttcttttttactacactacttctactggtattccagattaattaagcaccaccgtatacgtagttgcatttgctttccctgcactgcacattattatgggcatccctcccttcctagtgcaactcttgttgatttgtgtctagtatgtgctcttgcttgcctgtgtctcctaccaaagtcgtcctgctcatacagtactactatggacttcaattatggttgtttccagctgcatggagtatgcgataggaattactcttcttgcttcttttttttgtgtaaagaaaatccttgcttgctacactactgtagtcctttttattttctctgccgctaattaaggagctctttcctgaatactttcgctcatttccgattccatccacaattgattgattggacctcacaaattgaggaggagtgctgcttgccaagaatattactatattgcttgtatgtgtttggtgatgacgacattgtggccgtgatggatcccgcggtaattagttactggactagttaatactccttcgttgaaaacggtgtcggcggataggataatcttaacttgatgtgcaccgcaattcctggccttgtttcatggaggaagagccatagcctgtatattttgtttggggcctagcctacacgactggtactcctatgaattcataatgcagttctaaattaaaatatacacatatatttctaatgtttggcgtgttgctcatgttcttgaatcatgctcgcccactacctttggaaaattgccgtccaacttttgtttgtctccaacgattcctcaatccgtgtgatggtggggactgctcttttacaactggagatgcttttcttgccactttggaacttgcatgaaatttactcaaaaagttttacctatacaggatgtactagtcatattttgatacttgtactcttgtcattctcttatttatagtactgtacagaacaaagtatatataactccaccatcacgtggggggaaactaactaactaacttgtgctagaagtttgaggatttttcagccatagttcctcaggcagcgccttggaccttttctttttccctttccccactttcctgtgagcaaaagttttgagtttgtgccatgagacaaatgatcaaattttatttaaccagtttctatgttttgcacactaacccttttgttttgtttctttggcagcctcaagatatttttgcccatcatgactgtcgccttgctggttcttattccagttaatgtctctggtggcacgttacttaatttacgaaaagaaattgtctttagtgatattgataagctttccatatcaaatgtcaaccctggatccaacaggtttgtccacaagtatcttaatcatgaactcttagcagtgttaattattctttggcagagctcgtataattgttgatgactgctgtacttgaactctacattgctctggctttatgctttcatttgtagcattgcttgaaattgtctgaccatgtcctctgcatttcacttcaggttctttatccatctattaatggcatatgtgttcactttttggacttgctttatgctatacaaagagtatagcaatgtggcatttatgagattgcacttcctggcttctcagaagcgttgtgctgatcagttcactgtaagtgcaaataactaggcaatgctatatttagttctactacaatttatgtatcacaaccaagctccactaaattttttgtaaaggaatagaagagcagttgaacaaatatttggatttaatgtctatagtgttgtcttgctgactggggcatactccttttattgtgatataactcaatgggataccatttaatattgagatccatagttatactatatcacttactaatatattttggcatggcaggtgattgttagaaacatacctcatgtttcaagccattcaacatctgaaacagtggatgaattcttccgtaggaatcatccagaccactatcttggtcagcaggtacctaatcctcaccattgcttatgcctcatcatggatttaaactggaatgatgtttaaagctctacttgatttctgaccgatattcaatttacaaaccatggttattgatgaatatactgaccgcaaaactaacctcaatctggatgttcaggctgtttataacgcaaacaggtatgctaaacttgtgaagaaaaaagagaggcttcaaaactggttggattactaccagctgaagtttgaaaggcatcctggaaaaagaccaattggaagggtattttataaacgttgatcctgtcctttcgtttgcatcaataccaagttcttggacaactcgttctgaattcatgttccccccaagaaatgtttcaagcttgtgaatatttttggttctgcagacagggtgccttggtttctgcggtagagaagtggatcaaatcgactattaccgtgctagaatcagcgagcttgataagaaggtagagctagaacccacagtgtcgtgtttcttaccattcacaggcactcagcataactttgcaggctgttgcatgtatgtttgtatgcatgagtgaggctcttgttcagttttaacttttaacacaagctgtttgttattgtgatctttttagcttgcatctgagcgtcaaagagttctcaatgacccaaaagctgttatgccagttgcttttgtgacatttgactcgagatggggagctgctgtatgtgcacagacacaacagtcaaagaatcctacccaatggctaactgattgggctcctgaaccgcgggatgtatattggcagaatcttgccattccatttttctctctcagtatccgcaagttcctgatatccattgcagtttttgctctggtgttcttctacatgatacctatagcttttgtgcaatcacttgccaatcttgagggtattgaaaaagttgcacctttcctaaggcctgtgatagacacgtaagttagctcccattatatctgtcgaggttctgtaaattgcgccccttttgctattaactcataatatggctggctgtaaaacttgcaaaccaggggtgaaatccttcctgcagggtttccttccgggtttggctttgaagatttttctgtatatcctcccaacggttttgatgattatgtcaaaggttgaaggttatgtgtctttatcatctctggaaaggagggctgcttcaaaatattactacttcatgctggtgaatgtatttcttggaagcataatcgctggcacagcttttgaacagctaaatgcatttttccatcagccaccttcacagtaaatttcttcgagcaacctctcttttgtcacatatgctactgtttccttgtcctcaattaactaatgcgatcatggcatatacgagtaaatatactgatatgatccttccttccaatttctgcagaataccaaggaccattggagtagctataccaatgaaagctacattttttatgacatacataatggttgacgggtgggctggcatcgcgaacgagattcttcgagtgaagccgctggtgatataccacctgaagaacatgtttattgtgaagacggagcgggacagggagagggcaatggatccgggcagcattgggcttgcagagaacctcccatcactgcagctgtattttcttcttgggcttgtgtatgctgtggtcacccccattctcctccctttcattatcatcttctttgccttcgctttcctcgtgtacagacaccaggtgagtctgtctgtcggtcatgcctgctgctttggctttggctttggctttgaaagtgatggttgttttggtttggctattcagttaggcgctaaaatgtgttttttttttgtttagatcatcaacgtgtacaaccaagaatacgagagtgctgctgcgttttggcctcaggtgcactctcgcataatagcgagcttgctgatctcgcatgtaactctgtttgggctgatgagcaccatgaaggctgcctactccaccccgctgcttatctttctgccactcctcaccatatggttccacaagtactgcaagagccgtttcgagcctgctttccgcaagtaccctctagaggtgcgtgcatctctcattactctctttgtgaaatcaagaataatttgttcaagtatatgcaacaatgacatctaattaacgagggaataacctgtggtgttggcaggaagcgatggagaaggacaatctggagcgcacgtcggagccaaacctgaacctcaaatcgtacctgcagaacgcttacctgcaccccattttccacatgtttgagcagcagcagcagcaggagcaggagcagcaacgggaggagaaggtagaggtgcgaatcgacaaggcgcagcaacatcatcatcggcaggtagaggaggaagaggaggagagcaagagcagccaggctacaacacactactaccaccatcaccatgagcagaccacaacgacgacacaccaccattaccatcagcatgagcatatgagccactaccacatgggcccctccgacacagctgactcaccctcgccgccgcactttgtctaccattatggcgtcgacccttgataatcgcccagatagtctcttagcttctgaatcactagattgtttgttcttttgttttttccttttgtcaattgggggtgatatttttattcctctaattaacgaccgactggctgctgataattatttaatgatctgttgtaaatgcgaatatgtgagttgattgagtgtgtatatgcacgtaaatcggaaaaattccaatttgactccctcgaatataggccaggtatgcctgatccgtatccctcagcctgtaaaactaggtataatatcgtttccttgttgatgacaccaaaatgactaaggagagagagagtggggtagagaaggaagaagaaagagaatgtggggaggatgatatatgggctctttcatattttttttaattttctcaaatgattgggttgccatatagacaccatgtcagcaaataccaccaacaatactatctgggagtcattttgcaccgattttaatagttggagttattgtacctgattttatacttgagagatacaaatcacatccaatctatatttcaaattgagctttttccatgtaagttctctttgtttctttttaggaataagtcaatttgccgtccctcatttttccgtcgaatttaatcggcatccctaaaacctaatattagaaatctcaaacccaaaccgttcaaaatcaagtcccatgatagtatggatggttgttttagttgtcatggcatcctagtcacaaaaagaaaattaaaaaggcatgtgaggcccacatgtaatcggacctcaacctttcctgacctatcctcttttcccactcactccacctctcccttctcttccctaggagttcgccaatggtgagaggggcagtggccgatgagcttgttcgcgagggcttcggtgatctgcctgccaggctgaagcggtttagaaccgacagaagaggtagctagagttgtaggtcaaggcggcaaatcaccttggcctcgaactcttcagccgctgacggcatccttacagcacccacggcggacattgagctatgcctcccaaacaacgtcctctagatcatggtggccgaagagcgcggagtagtcaagggcaccgcgcggagaagcaaagtttggatggagctcgatcaagttgaggaagctaggcggggtcgatgggctagtcaaaacgtcgtggcctcaagatcaagcgcccacatgtgttgtggaggtctcccacttttttttggcacataaatgcctaattagaacgagtggacaggtcaatttgcaatgtcagggaaaccaaccatttatactgctgaaggaacccggttttataagttgttggttctaataaggtataggtattgcgatttagggatatcaattaaaatcgagtggacttattccttgtttctattgggctagaatgggctgtgaaatggcggattggggccgcaggaaatattagtccataggaggagataagatgatgccaaaaccaaacacgcaacttataatttgaaaagcgcagagagtcagtcacaggctcacagcgcaggagcctcacgctcgtcttccttttttgcgtgaacctcctcctctgtctcctctcctccctgcgatttctttttttcctatctctctctctcgatctctgaagtctcaactgaaagcagccgccgccgccgccgccgaccttaatttccgattccttccacccgccgcctcaagaaaccgcaatgcagcccgacgccgncgncaccgcccaccccagcttgagcttctactccgccgccacgggcctctacagcagcctccaccctcccctacccctcccctccgacccctctctctccctcgtcccccacctcttctcccatctccccctccaccaccattccctcctcgtcgatgcccccaccgccgccaccctctcctgcgccgacttccgccgcctcgtctcctccctcgccgccggcctccgccgccgcctccacatcgccaggggatccctcgtcctgctcctcctccccaactctctcaccttccccgttgccttcctcgccgtcctcgccaccggcgccgtcgccaccaccatgaacccctccagcgcccccgccgagatcgccgcgcgcctgcgggacaccgccccctccctcgtgctcgcctccacccacaacgccgctaagcttccgcctctcgccgccccgctcgtcctcgtgcccgacaccttccagcagcaacatgatgatgatcagttcgacttcttcttccacgcgctgctcgagaccgaccccgaaacgccggtggagatgggggtgggggtggggcaggacgacgccgccgccgtcctctactcgtcggggacgagcgggcggagcaagggcgtggtggtgacgcaccgcaacctgatcgcaatggtggagctgttcgtgcggttcgaggcgtcgcagtacacgcggcctgctcgtgacaatgtctacctggcggcattgcccatgttccacgtctacggcctctccctcttcgccgtgggcctcctctcgctcggctgcacggttgtcgtgatgaggaggttcaacgtcgacgacgccgtcaaggccatccgcaagtacaaggtgacgcacctgccgctcgtgccgcccatcatgtcggcactgctcagggccaacccgcccttggaattggattccttgctgcaggtctccagcggcgctgctcccctcaaccacaccctcattcaccacttccttcacgccttcccccacgttgatttcattcaggtccctccactccttcccctctctctctctctatatatatatatatatatatatatatatatatatatatatatatatatatatgcattattaattgcttctgtcccatgtttctcagttagcgtatcaattaaaaatgtggctgctaatgaatattttgtctttatctactgcatgtactacattttactcagctgttagggaatagtatatatgtggaatgggctctgaaatctccaatatatcttcatgcaatgtttgcacaggggtatggcatgactgaatctactgccgtaggaactcgcggcttcaatacatgcaagcacaagaagtatgcctcagtaggtcttttagcccccaacatgcatgctaaaattgttcatctggaaagtggttcttgtctgcctccaggctcttatggggagttatggctccatggcccggctataatgaaaggtaccgtgtcaaaaaaaatttactttattcaaaattctactatttttgcagtctgatacaaaagatttgataattatttcaaaagttaattaacaagcctaattattcacatatgctggtatgatctggctgcttggaatcttatatgaaaactacgcttttctactgactctagtttcttctgtactctctgccatcttgtttagctcctttagataatgtggttattcttgttgactgaagataacatggtcattcttttttagataaaaacgtggggtggtcattttttttttccactgcagataacagaatcattctgattttaaccttgtgtacttgctctgccgaacactaatcgttgcagtgctaaacactaaactctttttaaatacggtactgcattaggactcccatgggttgccatgcttagccaaaaaagaaagattcccaatgcatgctgctctcgaggaatagatttagctgccttcactaagtattgttcctgagatcagttaggcaaggttcctgagatccatggggaatggggatttagtttagcttccatactttagtctgtaacatcatatcccgctttaggtttgaatcatggtatgctgtacttgttacctctttgtatttgggttgtcagaattttgcttcgtcacaggttacttgaatgatgatgatgatgctttcactagaaaggatggctggttgaggactggtgatattgcttactttgattcagatgggtatttgttcatagtgggtcgcttgaaagacacaatcaagtacaaaggatttcaggtatggcctcctgtagcaggccttggaagttggaatacaatatcgttgttcttgtttcaaggaatttcaggtatcatgcaaggaagtctttggttgtaacaaattggtgtatttttcttgccttcagatagctccagctgacttggaagctgttctgatccggcaccctgaaattattgatgttgctgtgacatcgtaagatttttatttctaaacagcgtgatattatagctgttttatctgttatcatgtccttcaacgtgtttctttgattctctcgttactttttttttttgacattgattctctcgttacttagtgatgaagatgaagaagctggagagatacctgtagcttttgtggtgagaaaatctggaagcactctttcttgtacgcatgtcatggagtatgtggccaagcaggtaagaacaagaaggtcctacacaacacaacactcaccatattttcttgcttgggaacattacaagataataataacagcaagtgcacagagtgcattcttgttagctagagtatcaaattccagtaaaaatggatcactacaagctttatgcccacctgtgcaaataaatatggcagatattagttagtctcaagtcgtgttggtcagtgtgctcctctgcatccagcccacctgttttgaaaacagagatgtggttgttgtcagttgagcccccgtgtgtaccgatgggaatgtgtaactgatatgagcctgtctgtcagttggtttggccgcagccatagaagacattgtccatccagaagctggttgttctttgaccctgcccatccaaattaacaatatgtctttttttttcctgaagtaataatccttgggctgatgctgtctagtagagtgcttaccaagtagtgtgatgttgtatactgttatggtgggtgcaggtggcgtcgtataagagagtgaggaaggtaatattcgtggaggcgatacctaagtcagctgctggcaaggttctgaggaggcttctcaaggactctcttgttgatgcttccagtggcagatccaggctatgatcagagaagaagcaacatttacgcattcaatcaaagattcattttggccgtcaagttaggccaggcctcctcccgtttgttaaaacgaaaaagcaaaaggtccgggcaggccttcgttccaaagattttttttatttagaaaaacaaagaaacaaacgaggtcagtccaggctggcttgtccagcagcatgcctgttaatttccctgtagaagagtagatcctgaccagaagtggtcaatttttatgtattgttacttgtagtcgctcatgggtaggaatatgcttaagagcatatgctcttggaatactggtgggattgatgaaggtgtcaatgatataatactatggttgcaaacatatatatgtaatactattaacttgggccttgttatcgatcatctggtattttgttttctgatggatggtaggatgcgtttaaatcgatctctgtgtatctatctgctcaacaaactccagcgaactaacgaaccaactaaccaagggcaggcatcctaccaggcccctggattctaactattttgttttcggtaaacaaggcaaaagaaagagattgtaataggaggtttgtttgcttttttttttttgtttctagtcgcatcgcggcggcgtcgtggcgaggctgtgggtgcgtgtcctccgctgcatattattatgccaccgcggacgcggataaatgatggatttgctttctttctttgttaaaagataaaaaaactgaagaaacacatctctctccaagagtctgctgattcaacctcgccctcgcgcgtataatggagatgatacactcgcatcgcatcgtatcgtatcgcatatataagttgtcatgtgagtgtgtgtgtgcgtgtgtttaatttaccttaataataataataataataataataataaaatgaataaaaaagaaataaaggagacgaagaaggcgtgtttgaagcagtgattcgattcgagtagaacatgagacgggtggcggattatgcatatgttgggagtaagtaattgatgatgtgtaaaatattaaagagagagatactaacagtgcgtagtgtagaaattacgcgtgacccacctggagtcggagtcggagtcttgttccctttttattgagaggatcccctccctcgtgtcgacacgatcgtccaaaatagggaagagggagggggttcttcttctcctcgatccggttgaggactttgaggtagagagaggcagaggcgacgaggaaggatctgatctatcgatggcgcgcgtttcgcattccagaaagcggactagggctccctccaactccaactccaagcccacttcacaaacccaaccgccgccgccggagctcaccgaccgccctgtccgcgtctacgccgacggcatcttcgatctcttccacttcggccatgcccgcgccctcgagcaggccaagttgctgtcagtttctctctcttctcttctttacattacattacatggatccccccgatcgatttctcttggatctgggcctctatgttagaatagatcgagagatctgttcaattccaattcctgattgctcatggcgatcgcaggttccccaacacgtacctgctagtgggctgctgcaacgacgagctcaccaaccgctacaagggcaagaccgtcatgacccaggatgagcgatacgagtcccttcgccactgcaagtccgtctccttccttccttcttcaccttaccacatacgtacatggattttcatcatgatgaaggacttgcagtagagacngtcctacctgcgcg

SEQ ID NO: 3564 - DNA, 1565 bp, Oryza sativa
  unsure (1)..(1565): unsure at all n locations
tggattaacaagcacacaaggaagccaccaccgtttctatttccctttcctagccacaatattatgctcgcggcttgagtctcccttctgttgtgctctttgcaaactacatttctggattaacttatttcaaggggcctcttaatctctaatttagtgctgtaaatttaggttccataattacttctcaccttgctcctctcagctactttcatagctccactgatcctggatatttttttacatcagtcaatttttttccttccctcttgtgttgtgctgatatcaagcttcattattgtctgccttcttagatgggttgatgaggtcattcctgatgctccatgggtcctcacgcaagagttcattgacaaacatcagattgactatgttgctcatgatgcactgccgtaagtttcagcagcacaccaactattatcgaattcccattttttgtccctttaatactgtgctctttcagcttaactgaccggagttccttttttttttgccacagttatgccgatactagtggagctgctaatgatgtctatgaatttgtaagtcagagtagctatatttgctactagtaactacagatatttctcttgcattgctccttactgatggctgtcttcatgtacttaggttaaaaagattggcaaattcaaggaaacgaaacggacagacggtgtatccacatcagacctcataatgaggatattgaaggactacaatcagtatgtcatgaggaatttagcacgtggatacacaaggaaagatttaggcgtaagctatgttaaggttagtctcatctctgtgttggtttaccttcatcttcttgcagacaaattcagatgcatttttattatttgcatggttttgctgcttttgcaagtaatgacatgcttgtttatgggttcttactatcattctatcaggaaaagcaactccaggtcaacatgaagataaataaactgcgagagactgtaaaggcgcatcaagaaaaggtaaaccatgcatgtgactctaagatatttctgctgtgtcacatggaaggacagggagttccccttgtgtttacgactttacagatatcctgacccgctgggtaaattatttggtgcagttgcaaacggtggcgaagacagctggaataaatcatgaagaatggttggccaatgcagatcgctgggttgctggtttcttggagaagtttgaggaacactgccacaacatggtaagtttatacatgaaacttgagacaaggttgccgagaattcgtcgacagccagattgagggtaaaatgcaaaattatttggacgtggtacccaacactgattcctcgttggtatggtcaggaaactgccatcaaggggcgtatccaggagaaattgaggaggcaaacaagcagagggataattgggggtctaatgcagcaaccggtggcagcgtaataagttgtagaggagagatgacgttgagttggagtaagctgccctggggtcaccacggacgagaaatnnnnnnnnnnnnnnnnnnnnnntgggcgcaaaatttctct

SEQ ID NO: 3565 - DNA, 6726 bp, Oryza sativa
  unsure (1)..(6726): unsure at all n locations
nnnnnnnnnnnnnnnnnnnnnnnnnnnnnnnnnnnnnnnnnnnnnnttatttttttgcggggggtgggggtgttggtttccttgtatacaaatgtctatagcagaggcgtttggtgcataatccagagtgtgtagtaggtgttggacagatgaagttgagtggtactgtagtgttgttgttctcttcccttgggttttgtctgtaacgtcgagagggagagatgttgacgctggctgaaagcacaacacaagcagagtgatattatactactactagtaatttacttattagtacctgtgtagtattatctatccattgttggtgtgtgtttatctgtcctcccaagttgtggccagcaatcccaatcccagaaattgaatgaatagtcttctagtggccggcgagggaagggagtttactccagatagcgagagaggctagtgtttgagggaggggaaggggatgagaggaggaaaacgaagcaaatcgtacgtatggaacagtgacggcagttgggcctggcaggaagaggccgtcccccgtgcagtgcagtgcattattgaatgatgatttgcgccttctccttgcccccgtcgctgccgacctccaccggtcgccgcccgcacgcatcgatattggaattggagtagtatatatgatcgagctaggccttcctcccggctagttgtcattaaactctacaacgtacgtatctctcctctcctcctgctcccgagcattccgtccccatggctgttgacgatctaaaccaccacctcatcgccgtcggagtcggagaagaagccgccaccgcccattgtgggctgcgcaccgtgagcaatttcttctttaattaactcactctgtgatcgatcagatcacctgcattaattcgttcatctatctatctatctatcacatacgcgtagtaagtaagaagtatgatttgaaataatagatggcgcatgcagcttgtgcggaatatggcgcagctggtggtgtcgctgggcatattggtcgccgccgacaagttggtggagcaggccttcgcagccgcctccatcaagttccccagcgccctcttcgccatgttctgcgtcttcgccctcctcctcttcctacctccttcgctcgccaacggattcatggctttcttcgaccccgccaccgtcttcatccacaggtggctgcccctcttcttcgtcccctccctcgtcgtcctgccgcttgccgtcagggacgtctcgcctgcttctgccctcaagatcctcttcatcacatgtaataattaactactgtaactaacactactcttcttaatttataattcgttccacgtacgtacagatgatcgacatgactctgctctgctcatgaattttcttcttttaatattaataatttactagttggtggctggtttgcttcactggtggtggctggttacacggcgctgagtgtgagaaggatagtgaagacacagcttataccagctgagcccatgaagagaccgtctcctttcgggccgcttgaattctgggcctgggctgctgtctttgttgcttcctttgctgttgcgtatgtttcccccactgcgcttggtaccaccgcaacaacatgccttcctttcttgcttgcttccactgttttcggttacatccttggttcccggtactactccattttatatttactctctctttattcttgactttaaacataaccttttgttcattaacctcatctcaaaatttagtgcaaatatatgagtcatacataaagtacctataataattaataaaacattgcaccgtgtttctaaattaaaaataaaaaaaaacttctatatctatcttgatagcgattaaaatcccgcactattgaaaaagaaaactactactacctactactacttgagaaaacttcaacatcaactctaagatcaaaattttaaaattcaaattttagcgtgcaacctagtttactccattatattaatttctctaacgttcaatataattctcacaggttaccatctggtgtcaagaaagtgctacacccaatcatctgttgtgcactttctgcagatttggcggcagtagcatatgggtatctctcccggtctggagtggatgcagtgctaggttctaggcttaacccccaaccctgatcgatactcctataatcaaattgcatcaatcgcaaagtcgtgctccctgatcagttttatcctatatatataatgctctcaaatatatatgtatgtatggttgtccaggtgattacctcacagagtctccgtcaaatccaggagctggtgacatcctcatgggatttcttgggtctgtcatcatatcgtttgcattttcaatgttcaatcagagaaaggtaggtacccttctctcagttagtagtattactagtagttagcatatggttatatatgttgtgacatgatcatattcgaagctctctgtttaatttgttgcgagacgagtgtgcctagctgttggctagctaattaaccatgcatccaaccaaggagtaattaattaatgtttttgtgttggataatataatatttcagcttgtaaggaggcatgcagcggaaattttcacatcaatcgctgtggcatcaacattctcgttatattcaactgccatcctaggacgagtggtagagctagagccaatattgaccatatcaatattgcccaggtgtataaccgtggcattagctttgagggtagtttctctctttgaaggtttgtccctcctcgatctgtattagctcctccgtccttgcttcttttgtcactatgaaatgaaatcatcgatatttcaaccattattaacttttagacgatttatctatgattaatgaaaactatatagttgtatttatatcgtaacatgcattactaatatggtgtctgtactttaagtatgtatatatatgtgtgtatttttttttaaaaaaaagacatattatcaaagttaaaaagtgaatagctagtatccaacgacagattaataatgaaatgcatatagattaatattcatctataataatggtgtgttgggtgggcaggtgtaaatacttcagtaaccgcagcggtggttgtcctcacggggctgatcggcgcaaattttgcgcaagcagtgatggacaagcttcgcctcaaagaccccatcgcacgaggaatagggacagcttccaggtaggatcacaatataagagcaacggtaataatacagccgatttattggctataagctcagcgtacccatataatagttagctctttacaattaatatatggctcacttatctttctcatagaattttttggttcttatgttcgaaccggctgtaagtttatagcccgtttctcctctcttctctcctccacctcagcatttagccagcttatagcttactattatacttgctctaaatgtgggttttcacgtccaacatttgacgtgcctcaaagtagtatggagtggattacatggctactacgaccaaatatacgaagatctggtaaaaggagaaattgctaggcgtgtgtttgctttgtgtgacgatggatgtttattgtttaattgcataatacctctctgtttcaggctataagacgttttgattttgatcaaagttaaactgttttaaatttaactaagtttatagacaaatatagtaatatttataacactaaattagttttatcaaattaataattgaatatatttttataataaaattgtcttgggttaaaaatgttgttactttttttttataaacttggtcaaatttaaataagtttgactttaaccaaatttaaaatgtcttgtaacatgaaacagagggaaacggagggagcagtaattgataaataagagggtgatgttaggcgtgcaatctgatccatacatacatgcagtgcccatggactgggaacggcagcggtgtcagccaaggagcctgaagcgttgcccttctgcgccatcgcctacgccctaacgggggtcgtcgcctcgttattttgctctcttccggcgatcaggcacagcttagtcttcatagctggcgatgcctctgcctcacaaacacaacacttttcttactagtattatttggatatatatttgtttgtctgtcactattcatgaaaaacagacccagtacagattgatattgtgattaataatcctacgaccgaataaatactgtatatacagagacacgtatatatggtaggagtaacatggaagggagaactatttgtatatgtaattaatttttgtaagggaggacctggacttggtggaatgaagcagctgattgcagttaaagcgaatgcagcatcatcaaaatcaaattaagcagacaagagtcaacacaagtcaaagtgattttattattattagcagagcagagcagatcaagaaagcagagagaggtgccacactcttgtattcaccgacaactcactctgggcatgggcatggcggattcacatctggatggggtgccggcgatgaggaagacgacggtctccagctccagcagcctcaacatcgccttcctactctccatggttgccaccaacctgctgtccctctaccacctctccacccgcgcatccaccgcaccgccgctcctcttgccggcggcgcaccaggcccaggcccaggacgagcagctcctccgccagctgaccgccatccgcgccaccgtctcccaactcaaccacctccgctcctccacgcccccgcctccgccgccgccaccggagctcctcctctactcccgcctggcgcccctcgcctccgcctgctcagcccacccggacctcctccaccgattcatgtcatacacgcccttctccccctgccccgacgacgccctctccctcgccgagcccctcctcctccgcggctgccacccgctgcccaggcgaaggtgcttctcatcatcttcgatctcgtcttctcacaacctgaataatctgcccaccgatcccttctccccgctcccggactccgccgtccgctggcctccgggggccaaatgcacctccttctcctgcctcccgccctcgctcggcttcgacctcgcgcgcacggaggccgcgcgcttcctgcgggcggaggggcccctcgacctcacggtgccgcagctgctgcgcctggcatcgctcagccgcgcggggcccatccggctggggctggacgtgggcggcgggacggggacgctggcggcgcgcctcaagcgggcggacaacgccaccgtgctcaccaccactatgaacctcggggcgccctactcggaagcggcggcggcgcgcggggtggtgcctctgcacgcgccgttgcagcagcgcttcccggtgggggacgccaccatggacctggtgcgggcggggcacgccgtgaaccgctggatcccggaggcggcgctggagttcctgtggtacgacgcggacagggtgctgcgcccccgcggcctgctctgggtcgaccacttctggtgccgccgccctgacctcgccgccgtctaccaacccatgctgcgccgcctcggctacaagaccctcaagtgggccgtcgccgacaagaccacacccacgcccacggcgccacccggagccaagcatgaccacgtctacctcaccgccctgctgcagaagccctgatcgattcattgccattgccattgtaggtgggatcctggaacaaggctgtcactgaggtgatcaatttaattgtgcaataagctcaaagaggaatgccaatgccaaggctcaacaatgaggatgatgcactgatttgatttgggggtcttttttttaccaaggactgtacgtaacttctctgtggaatcatcattttataaggaaagcctcgcatctgcaaaagaatgcaaatccccttctcactcaaatttgctttgaaagttgacatcttcctgtggcttatgcttcggaataacatcttgatgaaggacaacttcatcaggagagggtggaaagaaaaattagagaggtcaactctacaccgcagatgagatagtgccgcatttttgtttacaaaatgcacactgcctcgatttgtttcgagtgtagcaccttcaattttaggagtgagctcataatattcctcacttgtttgggaaaggaggatatgaggaatttgattgctctaggagtaactgatgtggtgtggtcgattttgataggaaattgctatgcatacagctcaattgtccgactcatgtacgactaaatttgatcaacggttgtaaatggctgcaggcgcatatgaacatactttcatttgattgatctgtggttgtatatctctagttgtacatgagttgtataactaggttctacttatagcagtactcatttggagaacttggaatgaagcttcgttgctggattccctcgcactctcagagatcatcaatggaaagctgcatgtttatatgttaggttctgctacagtaaggaaccagcgagtcttccatcacaacaaaattcccaacgacaacttgggcgcgggcggaagtgaaaagactcgtgaaaatgttaacctagttcctgtgaaactccttttctttttcttctcacactccttgtaaatacttttagtgccactataaacagtgaaattgacattgtcttgtgctggttcgtttagggaaaaaaaatccc

SEQ ID NO: 3566 - DNA, 23505 bp, Oryza sativa
  unsure (1)..(23505): unsure at all n locations
cgctgggtaganttcnnnnnnnnnnnnnnnnnnnnnnnaaatttaactcgaagagctaagttcggaatagagttgtagactagtttaaaccggcttcactactctagttcattttataagagcagtttaacctactccgctatctttttaggttgagttaaaaccgtttggctctgctacagttttgaaatggttggcgcttatgttggcgtgatcctgatgatttgcacacggcaggtattaaattgcgataatgattatcgccgggcgacgggtggagggggtgtgtgtgtgcagaaatcgggcgctccccccacccccgcgcacgcgcgcatgctaggggcgcgtgcgcgtgcactccccttggcccaccatgtgtccacaaataaactctattgcaacaaatcacccacatattttggaaaccctctattaagggaattcgtttcattttttgtttcacaacaaatgtttcacctagtgtactcacaatgtttcactatatatagatctaatgttgcagtgaacgaaacattcttttgcaacaaatcgcccacatattttggaaaccctctattaaagaaattcgttttattttttgttccaccaaaaatgttttacctagtgtattcacaatgtttcactatgaatagatctaatgttgtagtgaactgaaacattcttttgctatctgctgaaacattgtttttatataaggtaaaacaacactcaatttaaacgattgaaacatttccgatatacttagcgaaacaattccgatatacttggtgaaacatcgtgcaacatttaaaaaaaatcaataataagctaatttttttcctcggaatatatctatgtgtggtcttgttttgaagatttaattgcaacaaattaaatggtgtaatcggatcatgatttggataaataatttaagagaaaaattagtttaaatttgttttacacgtatgcgtggcgctgacgtcatcgtccgatttttgccaatccgggcgcccgaccggaaatcgcgtccattgaattgggctgggttatgctgggctggacaaacagtacagtagcgctctgagtggtgggccgtgtggcgtggtctttctatgttggtttgctgggctgtgacgagacgtggcccgtggctaggctagtcgtccgacgccggcgtttgagcgagccttcgctgccgccgccgccgccgacgacgacgacttgcctgcaccaacaataccacgctcttgctttgcaatgcgatccccttgtaatctccccctcgctgcctcctgcttctatgctccacgccacgcgcacgcggacgccgcgcctctctgctgccgccgccgccgccgccttcttcaccaccaggcccaggtcccacccaccgccgccgccgccgcgcctctctccaaggctcgtcgacgccaccgtctcccgatgtccctccgacgccctcgccatcaccttcttcctctggtgcgcccgctgccccgcctacttccaccctccctcctccttcgaccgcctcctccccgctgccgcccgcctcgcctcccgcctccgcaccgcccccgccatccttcaccagctccgcgccctcggctgccccatccgcccccacaccttcctcctcttgctcaggctctactggcgcgggggcatctacccgctcgtgctccagctgttcgaccaaatgcccctctggggcttccaccccaacgccttcgctcgcaacgtcgtccttgacgtcctcctcaggacgcgccaccaccactccgcgctctgcttcctacgggacaatccctcgcccaactaccttacctacgccatcctcctcacccacctttgcaggtccgggaactggccaggggtgcgggcctgcttcttagccatgctgcaccagggttttctccccagcgccgcctctctcaatgcggtttttgcctgctgcactaaacttgctgccacgtccgagctactgcagcttctgggcttcacacttgtatcgggatatcagctcacttcggccatgtggacatgtctcatcgctcgtttgtgccgcgagggaaaactagatgaggctatcaggatgctggcaaagatgctggcttctggttctcctcccacagttgtcacctacacgccgatcgtcagagctctctatcgtgctggaaggcatgacattgccactgagcttttcgcatccatgtcatccaccaattgcagcccagatcttgttctccataatgttctcatggactgcatgaccaaggataagagatatgatgcagccctaggcgtttacttaaatcttcacgagagccagatgaagccagatgcatacactttatctactttagtccgcgcgttgcatttgtcacggaatgtaagccttcttcctaggttatttctggactcagctgatatcccttatgatctcgtggcctgcaattctgtgctgaatgctctgcgcaaatctggatttccatctcaagccgtgcagttcttcatcaatatgattaagtgtgacatcaggcctgacagctacagttatgttggtcttttggacagtctgtgccagttgggaaggattgaccatgcaatcaatgtctaccacagtattgtttcaagtgatcctgattcaaacgcttatgttcatgctgcaatcctctgtggccttgttaaaaagggccacaaccgtatggcgctaatgattttgaatgaggctgtacgtcaaaattatgctctcgacgctgtgtgctacactgttgttctacatggccttctacaagctcatttgattgaaaaggcttgcatgttgtttgacaaaatgaagcgttcaggaatggcttccaacacttgcacatacaacataatgcttcgtggactttgtagaaccagggatacacatgcactcaagtggtttttaagagaaatggaatgttctgatgtggagatggatagtatctcatacaatattctggttgtgttcttaatcaagttgcagcatattagttcagccactgctttggtaagagaaatggttaatctaggcatggaacttagtgccaaaacttcctcattgatttctcagtccatgggccatgagtatgttctggaggatgctaacattgctgaaaatgatcattccgactcaactaatgatctgcttgcatgctcagcttcatagtcaattttcaactaaacagccatgctgcttctgtacatcttcagtttggtggtgcataattaaatacagatacacactattaaaggttggtgaaatcttcaatgatttatctccctccattgcctatctaacaaatacctaccatggccactgaaaggctgctcaattacatgccccccgccattatgttggtatatactttctctttccctgtgatatcaccacttagtacattcttatttaaaaagaaggatttgattgcaagaaagaaacaagatccctcctattgcattcatcttatctttgctatagaacattggtcacaattctcactcagtgctgagacacacagaaatgcaaaaaaaatctgcaagtaataaattaaaaagaaagacttacctgctttttgtgtcctgccacataggctcagctagggctgaactaatgggttattgtttttctccaaaatttacattgtgatttaagatgatttaaacattattatggaggcaagcttagggctcaagctctatctgctctaggcttgcctccgtccatggtttgacctgaacagcctgtaaactacatctttatgaatttatgttttgtaacttgaccattttttatcatttggcgggagttcaaagttttgttccacatgtcaaaaagaatgaacactagcaatcagctccaaggcttgacactgctatacgtgctgaatggttttctttcagtaaaaaacaatcttatttgtgttagagagaataaacagatgatttcaataacctttcaaataattcaggaaatcatctccgatatagaaggaaaatatacaaacttcagtactgaacctcgtatatgtatactgataacaaaagctcagatggaattcgtatttaacaaaccctttgattatctacattagggggttgtcaaatgattggagcagagtttgtgtggagatggtgtctgtaaggatgattatttatgtagatcaaacatttacatgtctaatattcaaacaaccaaaaattgcatatgggatttttttttattttgccttgtatgtttttttcatttgtccataccaactgttttagtcaatagagcttgtcagagtaagtatctgacttatggatttagtgtcaactcagtggagaactgaggatatatgatacttatggtaaattgattagtaaggaattttttccttattgttgaaattagttttgctgtaggaatattctaaatggcatacagtggaaccatagaggactcggtggcttaacttgatcttcctgcgattttgaagtagccatagagcttgcgatgaacatgcaaatacttaactggcatcactttaacgacgataagttcaagtaatatgaattgatgttcttggctttataatttgttgctgaccaactgtttctttgcattatcttttctctgaatatatttattctgtacttctataactgcttctgatattgtctgcagcaagctgaaattgctttatcagagttgatccaatcctctccggaggaggctctacatgactacatccttggagtaaatctctggtcaagatcactttacttgaccataagaaaagaatgtcaaacttttcgttccagcttgctttattgaagttatgcaggtccttgcacctgatccaccttttagtgatgaaatatttaaggtatctaacctgatccacctttgacacggatgattgggtattactgatttcttcgactgtttccattactgacatactgatacctgatgaccatttttgaacaggatttctgaaatattaataatgtttgaactttagcaattatatttagtggcagaaaatttgaacaaggaccacactctcattacactttttaactcctttttctcaggagagatgtttaggctctttatcagcacatttgcacaccttgctgaaacaaacagtccatatcttccaagaagatcttgctattggaaaatgtgctgcactcaggtattctgtaattacgtactctctgcttgcttagagtgaccagatatccggttggaggcagttcccctgatttgggggcttgtatctcatctttattttggtcaagaaaaccaactagttttaatggaattttttaagagattatctgacatatctgcagagtaagagtttttgcacgtgatgcagcaaaagcctgttacatggccgtgacatcaggaaatgaaaaaaaagatattcttagtaaggctgcttctttttatctgttcttttgttcagagttctatattggcatcttcatgctgaagttttgatttatttggcagcatcacttgaagagaggttattggattttgatgtcaaagttagaatgcaagctggttttgcatcctgcaatttagggccaaatcaaatctaagatcagttccttctgagctgatattgcaggcagcagagaagccacaaactgttgttatttctcgctactgcaggttctatacagtgcctcacttaaacttttgttttatgtatctctgactgtcagaaagaatctaatgcttatattgctggacctataccgagattactgtaagaaatgctcaaaaggaactgccacgttaacactcactatgaacaaatccctgctaaacttataggtctttgtttcgataaggattgaatcttaaggtttcttctttctaattttgtacattgattatgccatcaattcaactcatgatttctgacctcttctttatggcagggtacaaaacctaagccgttgcggtcaactaactcccgcatcggggaagaagatggcgagggagtgaatgggggagaagaagggcctacccgggaagctccgccaaccaccgactacccgatctgccaccaacggccaccgccggtcctgctactcggccacaccgagcattgccgtgtcgatccccacctctgccgcctcgatccgccattgccacgttgatccccacctccgcccgccttcttagcggtgtcgccgaagagagagagaggggagaggtggcgtcgccggagaaagggaaggtggcgtcaccggagaaagggaaggggaagcggaggaagacggggaggagggacggggtgagcctttatatatgtttgtgatttttggggggcgtactacaaatattggacttatatatgaatagaaaatctgaggatttaaatggaaaatgtaatcgactgacaggtgctgaaatgcaaaaataagatagagctgtggcttatgtaacaagtgtgatttcatcccacttggcatctcctttttcatgagggtatagcttccatcggccatggtcttagtttactttgttcctcaacctttttgacaaaaatagaagaaatattgtcaaacgtgtggtttctttttacagacttaataggaacaggttccaagttccgagcttggatactctagtaacattatattgccgattctctagtaacaatgtattacacctgtgttgatgtcaagtgtcttttctttctcccttttctaggaatgccattcaaatgacaatgagctctaaacaattttagaaaaaaaaatcacaaacaagcaaaaatagtgatctcactcactgtgaagaagcagatctggactggggtgaagtgcagtttgctccatgaagcaaacagactgtgggtgatatgatcatgttccctaggctgcggtagctcgatcgaccagctagcatatgaatgaatcctaagcaagcagatagcagagagacaggtagtctggattgggtgtgtggaatgagaatatatgtatatcaggggaaagagaaggatcctcctagctgtgagttggcttgtgcagaaggaggcttgattgcaatccagagcaaggagatggtgatggcgacgaggccagaccagacgtagacgatggtgggtgtccttcccctcctgcccatgaggcccttggcgaaggggtagagatgcgcgaggacccagaagctgaagaagactccaccgagaagcttgctccactgcgggatggtgctgtagatggtgcggctgaagccgacggcgatggcgacgaggttgatcattatgatggtgagcggcggtatcatgagggacgtccacttgaccgcgtagagctcggcgaactcgtcgtcgacgtcgtcgccgagctgcttggaggtgagggtgaaggagatctcgatgccggcgatgaccttgagaaggccctgcaggacggcggcgaggtgggcgctggttccgccgatgagccagaactgctcgttccgccaccactcctccagcgcgatgccggaccacttgatctccagcatggccaggaggcagagcgtgatggtgatgatgagcaggtaggtgaggaaggtgacgttgagcgtctgcacgatgaactgccccgagaagagggagagcgccgggaggaagcagtagacgatgaggaagacggaggtgaaggggtagatgccaacgttgaggtaagcgatgcgctggagaacctgcaaatgcaatggataattgtttgtttggcggcagcggaagaagaagaagaagaaaaataatcgatcgaatagcaagctaggtaccttcatctttgaggaagcgaagagtgcgttgttgcgtgagaagaagatctcgacggagccagtggcccatcggaggacctggtggaggcggtcggtgaggttgatgggggcggtgccgcggaaggcgtcgcggtgggtgacgcagtagacggacttccacccccggttgtgcatgcggtagccggtgaccacgtcctccgtcaccgacccgtatatccaacccaccctcgtcccccactccgtcttctcctcgtaccagcacgacaccacgctgatcgcctccgccacgatcgacgcgtccagcgtctcccgcgggatcgtcagcgcccccggcggccgcccgttcttcaccgacgggtggtccgccagcggccgtccctggaactccgccaccgggatggagtcgatcaggaagctcgagttgccgaacttcttggggaagctcgccatgttcatcgcgccgtccatgtccatgcggagggccatcgtctcctcctcctcctcctggggctggggctgggatcttgttcggcggcgacgtggcaggcagcaggaccacggggtggtgtggtccttggacctgggcgggtcgaagccgtagagcgcgatgcggcggaagaggcagccagttccgacatagacggggccctggaggccatcgagggcgcgcatgttgacgtcgaagaagacggtgttgtggttggcgtagcggtcggaggggtcgatgccctcgaagcgctgcgggaactggacgtagcagaggcggtcgccgccgcggtccatcatgaagcacatcccctcccggaacgccttggagttgtacacgtagtggtcgcagtccaggttgaggatgaacggcccgttggacatgatcgccgacgcccgcaccagcgcgttcatggcgcccgccttcttgttgtggtcgtaccccggccgcttctcccgcgacacgtacaccagcatcggcagccgggtgtccacgcccgacaaatccaccctcttttccatgtcgccgccgctgctgctgggactgggactgggaggctttagcatcacctgtatgatccccgcgtggtcgcccctcgcgtgctccggcgacgcctgcagccacgtccccggccagtgcgtgccgtccgccatccacgtcgccttggggatctttatcggctccagctgctgctcgtcgccgccggccttcatcttctcccgctgcaggttcatggcctggatctcctcgcgggcgtggtacgcgtcggagcggcggcggatggcgtcggggaggccattgacgcggaccttgaactcgtcgtactcccgcttcacccgccgcctgtccttgacgaagtcgcccttcaccttgttcttgaacgggtccctcttgaggttgaagtagctgtcggggttcctcggctcgatctcgtgcttccggcagaatggcacccacaggttggcgaagctcgccgcctccgccatggcctcgaacgtcagcagcgccccgccgtcgtcggacacgtagcacgccaacttgtcgacggggtagtcggcggccaggatggagaggatggtgttggccgtcaccagcacgggctccttctccgggtcggcggtggagacgaagatgtcgatcccggggaggtcggacttgccggtggggttgctcggcgtgggcgtctcgaacttgtccttgagcacgctcaggtcggtggcgcggttgatggggcacagcttgggcagctggtccagcacccacgacaaggcgaaccacagctcgcacacgatggacatcccccacagccagatggcgtcctcgttctggtgcttgatgcgccacatcaggaacaaccccagcgccaccagccggatcaggaccagcagcctgtacgggctgatcaccgccgcctggatccggagcttgcgggtcagcggccgccatggcttgctcatcagctccttggggtgccccgccacgccgtcgtcctcgggccagattgcgttgccgtagccgtaggtgcccttggtctcgaagagccagcggttgtggtcgaactcgccgggcgcccccccgttctgcttcaccagcgacagccgcctctccatcttggggccatgcccgtgcccgtgcggcagcgacagcgccctgttgatggcgtcgtggttggacgccgacaccacctcctcccactccgcgtgcttgtacggctccttgcaccccgggcacacgccgccgccgcccttgacggcgtcggtgaagcagtccacgcagatcttgaagtcgcactcgcaggggaggatgtcggcgccgcgcccgttgcgcatgatcttggacccgcacccctgcaccatgcacgccgacaccgtcgccctcgccgacgacgcctgcttctccatcacgtgcgcgcgtgtcacgctgttgaacccgccggtgaagagcgagctggacacgtactgctgctcgtcgccggcggcagggtccatgggctggttgtccggcgtcatggggatgtggacgtggtagtcctggaagtccacgctgctgatctccgagtcaaggtcgtcgcgggagtagctgatgaatcgccccgagtccgtccgccgaccgaacaccaccgtgggcgccgccgacgatggcgccgtcggcggcttaccgccgttcttgaggatgcccttcgacgccatgatcgaacacctagctcccctgctctgctatgtttctctcttctcttgtgttggtatggtattggtaacaacaacaagaagagagtatagctagctagcttgtctcgccgccgatcaacgtgatgcagctagctagctagaaaatatgaataggaatgaattgaatcaagcatcagcaattcaggcatcaagcatattttgggtggctttgacccgaccccagtaatggcgatccaaaatcatcagtcctaataataggaaaaatgtgactctgcttcttaaatggaaatggaaacaaattagatgcaggcgggttgaaaacttgcagtaatttactggccgaattggtacattcctattttgcatgcaacattataatagccccctgagaatcgatcgaggattactaacattacatacagtatcaagctagtttaatttgtagtggcaattgatcgaccaaaacatgaacaaatcaggtgaagaagaagaagaatcaatcgatacctgttggtcctcttcaggtggggcaatgcattgcaggtggacgagtttaatttgggtagtctgagagagagaaacagcagataggtccaagaaagaaagaattcagtggaagccgcagtgcaagagaagaggagagatgtcgaaagaaatcagagggcgtagtgttatttgaaggtccaaaggcagcaagcgtgtgttggtgctcccttcatggcctccctcctgctcgatcgtttgcttccttaattcttcttagttgttccatcatcggttgagtttagttggtggcgcgcacgatgggattatcggtctcgctcgtgtcgattgccactgcaagcaaagccatgcagatttcttggaaattgctgctgttttccccccatcgtgaatggattcgtggtcagtcagacttcatactcacacacaacaacacaaggaatccaaatcaagatcgtcgtgctcgcgactacctccctcccggtcggtcttgaaatgtctgtctgtcaaaaaccaaaataatgccacgcgacgcaatccaacctccctattgtatactactgtatttgtatgacaacatgcgcagatacatgcatacaagcatttgatgccaaattatcttctgaccaatcaatcaataaactagtgtcccttcaagggggcgggagatgacttttttgtgaaagttcgaggtcaggcatgacatgtgtctccctctctctactctttcaaaccatttccaaataaatttcttatccttcttcgctgctataaataagtttagttagtccaaaacaaacagtaaatccagccgctcgaccctgtcaacttgattactacttcagtggtggtgttattggttttcgactttcttcagacgaccttccagaggtcaactccatccaaaatccaacccatggatggatattaacaagctgatgggttcactgattgtgctcatcatgccatagcattactagactgactccgcatgttccctcttaacttgcatgcacgatcaatcttgctttcagctagctaatttatccaggttttttataaagacaaaggacctaccttattctggatatatatctgatacaacagttcagacaaaaggttataacctgacaaatcaatagttgtatataaaccagattactcagttattcctgataccaatcttatatgtattcgcaaaaatcagcacctagtcatgccaatataaaagcctcaggatcaagaggacttttacggtacattctactgctagtatatactagcagtatatacaagggtaattttggtattaggtaagagtctgaaaagggctttttggtcatttaaattagagaattaatttcagccggattaattttccttcgttagtttttcctggggatgtcgtcatctgtttcttctcgtcacatctcgcgtctccggcgtcgctgcccctggtgcacatcgctcccgcgccgatgcctctcgcgtctccggcgtcgctgcccctggcgcacatcgctcccgcgccgatgcctccgtaccgattcctccggcgccgagagaagccgaacctccacgcgcccggtgtctccctcgccccggcgccttgcctccagccctagcctattctctcccgcatccgacctcccacagcttgtgctttgcccaaaccacggcggtgagagtgcactcgtcgagccggcagcctccccacgcctcccatctccgtcctggttgccctgcctgccctgcagccactggagtgctcctggtaagaagctgacctaaatttggtactattgtattgattaatttatgcaatggttgttttgttctgcaatttttgttgtgcttaaccttaatgtcgatatgaaaatttactatctcattatgaaaaagaggtgagattttatcttgttgattgactttgttttggacgatctgccttagaacactaggttgtatttgatgagacaagtaggatgaaaatctgcattctgcaactagaatcgcattaatcctaggtatatagctagatgagtgtgctatgtaaaattaatgtagcagaggtgcaaattttgcaacttaaatttggtttaaattaaggtattatccatatatgtaataaagctggttccatcgaacgtttatatcacaggttatcataaatcatttgttttaatatttgccaacagtctatcaagcctttattactttgtaatttgcaggatgtttttcgcaaagttgtatcacttttatcattattcttacatgcaattttcgaattgtgttgtgatctgtgtgtgaaaaatctcatctttgtagatacttgatttatgtgaagacttgcaaatttgtaaagatttttgttagtgatgtatgaaacgcaagatgttaacctatattttaattatgctgatatggttcttctctttgtgtatttttactgtgtattaacagtgttgcacaatggacgaggacgaagttagcttggaggagatggaggagtataacatggttgctagtaagctttttagaagcgaggaagatggttacaagttttacaatgaatatgcaaggtgtaaaggttttagcattagaagggacaaagtgaagcgatttagtggtaccgagctagtgttctggaggcgattttattgctcatgtgaaggttacaggacgttgaagaactttgagagaaccaataggaaaagggagccacgtgcgttgacccgctgtgggtgtaaggcaatgcttgaaattgagctcaatggagagacaggaatgtggtttgtatcaggttttgaagctagacattcacatagacttgctaaccttgacctggtagctttcttaagatctcatcgtgaggtaaatgatgctcaaaaagctgaggccgtggagcttggagttggcgggcttcgaacatgtcaaataatggaagtaatggagaataataatggtgggtatgataaggttgggttcgtaacgcgagacttgtacaatttttttgcccggtacaagaagaagagaattgaaggtagggacgctgatctcgtggtgaaccatctgatggctcagcaagaacaagacccagattttttctttagatacagtatagatgaaaagggtcgtctgaggaatttattttgggccgacagtcaatcccagcttgactatgaagcattcagtgacgtggtaatatttgatagtacataccgtgtgaaccggtacaatcttccatttgttccttttgttggagctaaccatcatcgaagtacagttatttttgggtgtggtatattgtcaaatgagtctgtttcttcatatgtttggctgctgcaaactcttttggaggcaatgcaccaaaaacatccgaaatcattgatcactgatggggatgcatcaatggcgaaggcaattaggaaggttatgcccaatactgatcatagattgtgtagttggcacattgaggagaacatgaaacgtcacctccgtcggcaaaagcttgcagattttaagaaattcctttatgatgctatggatgttgatgactttgagagatgttgggttgagtataaagcgaagtatggattcaatgaaaataacttatggataagcatgatgtacgagcactattttggaccagctaacgtgaatgagttattatgtactagattgttgacgacatcacacttgctatagaatgctccaaatcctcacaaatccaaaaagataaggtaatcattttattcatctctacgtactttgaattatacatcacaacacatggtttaatatccattaaatatgatatttcatcatagaatgtccaagacattacaagagacagcgaggagagcaaacaatcagaatcatgcatccctactgataaggtaatcaaataattcatctgtacttacattcaattatacatcactacgcaaggtttaatatccattacatatgatatttcatcgtaggatgtccaagacataacgagtgacagcaagaagagcaaacaatcagagtcatgcatccatactgataaggtaatcgtttcatttaattgtacttgcattaattatacatcacaacgcatggtttaatatccattaaaaatgtcatttcatcatagaatgtccaagacataccaagtgacagcgacataaaaacatcagaaaaacgcgtcgacagcacaacacatgccacttcacacaaggtagtcaaaaaattatacttttgttactatttatttgaattacaacagcatatgtctcaaaacttaacaaacacatattatgcaggataggccagaaactgagtcactgacccgaaaactaatcatgctgatagaagagcaaggaaaggagatgaaggagatgaagcagaatcaacagtccatgcataaccaaattcaatcactcaccaacataatagctgcattcaaagaggaaaagacaataccaacttccaagaactctaagccaaatgtttgcaaaagtttcgacaaagaaacacatataattaaaaaaaaggtaagacaacatcttacttcttcagtgtctgtcaaatttaatactaattatttttaaaatgccaattgaatagcagaaaccaaacccaccaactcaaacgcccgtcattgccaagtcactttcaggatcaacatgaagattgcgtaaatcaacaattaaatcaaattctgatttcatctacaatttaggggctacaaagaagaaaccaaagaatgcgcaagcaaagaatttaatatccaatggtaaaagtcctataattatcatcacatcctactctgcttaatttttgtgttgcagttcacttacagatttaacttcaatggcagagttcaagtgcaccgcagaagatgaggaaaccattaaaagtataatgagtgcaccagaatcacaactagtggtgcatatcgatgatgtctcaatttcccaaaaaacaatgcaaattctgactaatccagtgactgaatcaagtacgagctatttggatgatcacgtaagtttactaacccgtgaaactattctctcatgcaactactagcacaatcataacctgccattttcctctacttttaaataatcgatgcatacgttacttgtctacgtgagaaagatatgaaggaaggtacagggactagggcagaaggtacggtgttcctagagaaaccgttaataacaaggttgctacaaagagatggcgaacactatgtttccaaagacatcatcgatcgggcaatggctaaagcaacggcaaatagatatctaaagcatgatatggtaatatttatgccacaatactatcaaattttcagcaagtttatactactaatatatcctacaaatgatttctttgtacagattttcctccccatgaacataaaagaaaaacatcggtacctggcagtcatacacgccaaacgccgcatcatccaagtgcttgactccatggcgaattcatccacacaacgcaaggaactaagaaaagttgtaagtattctacttagaaataaaccaaaaaggacatgaacataccgcagtaatgacgttttctcacaaaccagctagaaggattacaccaatattttcagctgttggaaccagaagaaaagcacatagcaacacaatggcctgaccatcatattacttcctgggaagtcacggtcatacagaatttgccattacaaggagatctgtatgttatgcagccactacaataatagtttttttcactacctaaatgtatgttatcacttctctaatataattcaattcttccagcgtctcatgtgggctctttgtactaaaaaacatggagcactggcaaggcaataggttgtcgaaggaatacacgcatgtaagatgcactaaatatttttgcatcttctttacaagtcctcaattgattgtttctatctaacaaatacctttatgaattttgcaggaagatataaaatattttagaaggaagttagctgcaattttggggggtgctcagaagaaggataaaaagataaactaatggatgttacaccttccaagatactagtcgaaatcaatgactttgttctaattcctttaatataaggagttagtattttcaatagtctgtccagagcaattgagcgtgtaccattttgtgcaacatactctagtatcagcggtgttattttagactaatcaaaactccacaaacaattacacaactgcaagttcaataataaatttaaacctttctatttggaatgttctgaaattctcaaaaaaaatgtacctctgttgtgctgcagctatgacattgctttcttccatcggcagcttcggtatagggcctgttcacgctgtgacatagctagagccagagccatagcatgcaacaagagggtctgcctcgcgacagccatggcctgctgctgctgcggcatgctgccctgccgctgccacctaccgccggccggctgcccctgccgatgcggcagtcaaggtccccagcaggcctcgccctcccgtagacccagcagccggcgacctcccgtagacccagcagccggcgccgatttggggatttttttggaagagatagggttttcggtggccggaaaatacacgagaggaggaaaggagagaaatcgaatcgatttcgatggcggcggcgccgattttggctcccggtggcggcagcgactgtggctgtcgacggcgagggcggcgccgacagaagacagcggtggcggtcgcccatgcgagccgagcggattcggtttgagtcgatgcggtgaaatgtgaaacggatctgactaagtgagctcgtgttaatttacaaaaataccccccatgaaaaaagataaaaagacaaatataccctattcaatttatactgcagtataattaggagggaaatcagataaatttacaccgtcaaatcaaatatactggtagtatatactagcagtagaatgtaccataaaaaaactcagcatcaaacccttcaccgagcgtacagcaagtaatgaaacctctgacactgatagtagtcatgagccaaaatctgactggcttgacacagtaagggggactgctacatctatctattcctgtacagcaagaaactagtcatgcccaagacattaaaccaaacaaaatccctgggatacattcaagcaagatgggcatatcacacaaatccatatcaagtgtctccctgcggccctgctgtatctggatctggtggtcagaaactgatgaaatcgtccttttgttccttcctgtcctgctgagatgaggtgccgcccttcttgccaaatatcatgtcgtcaagatcctgaagcaactcatcagcaccagaacctgctcgcttccctacagtgccatctttagtgcggggggagttctctggctccacggtgactggaatcatggctggctctgcctcaggctctgcaacaacaggttccttgagttctttatacttggagagaaccttctcaagttcatcgtggacactcaatgcctcaaagagctgagcctcgttgtcaccagccgtctcaatgattctctggatggtgcgctgacactgttggcattgctgaaccagggtggtagtcaggtcatcctgcatgcatttgaggtgcaaccagaagtttagaacactaacacgataacagaacactagcaattttatttattggatggaaggcctataaaattaacatatggtagagtaatgttatccagtaactgtaagttaacttcagatattgctacaaaccaaaacttagatgtatatatataatttaccaaactcagatgaccatttatcaaggggaaaaaagagagagagcaggctcaccttgagagcctctttttgtggagaagaagaaagcaccgtggaaagaagttcaacgctattacgagccacctcaaaagcttcattgacttgcacagcaggaacaacgtggactggcgcaaaactttcatctggaatttcttgatacccttcctgtgctgcagcagaatatggttcagctgaaggtgctgaacggggaggagtaaatattggtgccagactctcatcatcacgcccaggaaagcgaattccccttgatcttaagctctgcgaagaatattgaatgtaaactgaataagcctggctaacagaaacccacagtaatagtgtccagatgtaacgattacttcagcctttcagacacaactatgtatgtggtcaacgaatgaagtccgatcgacatacatcagatttctttatcgaatatataaaagcagcaagtttatatgaataatccaccaaatgcgtaaggagaataatagttgcatttgttcttggtagatcgttcataagcattattgtttcaggttaaagtgcactaaattgatgtaagcagaaatcattacttgttatgtaccttgtaagtctcttcatacaccggaaggtagcggagctcatctcctgactctccccatgcttcaataagcataagtgccttgtttctgttgttgactacagtctgtggatcatcgatcagttttaccatctcatcaaggacccgctcagcagcaatctcagagaaagccttctcgcagtttttcacaacggtctcaaggaggacaagagcaagatattgcactcgtggattcttcaacatgatgcgtctcttgatggcacggatcagctcaatgctgttgacatttccagtgttaaccatatcacatatctcaagattggtggcccaatcaggagcatccatggtctccagcgtggcctcatcgactatcttgtccgccatgttctggccttggaagaattctttcatcttgaaactcatgttactgacaccagctgacatcttccggctaacttctgccccacttaccttgagccgctcacccaaggcattgaccttatccatcagattgtcacccatgttgatgtcaatggagggagggctttatctgcagcagcatagagaggccgcatcaagatgaggtaatgaagaagaaaatatttgtctcgtgtgctactagagctatgacaaggctagccaacacaagagaaacatgcaagtagatgaacaaagtgaagaatatgaattccgatctattaacccccaaaaaaaggaatatagtgtgtaattcatagatgagccttgaaataatagacatgatctttgtgtaatactacagcacacatacaactagaaagagtgtactgtgtctgtgtggtctgcccaaatacagagatacaagatgtgggcagcggagcgattttctttgagagaatacagtagatgatacaggtgcacccaagaaattactcctactcgtcaagacatggcatgaactcaagtatcgtagagatggttaaccaaagaaaaggagaagtggaaatttggggatagggttttaggcttagcatcatatgggggcatggattaagcggtaattagtaacctggatcgaacattcgaacccgggggcaacagtaattaattaatctcgaacgagtctatctatgtctctcctcgtaggaggagatggagatggagatggagatgaggcgcgatggatgagatgatcggcaaagaaagagcgcgactaacctggcgtccgccgcgcttcttcgccggcgcaagcgcaacccgcgagcgctgttccactttcccttcgctttggtcccaactccaacgcaagaggacgacgactagtagtcgatggattccttcttctgtatttcccccttgcctagtcttctttgctttcctcgcatctatctaaaagttactggtataagtaggagtattatcgattttggattttatggaaaccctcacgttctctaatacttcagttattattatcaactagaaaaaatacccgtgcattacaacacgggtgaaatatattttaatcttactattattatatggtttagttaagataaaatttattgtgagagtttgcttagatatatatatttttataaaatcatgagctgcagttaggaatccgatcgtctcaggttagcatgcgagttttttaaacatatttcttatatgatttcttatgtattactaaaagtgaacgatcttaataaccgactcaagtacggatatgtatttccaaaaacaaacgaacttaaaaacctactgtgatacacggatgacataccaaaatactagcaaaaacatcttcaatttttataatagtagagataagataaaattccaatagtaatcatacggagggcaatgccacatcttattagggttttcctttcttaaaacctcaccaatatgcatagggatttttgccttgttttttaatcaaattccatcaaagacaccaaaagagtttttccttggatagatcattatcgtaatcatcaaataatctgaattccacatttcgcaaatattttatttatgtctaatgtgacagattaacttccccgcaaaaaaaaatgttacagattaactgtaagattaataaatatgactgaggtttggggttttcattctaaatttagccctaacactaacagttttcttaatataataaatataaatctacaataacaatgtagtagtaacacatttcgagagtcctaatagctgtcgtgtgcatatgtgagtattttacatactaaaaggattttatttttcacatctcgcacatacacaaaatagcgaacgagtatagtacgattattacaacatctgagttgattacatggttattacatactcctgtactccgtatataacaccacccttagccttagaaaatcccatttttcagaactcagagttcagctaaaaaactctttgaattcagagcttgcggtcgcagggacggacgggttcaaagccaatgactcgcttgtttgacagtaatggcctttggcctggattctcaacttcacacgctttctattgctcaatctatttttcagcacccagcttacaagtcccattcatttattactccttttgttatttctcctgtcaccctcgcatatcaacattttcactgttctacacagcccatctttgtcataatatattgatcatcactaaggtgccaacagtgttaacaaccaatttcgcaatagtagttttagatcactgaactagtaatttatccccagaaacaacataaatgaataacttaaagacagcagctctattttatcaacatccaagcaccatattggcgtcaggaagttcagaaacgagtaacatcatcagaatatcagtcagacatgttgcgcccgagtataacttcgaggcaacaaactaagagactatcataacactttgaccattgtatctccaaacctggagatcaaaatcgaatatatatacatggaacaaaaggaaaacaggaaaaaaattaaccgcaaaaaacaaaatcccacatgttgggcttcttctgttaacaagcatgcaccccatagacaacatgccagattgagtgcccaggccgcgttgctgtgcagttctgacccaaagaatactcatatgacgcaataatatttgtgtgcaaacaatgaacgaacgcatcatgtgtggctgggattcagctgggtaaaatcatcatactaggcctgtcaacaatcacagggattttatcagttattgctacatataactcaagtgtgtaccaaatgataccgtgaagagccacctgaccagggccttcaataactcacaagatttgcatgacagtaacagcctccccttcatgattagtatgggttaggataccgaagtttaaaaggttctgccaggaaaaattgcaatgtcggcagcagttcatctgctgtgtcgaaaagaaatgaaggtaacttcattgagaaatccagacctgaaaaataaaaggagtagcacatttgttatgtcattcatcagatagttcctgttgttgagcaaatcacctttggaacagtacatcacaggaggcagtaaatgaggaaaaaaaacatgaaaaaaggtaatttcttgcggctataatgcttgcttcataataataattaataaactacaaaaccagatgtatcgtacagaaacaaggaatcaccatgtgcaaagattttttaagtcaaagtgtattgtgcattatgtggcgcaaccacatgcaatgatgcaaggtatgctctagcatggtaccagctatatctatgttcagctgattttattttaaatgtaagttgtactccatccgaaactcatccaccatgtaacaaaaccaatgaactatacacatgcatgtaaccaataaatactaagattgcttcttaggttccagtcaacaatttaatttaacacagagattacaaataggtcttagacttttggaaaaaccaaaaaatgaaataggtcttagacttttggatggagagagtatatagcaagcttctatagaaattattatgatgtctgctgtatatgccgn

SEQ ID NO: 3567 - DNA, 1161 bp, Oryza sativa
  unsure (1)..(1161): unsure at all n locations
gaacaaagacatcaacttcacaaataaaaaaggaaggtttaacagatgaggcnatatcaataagtaacactatcagtgagcaagtctgaaagtcaaaagttctgtaaactgttacaaaataagaaaggttcttagcctaaaccctggagacaaggggcctacaagagtaacagcaatgagaattttcaaatccaactaccaatctcaagctagcatgggtgaatatcatatgcaaaagtggaatataaactgagctgcacaatgatgaaattacaacttattttgcaccctctacaaaagtaaattgatgtagcttagtttcacgttctgaagaagatatatgcacaaatgtgtctgttcaccctgaaaaataggttaaatgatggggccaacacttgatgcatgattttgacatatccattaatttcagctaccctaacactataaatattcagccattcccagcatagagaaaaaacaatgaaatttgggcaagagttcatcatgatcaataatcagtaagaaggcaaacagagtcctgaaagctaatctaatggttattgttctacctgaagactgggcagaagcacccacccccaccaaagggaattacacaaaaataagtaaaatcggtaaatcattagaaatgcctgttacagtgttacttaacaaaataactagaagtcagagcataacactatccagatattaaacatgataatctacaaccaacattcagaacaaacctcgtcgacattttgggtatgaaccgtaatgtcgctgtactttatctcttcagttactgacaagcctacaccatggaaggatataaccctttgctcaccaatctctttctcaacctattcaaatataaaagtcaaacaaatactctgataaatatgtctaaagtaatacagtaagaggttgcaactgaatataccttctgtggtggaggcataacctcatagcagagcagtgagagtggatatatgtgcccaggaacaccagaatgctccagaagcctcctcatgttgtccactgcagatgcatcaaatggtgcctgtccttgtttttgtaagtagcagacaagatacagacaagtggtaagttggaattatactgatgaactactgtaccatactggtaagcgcatttattcta

SEQ ID NO: 3568 - DNA, 693 bp, Oryza sativa
  unsure (1)..(693): unsure at all n locations
ggcgccccttgaggtgcattgcnnnnnnnnnnnnnnnnnnnnnnatgccattcaccgtcaggcgggtttggttcggtctgaggaggcccagccgctctcctcttggcaggctgggcgctgggctgtaggcaatcacgggcctcctggctactagctgttccctgccgcgcggggcgtcgtcgcccttcggcctttcttttcgggtgcccgtcgtcggtccaaacgccgccaccgacgccggagataccgcgcaacgctaaacgctgagcgtcagcgatctaaaataccaccgccgcgacatgcaacaagacgtacgagaaaacctccgcacacactgagccgaaccgaacagccagcgagcgaccccgtttatccggccaaccaccatccgatcgtgctgcgtacgtgatgggtgcagttgcgatgtggaaaaaaagccgccctataatgggatgcagctggggcaagagggaataataacgaacagcctccaaatctatcgtctgaaaatttcttcgtggagaaagctcaaacccagccgctaaaactggtcaagatttcccgcacatgctgctagctgcggccgtttgacatcgctgccgatccatcgtcaggtattccgtcgagaccgcgacaaaaacgaaaggccgaaagggtgtggaatatcttcaaatcgaaggcatgcaagagcaa

SEQ ID NO: 3569 - DNA, 728 bp, Oryza sativa
  unsure (1)..(728): unsure at all n locations
acgcgggtgatattctactctgttatggcgcatcataccactcaccacgttgataaacgtacagtcgacctgcaggcatgcaagctagacaatttgctttggaaagtctttccattcaccaccttgacgaagcagaagtcgcttaggtaaagcactagtcatgaaattctgatcactctgtataatctgcattttgaaatggcacttgatctttgccttgtgaccttcatcaacataaaacctaacaacagagttatcggcgggatgcttatgcaatttagaggtgttgccggcatcagcgcaacgtgcagctgggttgtcccgctttctcttgaggctacttatgtttcttccacatttatccaataccttttcgttcatcgcagccatggttgctagctgaaatgaaccagagactaataatttctaacaaactaaactccaacaagcctactatttacactaagctaataggcaagcttctgagtgtactcaagttcattatcgacgaggcaaaaaccaaaaagagtcgggtcagaaagaggcataagcgaaatgatcctgaaaatgaaagccagatattagagaacacttccaaaacacaatattttaaatcatcaatacgacagactgcatgccaaagttgcttcaaacaatagccactggtactagcattaaccgttgttgtgtggtaccttaggccgcccgagattgattattggataaan

SEQ ID NO: 3570 - DNA, 8542 bp, Oryza sativa
  unsure (1)..(8542): unsure at all n locations
gagggcnntttgattgtctatcagctctccagtagttcatcatcaggaaaatcattcatatgcttttttgagtacacacaaatgaggtttctgcagggagaaaattcctttatgaaattaatatttccaggcaatagaaacactagaaacagaaaagacaactcagccatatgagcttctggggtggattaaaaaaccttcccatactaaatggcttgcagagaggatctgtaacaaccctatcaccagcaacataaacctacaaaagatggcatattagtgataatgtgattagtcaatagcatatgacgattcacatgtaaattatccaagtatgtccaaattactgtcgtactatgttttcgctgatccatgggttgcttctttcaagcagcaaagcaatgattgctggatctgcttctgtctgatggttagacatcagaacaacattatggccctacaataacaaacaatttcagaaaatgcataagaatctttagtaaacaattaaaagaattattcgacagctctaaagcatgacagaagtatgttaggataattactacaaacacctaagtacctagcgtcgggtgcttccagcaatgacagaaggtcagaagcaacttacacaaaaatcatccggtgtgagggacgtcatgtgctgacatacactggaaacacttttatcactaaagcataagaattggcacatgatgtttgttctcatcattctcttctatcagacatctctaaataactatgaaaccaaaaaatcaaacattgatgtgaggtagatcatatctagttgaagctttcttatggccgtctcttgctgttgatgcttatatatcaaaacccttggaaggaggggaacctctgttagtatgtatcatgatattactatcaacgacgctgggaggattacctctcctgttcatctaaaaaatgaagggtcgattccagagaggtctttggagggtgctatctatcctagttcttttaaccctagatatgtgattcatgggttattggtttgttctgtttactaaaccatggcagcttgcactcaccaagatgttgaagaggattgattatcaaagaagatgtttgatcagaaataaatacagaaaatagatagtacaatggagtttagatgaactaacctgttggagcttctgttccatgtcttggaaaatggatatattaccaacatatgaatttctgggcatatgaaataaaaagttagcatgataaggaagacatacctataagctatacagataaattataacacatgtgaatgttgcaagtttgacggcatgccacggtaataagcaaaaccaaaatgtgttaatagatatcacttttcttgttgaaggtatatctatgactaagccattagttaaaaaaactagctacttatggagaggatgggaacaacaatgtcttcaaggactgggaaagcaggtaatatcttatgctttgattaaagaatattgccttcacctatacagggtatctatatcctcactgcacccatcaaaacaatacggtcatgtcgcgcgacatgacagaaatatctgccatctatgtgaaatgtgattaaagcatttgtgctacaaagtgtggaaatatactaaataccatgaatgggcaaaaaaaggggaagattgaaagggtcctcgatacctataggggaagagatttgcattacctatagtctacaaggggcctaatgtagttctgaccaaacatgtaatagtcgaatggttccctgacagctttgtgataaggcggaaaggtaaacggattctgcaaaaggaggaggcagcttggtataaaagggggcataaaagaaaaatgtcagaggaaatcaggaagataatgacaggaggtagaacctctacatcgagcagaacacaatcgaacagggccaccatgtttgaaagcacgatgtcgtgtgcatttggatccctgctctgcataacctgataaggcagagtatccccgtggccatatgagccgatgatctaattgcaattgcagcagatagaaaagaagaaatgttaccgcgtccttgtagttgtagtatagctcttctagattggcagcgacatctgcaggcagcttccctttctccacttcctttctgatatgcaaaatgagctctgcacatgacaggaatcgagaagtgagcagagcacctcgtggtttcatctcatctagattctagagcatctaaaggtagagtgattttctaggtccaatatatccaaggcacaactaatataaggataataataatcgagcaattcaccaaccaaccatgtccatgcatcgaggattccaatgcgacccccatactaagtagcaatgcgaatgcgaatgcgaatggagtttgtgagattgggaaatggaggggagagaaccttgctcgttgcgcgcgtcgaggaggggagaggggcccaccacctcggaggcgaggacggcgcccttggccggcacccgcggccctcgggccgccggcctccaggcggccttggcttcgaggcggagggcgccgcggcgggagcagcagagcctcgccggcgcgggcaggatggcggtccacgccggcgacggcgaggaggcgagcggcggcgcctgcatagaagaagcttctagaaacctaatccgaaagggggttgttaccctagtggggactgggttgggagtggtcgccggagcgcttcgggatttgtgccaaacccaccctccatctccatctccatctccatctccagcccaattatttctttttctattttctcttgtatatattttcacttccgttgtatcattgcctattgtccccctacgatatcaaaaacgaactgtatcatacgatttgttttcgtagttcttttattagatacggaaacgaatacaaattaccttgaatacaaataagatcgaacacaaatacagaaacaaatatttatcagaacacgaaaccacagacaaataccataatatattttaagctcattttatacacaaagtttgatcataaactaaacatgtacaatattattggtataaatacatgtctaactggtattacaacacataatacatatagtatattttataaaaaaatatttaaaagtttaaataaaattattagtgtggactaatgttaaaagactagaactagagctagaacgaaatggggtatgtttttatgccttcagcgaatatccaaatattattgtgcaccggatatctgtattattatttatagaaaaagtgctcgtgcgttgcaatgggaaaaaaactaatgttatgataatgattatagttattttataattccatgggagttatatgagatagttctaaacataaacaatgaattaaatctatacctaaccctaaattcattcctcttctctcccaccgagagcgatggcggcggcacatttccccacctgtgcagcgaaataatatgatatagttcgatttaatttttattaaattaaccatgattaataacactctttgaaatttgttgttggaattttcggaacttaattgctaattttgacaatacaaacatcatttcagcatttatttaaataaaaatcccaatttctctatgggccattttcagtcgatttactatctcagcccgcaaatcaagtctaatttgcctcccccaactcctcctctgattgcgttgtagacacttgatggcagggccatcaagtgtgtgcagcccggcgatggaggcggcccgaagcggaggtgatctgagccattcgatttgatagatggcttggatcgcctgcgcaccattgaagatgcatgtgcattggaaaccctaaccctcacgttcccccgttctcgatcctgatcctttctcccagcaatgagcgagcggcggtggcggcggcactctctcattccgcgtgcgacagcagcggcggcggtgcccttcccccatcgcgagcgacggcgtcggtttcccctaggaggatccgatggcgttggtggctgcaagtggcggcggcgctgccctcccctaccgcgagtgacagcgtcagcttcccccgggtggattcggcggcgatggtgacttcccacggacggattcagcggcgtcggcggcttcccacggggttgagataagatttgtgcgctttttattatttttcatgttccttttctctttctttggattgtccaattggatttcaatcggatttacggatgaaaaaaattcacggacaacggaagcaaattgaatcggacttttttttgcccgatttttttcaccctgtttttcacgtacggaatcggattcgatttgttttttttattgtgtcgcattttttttaccgcatcacatataatttgattcgatttcgtttcgcccttttttcacggacggacaatggaaacacttctaattttttaagtagtagagatagagatacctatcgaaaactatgataccatattcatattcatatttgagaaaagaatatttgtatctgtatccgtatctagactatccaaaaattatacgcacagaatggtatccatatttgtttttcaccagagcggctgaaaactatatgcttcgttttcactggaccggctgaaaactatccgcttcgttttttctcctagttatctccacttatctactatattcattctgattttcctgataaaacactcttgagtttatggtaaatgcagaaagtttaagtttatatacacaaggtaattgaaacatgtacttaaaaaaatacagtatatttttaatggttgaaggaacaactatgaggaatattttagtactctcgttatcttggtcgcttgggacatttggaaatatagaaccgattgtgctttttcaatattgcaactcctagtgtagcggttgtcactcaagatgtggttaatgaaggtgcactttgatgcttgactagagcatcatagctctaggagaagttggctctagctgtgtgtttagatccaaagtttttcttcaaacttctaactttttcatcacattaaaactttcatacacacataaacttcaaaaatttccatcacatcatttcaatttcaaccaaacttttaattttggcgtgaactaaacacaaactctatagcccttttgtgtcgtagggtgtttgtttgcagttgtattttcttgttatattttttgttgcaagacatgttggtgttaggggaagggggtttctaattccgcaccctttgttattttctatcttgcttaatatataaaatgatgtgtgtatcttatacatgttaaaaaaaatataaacgagcagtaaaatcatgtctccagctatctgaataaaaaacgatattccctcaaatatttgtagaaggaaggatttaaatccaggtaggcttgcacatcaccaccagatccaaggagtcccctcttatccggtacacatatagacctaaattaatcaaaaagcctactaaataagcattgttaaattttgataaaagcatatacgtaaataatgtaagttgctacttctattttatattataagacgctttcattttctttatttgaccaagttcataaaaaatataaacgttttcaataataaacaaacatcgtatcaaaatatattcaatgtttggtttaactaaactaatttggggttataaaaatgattatatttctctataaatttgattaaaattttaaaaaaatgacaaatcgatttatatttagaacggatcggaggggccgggtatgcgaaattggtaaacggtacatcgacaaggcatgttttccatggtcgatggcaagctagagcctagaggtcatggtgattgtaacggagactgtaacggtgattctcatgttataagccattcacaccaatttctagctagtttcctatgcaagatatattgaatcaaacgactaaaaatcatgcactgcaggttagaactgacttgacaattacaaatgaattgccataccgcaagtcattcgctatcaaggatttaagctcaccatatagtcaatcataatgacttgaaaggtcccattcacaaagtcattatgtaaactatactcatttgatagtaacctttttttaaaaaaaaaatcagagacattctagaatctaatatacaaccaagataaaaaataaagcagccagccaactttttttgagaatttgttgttgatttttccccctcagccgcggagtttaggaggaggaaaatcagctacaaagtgctcttctagactttgaaagacgatacgtattggatctatcagtaaaaaaagtggaaacatgtgtttttgaaactccatcaggtcaggtgcaaatatatactacatcaggtattatatagcgtgagtgtttaggcactaataaaaaactaatcagttagtaaaccgcgagacgaatttattaaacctaattaatccatcattagcaagtgtttattgtagcaccacattgtcaaatcatacaacagttaaacttaggccctgtttttttcagcttaagattattataatctagattattgagtcagattactataagctagattgttataatctgtagtagaataagctgttagttgtttctttcctagattattagagcctagattattgggtttgcaagtctaaatagggagtggggtggcatgatgggtaatttttcacccaataatctagaaaaagctcacctaaatgagcttatcaaattatagcaagctgggtttcatactataataagctacttcaataagttgtctgtttctttcagcttactcctaataatctggattataataatcccaagctgaaagaaatagggccttaaaagattcgtctcttaaattagtcgcaatctgtgtaattaattatttttagtctatatttaatacttgatacatatgttaaacgtttggtgtgatagggtaaaattttttttggttgagatctattcagggcctaactgttcaaaaattttcacaatttgaccatttgcaaaaactatttttacaaatgaaccgtccgcaaaacttatttcaaaaataacccttttgttcagcgccaaatcatgtggcgctgagcttagacacctcaacgccaaatagcgtggcgctgaatatgcgttggcatgctgacttagtctcccatccgcgatggcacgacattcagcgccggttgacatggcactgaggtatctaagttcagcgccgagtgatttggcgctgacaaaaaaaaaaggtcatttttaaaataagttttgacggcggttcatttataaaaatggtttttgcaagggtcaaattgtgaaatttttagctaactgttggtatataaacataaagactagaaagcgtcttcaaaggaagttactccgtggccacgtcaccggtaatctaataatgcacgcaaaagaaacaaaaactaagaagtctgaactagtagcagaatactagatggacggctggcgttggagcagagaccgttgactacagatgtgaaccgtcggatggtggctgcctccctcacgacgtccccatttttgcttacgcggcaagaaagaagggaaggcaacttggcatccaaggaagatgcgcgccaaacgctcaccgccagcgtggccccgcgtgcgggtgggcccacatgtcggtgagcggggtgtagggcgtgagcggtaggcgaagtaggaggatgggacacgacaaaggcgtggacctcgcggcccaataattccaccgccgcacgcctctctcccttcctcccctccttccttcctccccgcctcccgctcgttgccttcgccgccgcctcacgccgccgtgatttgagttaggtttttttttttttttgctctgaccagacttgccggcgaaggaaccaccggcgggcaccgcctctcctcggcaatcgttgccggggataaagtggggtcgttaagggagcggtaggtttgggggtttgggattatagatcgaggaagatgaagcaatccatatcgtctatcatctttgtatctactcacgctgctgctgctaactataggtaattattatccatcgatcgattcgtcaccctaatcctcccttcatctggatctgctttttttgtttattgttttaagcaaattttttcgtctccctttccaatttattttattttgtgccagccgatttaggtagatttaagattccctacctgtatacttccttcccaatttattttattttttattttgtccagccgatttaggtagatttaaaattccccacctatatacttgtacgattgatttgctataaacttaatttttctacttatcatatatgaattcgcgttagactcctcttaaatcactattttagtcaaggggttgcccctgtctatgcttgtcagttttcgatgttaaagttaactgaataattctatgaagttccgattaatgaactncttgcngtcatacgaanagcaatcaaaagggagcag

SEQ ID NO: 3571 - DNA, 697 bp, Oryza sativa
  unsure (1)..(697): unsure at all n locations
tgtgtgtaannatttgactacagttggtacagtagttcatcactattgcctgacttgttttaagagaaaaggcaaactagatgttttcccacctgccattctggggatcaaacccgggtggtgcatttcagccccacaccttcactactggggacattgacaaattgttatggtttgctgaacaaaagttcttgtgaagtgataactctttagtgctacagaactgaattatgtcagccactaaataaaataattgtgatcactcttacggaaaggctcttctcgtactttcaccactgaggacattgacaaaatgttctggtttgctgaacaaaagttcttgcaaagtgataactctttagtgctagagaactgaattatgttagccactaaataaaataactgtgagcactcttatggaagggctcttctcatttataccttgtcattgactctgcagctgagatcttcctgggacattgcatttctgcagtgtagaagaagatatggtcgatggattcccctatgaagtgccagaagaatacagcagcatgcctcttctcaaaggaagggctaccgtggacatgaaggttaagattaaggacaatcctaatttagaggattgcgtatttcggattgttctggatggatacaatgctcctgtgactgctgggaacttcttagatctggtggaacg

SEQ ID NO: 3572 - DNA, 717 bp, Oryza sativa
  unsure (1)..(717): unsure at all n locations
ggtgtnnaattgatgatcagtggtacagnagnncatcacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctgtttgtcctcgtcccacatggggacaccttccttcttccacaactgtttaagatcttcgaccagtggtcttaggtacacgtcgatgtcgttaccaggttgcttggggccttgaataataatcggcatcattatgtactttctcttcatgcatagccagggggaggttgtagatacacatcgtaacgggccaagtgctatggccgctgctcatctcttcaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtattcgagtgctttgn

SEQ ID NO: 3573 - DNA, 9404 bp, Oryza sativa
  unsure (1)..(9404): unsure at all n locations
cgcgctccncgagtagatctgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatagtttggctagctgatcaggagctgtgtttgaaatggacctaacagggagatgaattttgcatgagatgggtctagatggaaagaatgcggcaaccaaacacacccattcctgcacacaacatagcatctgagccaggctcatgcagacatcgatccaaacaggctctactgcgaggagagtgtccagtgacatgaaatttcctcatgtctctcaggcctacccacaaaattgtaacaagcttgcactggagtgatcaatctctttcttagaagcttgttgtgctccttggtcttattttctagagtgattttatagtccttgagaaggtactatattttctaatgtaaaatttaggaaaaatttcacaattcttgagagataccgagaggtactaaatttggtacctcctagtaccaaaggtaccaagagatactaaattttacactagaaaatatagtagcctccagtaccgactcaaaaactgtaaaatcactcaaagtttagtacctttcggtactccaggtactaggaggtaacagtttgcactaaaaactttgttaccacttggtatctctcaagaactgtaaaatttctttattttctatgtgtggagcaaatagaggatattaccctatatatgaaaattcactatatgctaactatgttttcacatttaatgtaccatatctatatatttataccagtgcaatctttttttattagctagtagtatacctcatatagatcgatggtgttggtacttgtgatattctattaccaggagagacaagtgtaaaagtaattaacgagtctagaagacatcaatgagggtgagacgacacaataatttcattaattgtctcacatacattcaagcggttcagattgagttctcatccatgtaacttgccgtccggaggaggacgggaagaagagatcaaattaacaacgtgatcgctcttagcgttcaaaataagagattgtttaggcagcaaattaaatcgtcgttagctctcaaggtgtcacagcataaaaattttcagtggaagaggcaaaattttcagcacaatgtgcacctgacagtacactactgtaatgccattcagatcatcgtttcaggtcaggttgatcaatttggcataaaccacaggcttaacatgtacatcaccataaacagtaatggaagtttacggatttgttatcagcagcattccttgaaagttaagaaactgtcatctctgctgtacatggcattcaggtgatcacatccactcaatgaagagtttgatatcaaacgttcaaaccgcccatgagattcagaaattggttccaagaatcaaaccaagagttgcattgcaaggatatctgctgatgcaccaggcagaatgaatataaattactgtatctaaaaacagtgtccagtgaagtccggatgtctgaaacttgcattggaggaagtatggtcagcaaccagcttaccagttgcatatgtttcagctcttggtgcctcccaggcctaccatatcgtagcaaagctatggactgtctaaaatctccatggttcttcttgtttatctcaattaacatcaagctagaaaaacaagattggctacctttcatgcttcttttatatatggagcaaaaaaagatagcatggcatcatatagtatcatgcatgattttaatagctttcgcgaaaaaaatacacgattttaatggaagtgcatctacattattgactgagcaatcaacaaaaatggtggtttatgatctttaacgatccatctcaaaatcattcacccagtcatacaactctacacaatcaagtaaccggatggagtcatgaacttaattcttcatcaattgcatttgtggcgtcaacgagaaactgacacaattccattgccttgtcacacttgcaggacccaccacatggccctcacaagaatgattacaatgccaccaaagacatcatgatgcaatagttcgcaaaacttcatggtcttagcggaaggtgaaaaatgtctgaatctgctataattgtttggacgatgagagttatgctgagatgcagtttattctgaacttgtgaacatatttccacagacaaaatggcaaacaaagtgggtcaatcatgttttacaattccgcatagcatatttcaactacagtccaattcatgaagtgtacgaatagggaacttagtttttttttaaacgaaaagcggcaaaagacttaccgaatatattagaaggaataaaagtcacagtacagacagggaaacaaagaaagcaactagcacgttaaaagagtcatgctatgaattcagaaggtcgaacattgactcttaaaactctttgggccatcagataggccttttagatagatctatttggtctatatttttcctttactaaaaaggccacctgattttcattccgcgagctttgctgaaaaattcttcgattgcgctcaagccgaacgttccactaacttgatggttcccgaggatcttcttcttcatggtccctgacgaaatgtggcaatcccaatagggaacttagttgatggccttctgggtgatgacgaacctaagaagcctaggagatgaaataactcaattttatagatgtttcgtaattaaaaaaatcaacgtaaaatggtgagggaagaacctacacgaggtgaccatcgtacaaagatccaatgttgaacggtgaccagttacatgtactctctcccaaaaatctcatatatcattctttggtttttccaaaaatctaagtcctatttgtagtcactttgtgctaaataaaattgttaatcggaaaccaagaagtcattctaatacttattggttgcatgttcattggtttgccatatggtgagtgagttaattgcttcttggtattgatgcaaaaataaataggtctcaaatttttggaaggagggagtataatgtaatatgattcctggagagatctgaataacttggttaatcatgtctactagcttgagaaatggtgagcaaagaacttagcagattgagactattttgtaattgaaaaattcccggtgcttcctaggccaaactattatggcgataagccacttgaaaaatcttatctccatcaattctccttctctttctcagcctgagatccttattcatattgccttttataggtcaggaaaagggatatggtgatgtaataagtgagctttagtgcaccgtcagatgtggagaatgggatgtttccattgtcttataacgaaatcgttaaattatatatggcagttatataaatattaaggataagatatgtttagagtccttcattattagcgaacagttgactatgcattgaaatcagctttcttgtctctatcgttgtactcctatatatacaattcacgaggctccaaaacaaatcaaccaataatcgcagtatatttctcttcatggactatttaacacaaatgtgatcacatttttttgaaaatgcatttcttaatgcttcttacagttattcaagaaatgaaaggtggagctgatttcaatgcatagtcaactgttcgctacgcaatatatattgatgcaacagaaagctgaagatctagctaattaacgagttacatgttgcattagtgcaaaattcattcaagtggtgttttttgaggacgccctctattaactcaaaaaattgcacttacccacctagataaaccaggtcggtcatctccaaccattcgatcgcgatcgggcagacatgatagtcgaagccagcttgttttcttttttttggtatgacaccttcctttaatccgtatttccaatcaccaagtgctatgtctccccactcatcagcgacgaactacgatatcgaacttgcttcctgtgttgtggacaaacacactggcatcgatctactgttctctcccttccaccaaaatggtccatctggtgcgtcgacctcaacatcgcgccatcgatggctgcacttacaaacttacagaggcagagttccatggaggccaaccttggtcatggcccctccagctttagaaatattgcattattggagtccccaagtctttgatactctaatacttcacaaaatagcacaataaccgttcaaagaagctatcacactgtctctctccaatttattgttcaagctccgccgctgcaagcggagcaagttgctgcgcggtgtttcttttttttttcacgaacacgcagtgtgtgtcagcattagaagaaaagagttttagttatacaacacaataagcctgaccggcccttgccaagtaacaagggagggatagcaggggttgaacaaagagaagggatacaaactaacaaaattgctgctcctagacagaggaagaaaaaaggaaaaggaaccccctatcctcccaataggtcccaaaacgaagcggcactagctaaagactagagcgctgtttctgttaattatcacaaactaaagtacccatgtaactcgccagagatagaagggaagatgaggtcaaatcgtgatatattgcttagttatgagcatttaacaagagatgcaaggaaggtgggaagtctctctttgttttctatctcgatcgtgtgaatgaatctggacaatatttatgaaagacggcacacgaatccaggcagatgtacaagggattggcgtgacaattttacacaaaccaacggctaaaaagggattgcaccacatgtacatcactggagcaagtgaaatttcaccataaaagcagccagctttacgcgagataatagcgaaaggaggagagatttgctccggtccaacaaaaagtacatcgaggtaccagtacctcacggtaccaagtcgtttctgatcgttggatctaaaaatgcccattctatccagctagattcaatgatcggaaataatttagtaccgtgaggtaccggtacctcgagataaccggaacaaatctcaaaagatgaagccctatcgcgaccatgaaattcaggtgaccaaatccactctagaggggcttcatcctgcgaccttgaaggtgcctgccgcaagatacataataaactggttggttgttgctagcattaaaatcaagagctgcatatatgccaaattaaacatgtccactgaattatgaaagtctaaagcttgtttgagaggaagaattgggtcaggcaacagcttaccaataagatgtatgagagctcctgacgtcttccaagcctaccatacaatagcaagccaaccattgggctggctgaactccatgaaatattcttgtttcatctctcttaacatcaagctaaaaaaacatgttgctgctacttcattttatctactcttttatggaattcagcatgtcaactatctagttagtcatgtcaactatcttgagaaatgctgagcaaaaaacttagtagcaggaggctagtttgtaacaggaaagctcccgatgcctcttaggcctaactattatatatggagcaacaagccactggagtggtctatctcccatcaactcttcaatatttgtttttcagtctggtgtcctttctcttgttatatgtggaacaaaatgatacggtcatgtagaaagtgttatagctttgtgcatctttggatgccaggatgtaattattctattatcttaaaaaaataaaaaatatgatcaagtatgatttaaatgctcatcagttactattagctaccacacactgatgcaatagaaggttgcagaacagacacgatttggtttggtggcaaattaatttaagtggtgtttttttgaggaaacctacatttacgtcgaaaaagttagcccattcgataaaccaggtcatatccaaccatttgataggacagatatcagatagctttgtggaagccatggattgttatttttttcaagaagaaacctccttttgtccatatttctagtcatcaaattggcggctttgtactttgttttttcttgatgaaatacagaatacacatttcgccacttccaaaaaaaaaaaaacagagtgggtgaattatgtttttcagaaattcagcatataccattccaaccacagtcatgaagtgtacaggcaggcaacttcgtcgatgggcttctaggcgacgaccaacataagaggcctgagagatgcagtaactcatttttatagaagtttctaagaaaactttcaaggtaaaatggtgatgacgagaacttatgcgtgtgagctgatcatggtacaaagatcacatataaaatggtgaccagttacatataaaatgcaatatgtttccttgatgattgaggaccctgtagctaatcatgtctagttatccgataaatgttgtggtaaagaagttgaaggaatgggctattttgtagtgggaaagctcccggtacctcctaggcctaactttcaacaacaagccactgtagtggcccatcaactcttcatctctttctcaacctggggtcttggatcctgtcttttataatgtcggaaaaaaggataatctgtactccctccatttcattttaggtgtagttataatttttcatgcccaactttgatcgtccgttttatttgaaaattttttaaaaaaatttaaaaacttaagccatgcataaagtactatttgtgttttatcatctcataacaataaaaatactaattataaaaaaattttaaataagacagacgattaaagttgggcacgaaaacttatggttgcacttaaaataggatgatcgaagggagtaataaccgatcatgactttgtgaatcgatcgtcagatgcaacgattgcgatattattattacactatgtttgaaagattgagtgtcatgtttcatacagtcgatttcaatgcagcaaggcaacattcacgcaaggaagagctgcagacaaaattaacgaggcgaggatttggatgggtgcgtcatggattaatacaatggaatacattagcagcatgagatgatccagcaataatcaagagtgatccaaactaaagagttggaatgcttttctttcgtgtatgaggtcctcttttcagtcgaaatactacctccattttttaatatatgacacatttgactttttgacaaacatctaacagttcgagaattacatcgctaactctagcagagtcaactacaactgttcaaccagatcacccgtgcatcagcggaatcagcagttgaactgttgaagttaattaccagcgtctaagaagatccacgagacaacagaaaaggaagaagctgcagtttgctccctagttgaggatatagaccagattgactggacaataaactgttctgcaaccttgaagaagcctacgagatgcagaaacatgtgtcgcatgccaaaacatgtccactgtgccactgcaccagagttctgaaactctgaaacttgcttgagagcagaagtgaaacaacggttatgcaacagtttaccaccggcgtatctgacagctcctgatgcctcccagacctactatacagtagcaactgggcgatgagctccaagaactacttcttttgttcactgatgacttgttgttgttttttcactaccgctgtcaatatatgatcaatgtttactgatgcccatcacttcccaaactaagaaatgatgtcactgaataaagacggccagaaggtgaaaaatgcatttgattggttagttatttggacaaacagaagcacgctaatgcgacagcaggagatgcatcgacagatgcatggtgacctgttacatgttatcgagtctatatagcatctgattgaagtgatcatttaaatacagctatattccagttcaatgcagcacataacttcttttgtactggtggctaaaatgggtttgcacaagcggggacaaccgcctttgagaaaatgtctgtgaaaatgctatatttccataggccgggaagcaaccagctgaggaaatgcatttccacattttaatttttcaggtgaaagaaaggtaaataaattttgtattttagtatgtgtctatacatggtcaatttttcatagctatgcaaaataaatacgaatggtttggtggttatagagagtaaggtgaaaatgcgtgaaactggtaattatgtgaacgaacagaagttcatgcaatttactctgaacttgtgaggacatttgcaaaaacaaaatgaacagagggactgtgaattttgtttttcagaagttcagcgaagcgctttcaaacaacagtgcaattcatgacaatgctgacttcgtcaatgggcttccagatgattgatgatggacatagcactagaaggactgagcgatgcatcaacccatttgtaactatcaatgtttctataaaggggggaaaaaagatgctagaggaaaaatggtgaggttaagaacttaaatgagcctataatgagagaaagatctatataggcaaggtgactagtcacatgtagaatgtaatatgatttcttgatgcaccattcctgtgtggttggtatcttgaaaattcccaagacagttagcaaagaacacactgggaattgacccattgacaggacatttcccggtgtctcccatacctaagtgtcctagaagagatttgctccggtccaacgaaaagtacctcgaggtaccggtacctcacggtaccaaatcgtttatgatagtgactgttataatgctatttttggataggccgggaagcaacctgctgaggaaatgcatttccacattttaatttttaatgtggaagaaaggatgataaactgtgtatcatagaaattggttaaacgggccgactgttccatagggtttccgttggaccataaattattgcggtttatacgacagaaggccaaattgcaagcaactgttatttctctcacaaacaaaggattttgccttttctttggcctccccagcttttttcttattcaaatgaccgatggactgtgaatttttttctgaaaatattttacaaggtttaaacttcagcctttttc

SEQ ID NO: 3574 - DNA, 11067 bp, Oryza sativa
  unsure (1)..(11067): unsure at all n locations
ggagggcaaatcgttacggtcaaaaagtcaatagatataatacgtttttggtggcgattaatcgcattgaatgcttaagctaaattacacctggtatgcgggcgataaaacttgttcccgcaaagcaaaggtccaattagggggagtggatggggcaaagctatttataaggggtcgtggcaacattgtttgcatgggagggaagaacagcaccaagatatgaaaatgttggagtacttggcatacagaacacacggtttcaatggccatgaggaagtatgaaagctgaggtatgaggatatgatgtgtataagtgagcagtcaacggttgctgatataataatagtgcaatgtttgatggcagcatgggtgtaagtgaatatcaaacttccataacttcatgtgattccttagatcaggagcaagacgtaaaatttcaaacaggtatctgtcagcaattcaataagttagatagaagactagtacagaagtacatggcgtaaagagcatatagagataggctngtnggnnnggagcaaatctcgtactagaatgatccacccatatattgatctccatcttcgtcgtctctctctctctctcggcagctttatgtgctgtttaaaagatgcactgtgcatctcttgctagcttctattagtagttattcaagacctgcaactgatgaggttgatcatgagatgattcatcagtagcgaccccacccggaagaaaaggaggggtatttttcataaaataccttcctattatccttgagcaagatcaatgtatgtgtgattaccaattacatatgaaatgtaatttgatccttgagcaagatgtggttattgaagtctactaacttgagaaatgatagtaaagaatttggtaaaaagtgggttatccataataggacagctctcgatacctcccaagcctaccatggcaaaagcaagcagttggagtgatcaatctccatcatttcttcttcagcctctgctccttgatcttgtctttatattcatagagcaagcaggacatggtcatatctgaaaattgagtgtttttttttcagttcagagagtttaatgcttaataacctactagtattactctcttacctaggcacccactaagagattattacattggagcctcatctccagccattcgatcacgatcaataggaccataagaaaggattagaggatggtggaaatactgcctctgctttctattagaaatgatagggatcaaaggacaacgctgtgaaagatgatatggatatgggccgcgtcaaatacgtgcatattgcgacattgaattgatcagatttgctcaaaatgcagaaacttgtatgtatgctaaacttgcatcaactggtttctaattgctagaaaagcatcagcagtagagaggcagaatggtatggcaacagctcaccaccggtttatctcacagctcctgacgcctcccaggcctatgatattagtaactgcagcaagccagtttcttggttgctgaactccatgagctccacttgttcatctctctgaacatcagtgaagaaaaacaagtttgctgctacttcatttcatctgcccttctatggatcaaaaaagaagacagcatagtatcatacacgaatttattgtctgataaacattcagtaatttaagagtagttagggattttgtctcatcttattattggttgtgtgccttatggcagaggcgggtggagtgattggtctcccatactacttctctctctctctcatttcttacttgttggtgtctcaattgagagccccattggttgccctaataagctaaagcaaaagttaaattttaaattttcaaacttaattttgaagttgatttaaaatattttcaacgtgattctttttaagcgttggcttttaaatcgctaagaacacatacataaaagttttacttataaattaatttttattctctaataagccaaatccaatgggagcctgattatttaatcgtctgatctgatgccatcatttcaaagcagaacttagctcgggaaaaactgacgacatgtaattaatgttattgctttaatttcatgggagtggattatataacactgtgatagatcaatgtccccatacatatatattggtagtgatcaatgatattatgacaaaccaatgaatcattgaattgttcttcctctcctgctttgaatagcgaatgttcaacaatgtcacttcacaaaacatagaaaattaattttatgatccttaagagggtatcggaaggtaccacactttctaatatataaaatttaatacttcttagtatctcacatatcgggagatactaagaagtattaaatagacaccacatggcacagcaattttttctaagtgtcacctctcagctctgttctccctcacctctcctctccctcatctccctcaatgaccgatgatgggggcggcagaaaccggcgacggcgaggcgcggaggcggcggggtcggcggggttggcgacggcaaggcgcggggttgccgacagcaaggcgcggggtcggcggcggcaacagcgaggcgtggggtcaacggcggtaacggcgagacggcggggtcggcgcggctcccctcccctccctcctagattcggtcgaaggggggaggggggaggagaggtggcggcggcggcggttcccctccctcccagatccggccggagggaggccggggaaaggcagcggcagtggcgacagttctcctccctcctagatccagccggagggaggctgggggagggcggcggcgacagttcccctccctcccaaatctggctggagggtgccccggggagggcggtggcggcggcagtgcccctgcgcagttcccctaaccctagatcggccgaaggtgggtaggggcgcgggtgtggtggcggagaatttttcttgttcgtcgagatgattttcacaagcgggtgactgggccatttgcgaaaggcattgacatacaggcggatcgttccccgcctgaaaaaaatcatttgtgtccgcctgaataaaccattttctagtagtgagataccaaattttgtactaaaaatcttggttcctctcgatacctcttaagaactataaaatttcaaataagaaattaaagcactaaataaacatgtttggatcttctcaaaaaaaaattaaagattattgtattccgttgattgtatcgtgggtgctgaatattgtgccttcaagaggccccagtcactcatatatagagatgatgcggggtaggattagaaggtagaaaacttagccatatatggctttagttttctggtctctattttttatttatttgaataggattccataccctatattttgtagtacaagaaatcatactatggcctgatttagttcctaactttttcttcaaaccttcaacttttctatcacatcaaaactttcctacacacacaaactttcaacttttcagtcacatcgttccaatttcaatcaaacttttaattttgacgtgacctaaacacaccctaggctagtttgagtctaccttctatctcctagatcaggcccactctcccttcatagccattaattatgcctgtcgtgtgggtacccagatccatgatcgctacagggtcctgtgacttgcgaaattgcagtacaacctactagcaactggatcggttggttgctgtgttcgtttatcgcggtcattgcttcaaaatatcatataggtgtaggcactatataggtgccgaaagtgctaaaaccaaaacctatagtcatttttccatttttacgggttgaaatctcaaaaaaaaaaaaacctttaaacaattataggtgtcggttaaccgacacatattctataggtatcggtttttttttaaaaaaaagacacctttaatatattaatatattataggtgtcagttaattaaaaatcgacacctataatatacggttttaaaaaaaaagatacccgcagaaatcgagctgggccgacaatcgagccaagccagtttttttttattcttgtgacctcaaaggtgccgggcacctttaaatattcacatcagtgccgcctccgtggtgtcgcttgggaaaaccggcacctatgtggggttcccaaccggcactaatgtggttttatgtggcagtgagttgggaacggtttcctatggcatggaaaacggaacagttcattagtgcgattaattaagtataagtctaaaaatagaaaatagattaatataaatttttaaagtaactatctaccatatataaatacatatatgtatatatatatatatataaatacacatatatatatatatatatggtgtgctacctagttacgtaacacctctcacagagtctccttgcgtgtccctactaggcccagcccacccccgcctgcacccaccaaagtaatttttttactatgattagcaccgtctatttatatgtgtttctatccggcagtaaccatccaaccccttatccccgaaatttttggatcatccactcagccggcgaacgcctcaccctgccgtcaagatggccagaccagctgggatgcggtgaagaaggagcggctagtgcagtcagcacagctaggggtcgccaaactccacatcggagtggcgttagaggacctgccgttgagggggagccgccgtcatccgatcagatctggagccaccgtcgccatggctctccaccgcggaggcctaggcagccaaggacacgaggtgactgccaagctcctccaacgcctgccgcagcgccgtccacccctcccgccatcggcgatgttcatgaaggaaacgggatgtaacccgatccgctgggaccagcgccggtggcaccaggagagccgcgacaggtccggggcatcaggcatggcttcctcctccttgctcatcacggaccagcgctgtatcggtgagacctggcggctggaggctggccgtccctgtgctatgcgtggattccaggcagatttggcgctgatggctgacattgcctgcgcagggccacacctgctgctcgtcaatttcttccctatctacaagctgggtcctcaccaacacctgcgacacttctcatgttggtccctagctctgctctcctttatctcctctctttcaattgaaggggtgggtaccagcaaccttcttcttgccagtaaaacaaatagatttttcctcttcgattgtgcggtcttaatttgcaacagtatttttttattttatttttttttgcatttgctcattgattttgttgtagattgccggcacccaaagacagccgaggacttcctgaagctgagccccggccgcaaggttaatttttctctagacgcatcttgattggtatatgtattcgtgttaatcctgagtaacatgaccacagaagaaataatctgcagctgtggttggtattcacactccactatgattgatggaactgatggtttgggtgttgctgatttgggagttggtgacattgaaacaaccactgattgcacaaacacatcaaatatatgtataagttttatgagtctattagtatatgttctttaggttatttttttttgtactagtcttgtatctgacattctgaattgctgacaaatacatgtatgaaattttaggttttttgctgtgccaaaggaataagatgaagtttctgaaatttgatatccactgacaccctgctgaaatcaaacatggcactattattatagcagcaaccgctgactgctcactcaaacacatcaaatcctcaaacctcagctgcgatgctagctcatggagcttgagaccgtgtgttctgcatgcagagtactcgagcatattgtaattttggtgcagtactacagtggcatggaaacaatgtgccggcgtcccttagtcatggctctgcccagccaacccgacgaagtggtcatatgcttagtgtgtaaaaattttattgttcgcagtgtttgtgtagtttagcttgtaattcaatgtgataatcgtcagtaaaaactttatctatcgatgtattattgcggtgaaagtttgacctcaatcttttcaccccaataaaatagagtaaataaattactcaaacaatcttttgtcccaatagaacggagtaattaaattactcacaccaacttaacatggatgttaaccttagtggaagtaaacaaattactaatataaaccaacctcaacaaaaccgactgacggcacaataatttaccgatacatttatgccagtctacaagtgcaatatttgcctcatgagtccgatagtaattttttaactggagggtgggcttataagaagaaaatatgagtccaatagtaattttttaactggagtgtggactttagatggtgggagaccccacgagtaatttttttacggaaacatgtggacagtgattttttaactcgtggctgttggatatatacatgcgtctgggacatgggaatcaaagtaatttttttactcgctcctcctcgtggatatcggatgaggtgtggcatacatatccaaccgaaacagtaaaaagggagaaattcagggtgagtaattttttcacggacgttgggacgcacggggaggagcaatcgaacgaaaatcaggaagcggtggggcgcccaaaaaaaaaaaagcggacctcgctgctgttgtgagtcgcgctactgattcggtagcgcgtgtaacatgctaggtagcgtcaccgtaactactatatgacaccttaagggtgctacgtagcttcgtggcactcctcacaacaaccccatactatctgcacccaccattcttccctattagtaattattttactctcatctcacgctagcagcaccccttaaacacaatcccataccctttaacgtagtaattttttttactcaaatcctccaacctatatatgtagccattttatacggtaggatagattcccaaaattttatccaatgttaccgtttttctcggatctggagaggccgcggagggcgcatcggcaccgatcgggagaggcggcatgatccggcgtggagttggcaggcggcggcgggaccatggcagcgaccggttctatcgtagccaggtaacgaccaacccgagcatgcgggagatggcgacgtgctgcgcatctaacagcgaggggagatgggagacgggctcctctgacagccaacggaacggcgaccccagcgatggctggatccatccaccatgcgacggtggacgacggccccggcgacggtgggatctttcccctatccagagtggccggaggcagaagtggaggattgatacgtcagatctggcacgagcatcaccgctggaaacgaatccacatcggacggcgacctctacacctcaaaatcgccggtgagttcccgactgctacctcgtccacggcgctcctccaggccggcggctgagatccatgatgcgcctctctctctctgtttccttggcaggatccagtacgtctttggtcgttcctgtctccggtcgagattggcggcgactgctggtcgttggcgggcacacccatctctgcatgtgttggttggttgggcgaggaggatggtgatgtcgtccccctccatccctcccctataaaaatgttgcggcgctggaatctagtgtagcgcttcagtcttatggtgttgctagattgggttccgggtttcgacgcctgtgggaggctgcgatgatgaggaggtgcgtcgtggtggcccaacagaaattataaaaattgtagatacactcatagcatgacacatcaatgatagtaaaaatgtagtaaaagaaaagttagtacatatagccttttccctttcattttttgttaacacgtttcacacacggttaaacagtgtgttaaacaaaaaaaaaagccaagcctctctggtgagagttgacgagtttctgcctcatgcagctagggccgaagaccggggaatctgaggtcaaaacttttcatatagaagtttcttaaaaaaacaaataaacctattttttaacattgtaataattattacttaattaatcatgcgctaatggttcatttcgttttgggtgttgctaaaaatcccaccacgtactacttccctctcgagcatgaatgtattgccgtttgtatgtcatcgtcctatgggctgtcatcttatctgaattcctaatggcttgttttgaaacgcgaagttgtaaaagcatatgaatagaaaaaaaaaacaagaatatcgtataatagcatgtataaaacaaaggatttgagaaaatatagaaatttcgtaggaatggatgttgtgatgaaccatgaaaaaacacaggaaacgacagtacgtgcaaagttaattagagagttagccatgctcttatccctaaagaacagtataaacaaagggaaggtccgatgatgatatgatgcttaagccttgcattagtggcatcagagcgcgatttgccttgatcctacacgatgggaacaaaaacaaggtcatactggatgttttttcccactattttcctgcgaaattagcaccatagaaaagatttctccatttttcctatgttccgaatggatgaatatggtaaccatttcccataggaattggaatcttccgtttttccttcaaggatccttcagtccgaatgaaccctaagcaggcatgcatatatgtgatggggagtacctatgcatctttcgaaagaattttataatcatatcacacagatttttaatctttgtattaaaatccaatagatacaataaaagacaaaaagcaactaagaaacaccataatagacactaattaccatatcttcaagaaaaagaccaaatccaatatatatttcaaaacttacatgcgaagattcaaaaattacactgtaatttacaaaagttacaatgtaagtttcataaattacactgtaaatacactataaatttaagtgaaaaaatagagtgagagataagaaaaaaatctttcgagtgagatatagcaaaatcgattctgatgattcaatgtggccgtgacactactttctctgatctcttctccttttctttactataaagttattagtaaatagttaggaaagggtcatctaagaaatacaatactgatgaagaaagtttatatagaaattaatcgtactttaaaaaagtgtggcacaaataatttggtatccagccggggctatatataagaactgaaaaaaaggggccaattaattgtggggccaagagggaagccaggtaatgttgtgtctatttaagcttcgtctcagctggagtctcgcatccatggaaagaggccggccggtaccaagcgggaaaggtttaggagagcttaaggaagacacaagctagctatagctagtgtgcagtgcaactgaactgatctagctcgatcacagttgttatcagttatggtatatcttaattactatactcgtcttcttcctgctactcgatcatatatctactcgtttactagctataattactgttgaggtgtttatatatatatatatatatatatatatatatatatatatatatatatatatatatatatgtgtgtgtgtgtgtgtgtgtgaaaactattctacatccggcgtatagctattatataccccccctctctcctaagggcggctcaacccacctcccctctctttcaagggttcaaaacccacctcccacctcagttaaaagtcggtcaaagcattctcacattgatcaaatcccggtcaagccgcctactaactcctcccaccaaccacctcttctcagctctcgtctcgcagaacggtgcagtaacacgacgatcactatgtcttacgtgtagtaacgaagttcgaatatagttgaaatatagtcatgacggatctactcttgataagtactttttttagcatcatggtgcaaacggttttaaaaaaatatacatcacgtgagagatattgttctttaaacattgattttttggaatttgactctccacaggtagtaatactatagcattcttgttactattttctgttttacgttattacaatcgcatcacgacgttactgtaaaagtgcaatacagattataaattttatagtaacaatgcatcttactgtaattcttgggtagtgttactgtattttttatatagtgttactgcataaatatatggtaacgtgtgtctatcatgtagtaacactttcacttttgtgcagtaacaagtatatttagcatgtaaaacttttatatatgtgtgtattattattaattaatttggcatatatatgcaggatggacgtcgacagccccagcccggaccagctacagtgtggcgaaacatggacgaaaaccaatcgttccggcagcaaatcgatgcccttaacgaaaggataagaatcctggagaggtacattgaagaaaagaagagggaattcgataacctacaacagcaatacgacacgctccggtaagcgcatgcaggatgtcctcgtagatactaaaatgaaagactacgcacatacatgcatgtatgtgcgtagtctttcattttagtatctacatgtgtatatatatatctacgtacgtacgtacctgcatatactatacatacatgcgtgtgtatactccaacctagctagtatgagtgtgaagggagtatactatattatattatttgtgcgaataatgaaactctgcaggcatgctgagcatggcttttgctggagctagctagcatatgttaacatgttcctaaacggatcgaaatcctctaacttactttcatctgcacttatgctcaaagtcagatataaaataaatttgaggttccttttccgtacctaaacccgatcaatcacatgtcttttcctgccttggagctggaagcagaccgattggcaaattaaagtggtcagcgtaaacaaattttgtaaatttgtttgtggctcatggggccccggcaccattggtgaaattgtgttattacc

SEQ ID NO: 3575 - DNA, 10713 bp, Oryza sativa
  unsure (1)..(10713): unsure at all n locations
atatatatatatatatatatatatatatatatatatatatatatatatatatatatatatatatatatatatatatatatatatatatatatatatatatatatataccacctatttgctactaccgggagtagttactctctccgcttactggatcgggttagtggaataacccataatccaataacgggtgggagtattcgattcattagacccggtaacagtcattggcattagtagcgatcgaattgagggcacatagagagggagtagctactcccggtagtagcatataattttcaatatatatatatatatcaataaatttaaatctttagtgctcacaatacgggccgggtgtttttttttttagaaattagctagtgaggttagggattaacagctaatgtctctctttgtgtgctttaatttgtgcttgtgttaaagggacacactagcttataggtacttctgcctatattgacttgtgcactcttgcgtgtctaccttacaatatcacaaaaaattattttatatatttacattaactttggcgtatacttatgaacacctcccgtagctggtgctactgtcgcacctacctttatgctgcaacatccatagccaaatccctgtgatatcacaactacctagctaagaaaatggatctttctcgcgatgggccaggctaaaccatcaagaaaatagggaaaagcatgattaaatatttgagtaaattttgtaaaactataaatattttgatcatactatcacaaaactacatatttaagtagtatattacagcactattgatttaactgttataaaatcagtccaaaatcaccattagaaaccaaacgcaaaagtaacatcataggagaaccaatcaagatgacgacaccgagacacaatatttgttaatgaggtttagcaaaagtctacatgcctatgacactgattacggatactcatttctgatccagcatattacaacgtttcaaagttacaacgaccctctgtcaatgccgccgacaaccgttcccttttgtcgatatgggtacaataggtccgaccttctatgagacgatgcatgcactggatgcctcgtataggacagcatacaactcacgcctcctggtgcctcccaagcgtagagatatcatcgcaataacaagtcactggaatgatctatgtccatgaactcatattgctgtcttatttgctaatcattttgccctgtccactcatccatcatccattttgtatctgacggacagttttggttgttaatttcagagaagaaaaaaaatgggggattgaattgttaccttggataagctcaaagagcacatataaattgtgtacaataggaggaggaaattaaatactaaactgcccttagcatactaactcacacatatatacttaacattattggtgaatctgtttgaatcataatttggcttgtagttagtttatttggccatgccaaattatttagaatagctatcgtatttgttgagttatagatttgggaaccaattaaatatctagacgaagcaggtatatacactatggtctatagagattaggtgcaggtgattgatgggcatgtagccaagatggagaagcagtgatgggggtcacatagtgcatggcctgatgggagtttattggttgttattagctgttcacatggagatatatatatatatatatatatatatatatatatatcaatctaacgttcttttctattttatttttatggctgagttatagcgaccctagaatttagttaatctttatcgttttgcgctaaaaaacggttgtgcttctctacaaaagcgagaaggttatcatttgctagtttactcagaaactagtcgttcgtcgtcatgtaagtacgatatttatcttctttactaatctgctcgtaaattagtcgtttgattccacgaaagtaaattaatcttgaaatcggttccgctagccggttttgatctatcgattttggcggctctgttgattacaccataaatcgttaggtgatctcatattggccatgaaaaagcgtcaatagaatcccagaagacattttcgtagaacgacatgagagcagtaggagaactactcccaagcagagaactactactatacgagtaagggacatcaccttccaattcttcaactgagctgagcaccatcagttctctgtacagtagtaggtgctgtagatattgaagtggaattacagtgttcaattatcgcatcaccatctgagacatgcataaacttttgttcggcaccaggaggcgtgagttgtatgctgtcctattacgaggacacacgaacacacgaacgagaagaaaaactctcaagatgagagagatcgcatttcttgcatattgttcggcacaggaggcatcaggacttaccatgctacatgctttggggagagtaagttacaaaattgccttaattatcaccatttggcttcagttccagtcaaaattttgctctgcgtgcttaaactaaatttagagatcgaacatgctatgaagattatcgaactaatggctactatgtgctaacatgcagtatctgcatagcgcggcgatgactgaaatatttgagcacattggtttatcagagaagcagacaatgtcctctcaaaagaagaatcatggacaattcacccgaggaacacaacgatcagggcctgattaagtcataaacccagtgctcaacaaaatctgcttggtaaagacccatcttccaaaatccatggattataagtgtcaggaataggagagtgctccacgacggttgcaacagtcgggatgccatatatcagtattcagggttgttgtataatactctaccattgccgtgttttactgttgagatcatcacaacgctatcttaagtcctatctggccctgtttgtcacaattttccttccttttgtactcgcacaaaaaaatgggagagggttccctttgtttttcagtccacatgccactaattgctggtgctaaattcaatataacccgcacatcgaccattattgcgcaaggaatcctgcatctgtgtgtgacatggtgatctcactttcatccatcttgtttttttctactcaagagcaattgagcaaagagcagagcaagatgaaaacatgagggcagaacagaagagcaaaacaaagcattttttctgtacttgttttttttttttacataataagtgatgattgagtccgcccaacaagaagcccatatttcaccgggcgatatgttttggcccatactttgccgtcagttttgtgggcccacttaaagtgatgggccgatttaactggcccacgcggtgaaggagcagcccatatatataataaaaaggaataagttcactttaggttcctcaaaattgacattgagtatcaactttgatcttaagacagtatggctcttggttttattcaatactacctttactcttttagaattaatatttgaaaatgtatttgtaaatattgtatgaaataacacaaattaaagttgtatagttgactgaaagtgacatattaattagctttagaaaatttagggccccaatttacattttgttccgggccccaaaatcctgaagacggccctgctgcctgcctactttaagttgtggagaacacaaaacaaatacatgagctgatcatcttcttaatcatatatccttcaaatcatatgcttgattgatgtgccacgttggacgaaaccggaagtcgtactgcattgagaccaaagttgacacgatattgggagttggggaatgaactgtgtctggtatttcggttcaaagatgaatttcatactcgacgttaaattgaaggacctaaagtgaataaaaaaaccaccaatgcctcccaggcctaccactggacaggctcaactccatgagctccccttgttcatagtctctaaatatcaagctacaaaaacattcatgttgctgctacttcatttcatttgcgctttaattgagcaatggagataacatagcatcatacaggaattagtcgttccaggacctgcagctttcttcaatgcgcagttggtttgattctgatgtttgctcatcaaaagcaggggggaaagggtgtagttacacagcattgtgatgaatcaatcaatgtattgaaatggatctcatccacataactgactgagcaatcaacaaattaaataattcactcagtgatacaactctacatcgtcatgtcatcatgtgatgaaacaatcaaatctttaaaggtgtagaagctacgaggggagcaggtgataaacaaattctataatgaaatgcaatattggagcaaagcatgagcagaggggaataggaaatccgttaccatgagttaatccattaatagttagtattacttagcagtttattttgtttcactctaatctcatctttatattgcacatttcttctatcaatacagcacaagcggccctacttgttctccagaaataactcatgaagtttagaagttgcatggcttatttcatggacctacaggtgatcctaaaccaaagaaatgtgtggcttctttcacagatcaccatcgtaacaggacagctcttgattcctcctaagcctaccaccgcaaaaaaacaagccactcggagtgatcgatctccatactacttttctctcatatcttcctcaacccgtgctccttgtcttgtcttttatatgtagagcaaataggacatgatcatatatgaaaattgagggggggggggttcagtactattagaataagtgtcgaatatactagtcctatttgattacagttagacttggagttgtaataggtgttagggggtagagttagagtcggactctgtaacccggcatttctcttaaatagagaaggggcaccacaatgtaaccatgcgactacaacgtagtacacgcagggagatgatggcggcgtggccatggactcatagcggctaggtgctatgttggttggggaggagcgcccataatcagagccccggggatgtaggcttcggctgaacctcgttaaaaaatatcgtgtgttcatgtgtcatcatctggcatgtcttgggtggtcaatgattgaaacgatcgagaaggttagttgtcgttccgctatatcgactaacttttataacaagtacagctgactacaatgctcaatatataaactagaaataggtacactatattagctaggcagtactgaaacaaacagaaagctgagaccaaattaacaaggtgatgattttgatcattgacacagcaatcaacaaatgagatggttggtattatttattctttagcaatccatcagaaaatcattacccgatcatacaactctacaacatctctaatccattccaatcacgatcaagcggaccagattaatcattcgcaagcagaggatgtctctttttcacaaaacaacaacgtgaaaggtgaaagcaggaagctagcacgaacaatttgaggagttcagcaagttataaatcaccagctaaataaactgcatcacatgtacatcattggaagcatctcaacggttactcgggaaaccggacggaggagaagactcgtgctgtgtccttgatgttgaggtgatcatgacctcttggtcttgcgacttggaataagcctacgagatgcagaaactggtcagttgggttgttgctaatatcaaatgaaagaattgcagtgaactactaaaatcagaaacttgactacttgagtgagaagcaaaatggtcagacaagcagcagaagattgcttaccatcggcgcatttgacggctcctgatgtcttccaggcctacctgggctgcctgaaccccatgaactcttcttgatcatcgatctctgataaaaaccaaataatcaatcaagaaaaacaagctgctgctacttcatttcgtctgctgttttatggagcagaggagatagaatgctatcatacaggaattaattgtctgattccatgcaatcactcaagacatgcagccgagatcaatgtgcagctatgcccctgctttgattctgatagttttctgaacaaatccaaagggaagggaaaaataaggaaaataaaaccaaaagtcctgaccatttgtactatatccccactaagttgagactttaatcttggagtacatgttacagaagtaagaaggactaacaagaacaaagagtacaacaaaaaaaaaagattgaaacaaattgaaattttgggccaaatattttcgtgccagtgggtctcggaaattttgaaacgaacttgcaaaccatggttggcagtataagtaagtctagccccttggatttaagatgatgatgggcatggatcacttctactagcagtagagacctctgtaaaatttaccaattttgtgtcaatactaagtaatatttggtctgatgtagctgctcaacaccctcattttttagtacttcaatgtagcacataaatgtatgtccacgtaactgagactggattatctaacattgtgatagatcaatatcccaatacatatatattggtagtgatcaatgagattatggcagaccaataatgaatcattgaattgtactcttcatctcctgctttcaatagtataatgaattttcaccaatgctacttcaccaaactaagaaaaataattttatggttcttaaggagggtactaggaggtacaacactttttcatataaaatttgatacctattagtatctcacgcattaggatgtaccaatttttctaattaaaaatcttggtccctctcagtacctcttaaggactataaaatttctcaattaagaaatgaagcactgaataaagacgtttggatgttctcaaaaaaattaaagatgtttggtttggctgtcatggagaaaggtgaacaatgcatgaaattggtaattgttttttgttcgtgaaattgataattatttggatgaacagaagcatatgctcctaaagtttactctgaccttgtaaggacattttggaaaaatataaacgaacagatggattgaattatgtcttttctgaagttcagctaagtgcatattccaactacagtccaattcatggcatttagacgttcgcgcgcgtgttgttcctcagatgagcttccagttaatgatgggcctagcaggcctgaatgatgcatcaacctaataattgtatcaaattttatagggacaatgaaagaaaatctggatgtaaaatgctgtgagagaaagatataaattgattcctggggcatctctctcatttggttcattgggtatactgaacgctcagccaaaaagcactgcaggtaagcgacctattcacaggacatctcccggtgcctcccatgccgaattaccatggttaaatccaaggtttattttctgccaagaaatttggcatcaatttatcagataatctcattaccacacatcacatctatacatagcactggtttgatcgatcgaaggctgcacgagcacagcagccaagctgcaagcttcaacagcactcgtgctactgatcacaaagcaccgatgtaactcgctggagggcgacgagaagatgatatcaagattaacaacgtcatactaccagttaaaaaaatattcccaccatcccaatttgatcatcgtctttataaagagatttactccagtctaacaaaaagtatctcaaggtatcaatacctcacggtaccaaatcattttcgatcgttagatctaacaatgtccagcttgatccaacgatcggaaacgatttgataccgtgagataccggtatctcgaggtactttttgctggactggagcaaatctcatttataaatgggcatcaagaccaaggcaagaaaacatccttccttaaattaaatcttatcgattaaggtgagcatgtaacgatgctatttactcctgtacagataaatgaattgacatgcagcgatgacattgactcctgctcatataaacaaccagacatgctacaatgctatttaattttgcacaaataaacgaataggcacagttagatgatcatgaatttgggaagacctcaaaaatcttacgagatgatcaatataggatggagggagtagagatgtgtcgggggtattagaggtatttctcatctctattgtactcaatatatgtcattggcgctaactcaatatatacacaacaaatctattccctatttctattattcactagagttaacatggtatcagtgcaccggattcatctgtccagttgacgtcgtcttcttccagctgtgcggcctgaagaagccagcaagatgcagcagcaggtttgctagcatcaaatgatcaagagctcctaccatcaaatgcagaattcagcaaattcgctgtaatagagcagctcctggtgtctcccaagcctactagctagctcccatatcgataaccaactagccattggaatgaacaatctccatctacatgtactcctttatatgtagagcaaacaggagtcaggacatggccgtatctgaaaattgattgttttgttcagtacagctgagctcaatgcataataaaccactagtattattactctgtattagctaggcagtactgatgcaaacagaaaaaaaaactgagaccaaattaacgaggtgacagttctaattggtgccaaatttattttgtgactactaatttatcagataaacaccaataatgtcaggaagtggtgttttgcgtaggaaacccctctttgaagtcgaaatatgtcttttaaaaaagtcgaaatatcctttaactcacctgagaattggaacgctatcatcgatccaagctgtctcattgattgagcatttgagctactggcttataaaccaagaaaaataaagccaaaaaatgaaaataaataattttctagtaagacttttatactgctaagactattcttagcagttcaaaacccaagctgaaaaaaaagggcaaaatcaactttaaaaagttctaaattcaaattttcactattgctccctggtgattcaaatcgtcgccaaccaaatctaaaaaagttaaaaaaaaaactgaagttttcgggcgaaatcgattagtgcaggggggtccgaaatttcagaagacgagatcagattataacaatgtttgccctctgcatttaacaagagatcaaaggatgatggattgatgggaagtctctgtgtctgttttttttctctaatatggacaagattgtgtaagatggcacaccgatccatacagataagcacgattatcagctgaatttcgaacaaaccatgagcaaaaagaactcaactgagatcccctgcagtgcagtactgcagacgacctgcatccaaaagaactgtatcacatgtacaccaccgaattaaatcagtggcatctccaggaaattcttcttgggtgtgactaagtattttataaagtatatttacaacatatttctcatctagagatagtcgaattctgtctggctgtacaatatttaccgtgtagtggattagcaaacaacaaagagagatgtgcaccacacattgccagcgacgacattacccccaatgactaacgtagccggccagctgccgccccaagctgcccatcctcaccaccaacaagccaccttcaaatagtgtaatttgcaactttaccctctcatatccttgattctttggataattattcccttccttgtactatttttaaatgagatggagaaaatagtagggcaaggattcagaagaggagtaaaaatctcagccaccacctatatgggtttgctacattcagttgttcggcagtgtatcaaggtgacatgtgaactcctgatacctcctaggccaacgaacatgaaaatttagtttctagttccatgaacaatgttcctctctctctctctctctctctctctctctctctctctctctctctctctctctctctagcatttgtgtccattgatctatatatcatatgatctaatgccatcatttaaatgcagaacttagctctggaaaaactagagacgtgtaattaatgctaattctttcttgagagtggactatctaacattgtgatagatcaatatctccatatatataaagtggtagtgatcgatgagattatgacagaccaatgaatcattgaattgttctccttcatctcctgctttcaatagtataatgaatgttcaccaatgccacttcaccaaactaagaaaattaattttatggttcttaagaaggctaccgggaggtaccacactttttactttaaaatttaatacctttttgtatctcacgtactaggatttatgagtacaaaatttttgcaccaaaaatctttccctctcggtaactcttaaagactataaagtttctcaattaagaaataaaagctctaaaccaagacatttggatcttctcaaaaaaaattaaagatgtttggtttggctgtcatggagaaaggcaaacaatgcatgaaattagtaattttctttttacgtgaaattgacaattatttggatgaacagaannnnnnnnnnnnnnnnnnnnnnnnnnnnnnnnnnnnnnnnnnnnnnnnnnnnnnnnnnnnnaatgggatgctaacaatggncgcgc

SEQ ID NO: 3576 - DNA, 756 bp, Oryza sativa
cccccccccccttgagtgcatacactactcgtaagggcgcattacgacataataccgcatgatgcgccataggccattctggctgctgcactgtgtgggaacggcaaacggtgcatttctcttcgatagaacaccacttagcgcaaggggtgtttgcctttatgcgagacagtcggatcacacctgtgttattccttttgcgaagatgcaaaagtactggtttagagcttttatttcttaattgagaaactttatagtctttaagagttaccgggagggaaagatttttggtgcaaaaattttgtactcataaatactagtacgtgagatacaaaaaggtattaaattttaaagtaaaaagtgtggtaccttccggtagccttcttaagaaccataaaattaattttcttagtttggtgaagtggcattggtgaacattcattatactattggaagcaggagatgaaggagaacaattcaatgattcattggtctgtcataatctcatcgatcactaccactttatatatatggggatatgatctatcacaatgttagataggcccactctcaagaaagattagcattaaatacacggttctagtttttccagagctaagttctggatttaaatgatgggcttagatcatatgatatatagatcaatggacacaaatgctttacagagagagagagagagagagagagagagagatagagagagagagagagagagaggaccattgttattgaact

SEQ ID NO: 3577 - DNA, 882 bp, Oryza sativa
  unsure (1)..(882): unsure at all n locations
cccacccctcggttcgtgccctcctcgattcgtgttgttgcgccgcacggcgcgatggacggcttagttcgagtgttttctgcccggggacttacttccncccccccccccccgagcccttggttgaaccctgctactgcattactcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacactttcacttttgtgcagtaacaagtatatttagcatgtaaaacttttatatatgtggggattattattaattaatttggcatatatatgcaggatggacgtcgacagccccagcccggaccagctacagtgtggcgaaacatggacgaaaaccaatcgttccggcagcaaatcgatgcccttaacgaaaggataagaatcctggagaggtacattgaagaaaagaagaaggaattcgataacctacaacagcaatacgacacgctccggtaagcgcatgcaggatgtcctcgtagatactaaaaaggaagactccgcccctccttccatgtatgtgcgtaagtctttcatattacgaactaacacgggcatct

SEQ ID NO: 3578 - DNA, 758 bp, Oryza sativa
  unsure (1)..(758): unsure at all n locations
tgatgggnannnnnnttgaagtacagctctatgaacnacnncataatgtgtaagcgctaccctggaaaagacgggaaggctgcgctgttgacaggcggaccccacatgtcaactctaagggaccacggtggaccgagtacatagagacggtccacgggtcgacgaaagcggaccccgtgtgtcaaccgaggcgagtggccgcaaacggactccactagacaccacgcgggctacacacgtagaaaccatgcggctaccgagcgggcacattaacacggacaccacacgcacacacgaacgactaccgacaccggtacacgggtaccggggtcgacaaccgcacaatgggcacagggcgataccgaaaggacgaggagggacccttaccatcacgcgacaaggcgtggaatgacgacgacgaacgggcgcggcggagatggctcggggacgacggaggcgaacagcgaggggacgactttggcggcgattcttggacgaaagcgagacgcggccggcgcagggcttgacgacgcggagccgaggacgaagacgacgaggaggctacagcacacttgacgaaacgcgggcggcaaacgcaaacggcttgacggagggacgaacgccacgacgatcgggaacgacgagaggacgacgacgaccaaggccagtaaagaggcgacgatggcagccgacagcagttgcatagaggtgaggacggcgtgnaacacgccgctacaatgccgacgacggaagtggcg

SEQ ID NO: 3579 - DNA, 1274 bp, Oryza sativa
  unsure (1)..(1274): unsure at all n locations
aacaaagtggcaggtttggattttaaatcacctttttaattgggatgaagttgaggatttggagggtaaataacttgatttgaactacgattatgtttgttatttagagaagaaaggtgtgtccggttcctgctagtgttttcttatttttctcttatgaccctagtgtttcgatcttcttctatgatctgtatgtgcttaatgatctagtttgttatatcggtcagatgaagaaggtgggcacaaagacgttgacaacacagccgcccgcggcgacaatgatgatggcggcggcggcggtgacaacgatgatggcagccgtggcggcaacaacgatgatggcagtgacgacggcggtgccagcggcggcggagacggcgacaatgatgatggcggcggcggtgtcggtgcagcacacgccggcacaggtaatacacttaagtgtttttttttgctcagcttgtttactgaatgagcctttgcatgtagctatgcatgcacagtaccatgcaaaccatgagtaatcttgttgttgttgcttgatcgcggtcgatatataccatgagtaaacatgacaaaactatgcaaaccatgcaaatcatgactgcaatatatgcacgtactaagcatcatcaaccatgtctaggtatcaatatcaagaggaggaggcactaccctcctgatgtaaaacgaaccatatatgccaagttattagagaaatcaaatcctggcatgatgaaggagggagtgacaaagtcagttgctaatgaaatgggggtgccgttgagagatgtccaacgcgtatggcgacatatacagattggagatggaattgaagcttttgagtccaagaagaagaagtattgtggcacaaaaaacttccgtgtgatcctagtgtcatcaaagatgtgccgcttggacaacgccatagcatccgtgacctagcccaccgctttggttatggaaaagccccattgtttcggcttcgcaagaaggattgttacgcgccatcaaaaggcataatgttcaccccgacccgaatataacctgtaggnncgtgggcttatgtgctatacaagggcttgaatggttaagcaatatgggccccccctaactttcaaaaggggggttaccggcatttccgtggtcagaaattggtttttagggacaagggtttccaccattttttccttgggtaaggcgataggaaatcctaaagaaacgggggttctttggaaagggaatgtgtaaacgaaaccaaggtcctcccaggg

SEQ ID NO: 3580 - DNA, 1632 bp, Oryza sativa
  unsure (1)..(1632): unsure at all n locations
nttgcgtgagntcnannnccgtagttagatangttanaantcaccannnnagnannnaaaaanacaccttntaatgcaagtaacataggctgattgtgaatagtttatccacatgaacatactatttttaccatnctccacatnattgttgttttcctatggaagagccaaaatatccccaccccgcataatcttagaacctgacatgtntacttctgcacacaacgtaaaaatattgcaaacattttaatctcagatgaaccgaactgtcattttaatctcaaaagaatcaaattacattttaacctttccaataatttgcaggcaatgagtgaagaatctttgcaaacatgtctttgagcttcccatttgatgtcattgctttcaatatcttgtcattgaatatcactttctgtgaaaagtgaagaatctttacaaacatgtctttgagctcccccatgtgatgtcattgcttccaatatgttgtcattgaaaatcacttcttgtgagattttgaaccctgcaggctgtggtaatgtggtttttccgaaaacaacagtttggacatatgatccttcctagcttgtctatcatatttgactttctcctatgttcctttctgcgattagattgtttgagtacaccaattctatatgcatggcctatcaccttccatacaacatcgatgagaatttcacgtgatgccccaacaagtgtaatgccttcatagaaccaaggttgtttaatctcaaaataatcaaattacatctagatctagtaatagtatggagcttagatcaccattacatggcaacaattaatcccagttttagtattcaagcaataaaccttttaatgcaagtcacatagcctgattgtgaatagtttatccacatgaacattctaagcttaccattctccacattattgtgcttttcctatggagaagccaaaatattaaatattgattaatcttagaacctgacatgtctacttctgcacacaacgtaaaaatattgcaaacattttaatctcagatgaaccgaactgtcattttaatctcaaaagatcaaattacattttaacctttccataatttgcaggcaatgagtgaagaatcttttgcaacatgtctttgagcttcccaattgatgtcaattgcttctaatatctggccatggaaaataactttttgggaaaagggaaaaattttaccaaccttgcttttggcttcccaagggaaggcaatgctttcaatatgtgtggaatggaaataactttttgtgagaattttaaccctgtcagctgtggttatgtggttttttccaaaacacaaagttggacctatgagaccttctagattggtatcatatttgacattctcccaaggtccttttgcgaatagaatggtgagtacacccatttatatgcatgggctattaacttcatacaacaattatgagaatattcgtgatgcgccacacatgtgattctttatataaaccagttggttaactccaaataatccaattcactttgaactcttaatagtgttgggcctttaacaccctttcatgggacacattaatcccgtttaggattctagccaataccctttaaaggacgggcaat

SEQ ID NO: 3581 - DNA, 1580 bp, Oryza sativa
  unsure (1)..(1580): unsure at all n locations
gcgcgcctttgagtgcgcatcgcattggacncnncncanattagnacacaatatcccctcgaccaattctataggcatggcctatcgcctgccttacaatagaagggtttttatgttttattgatgagaatttcacgcgatgccccaacaagtgtaatgccttcacaaaaccaatgttgttaaaatcgccaccttgaatttaaaaccataaaatcgtacaatcaagcacattttaattacaatcgtaaattcataaaatcatatgacaaaatcgagtctttgacaaccttgtacaacactccttcgttgatgcaaccattacattagcattgtgtttcatgtcattgaaggcctccacggcttcttgaaattttactaggacatttccactcatctacaggatctccttattttcggtccaattgaacattgtgctaagctggtccatgatgaaagacagttattcatgatattgactgagcatatgcactcactctttcatggcttcaccacaaatggacaatctccaagacaaaccttgtgatctccaagacaatctccaagacaagccatgcatatatatatgtttgtatatactatatacatacatatacaaattttattcataagtatgtatagcatacacatacatatatacgtacaaaagagatataggggtgatttgttgtcgtctagcgcgcaccacgcacggcgcacggttatccgcccatcagcaccccagaccgctcctcttctcgagcgaagaaccctagcgccgccgccctcttgatttccctccccgcacgtttcctccacaaattaattgccaaaattgtttccttacattgtgggcattatttcccctcttgaattgcattcgatcgagcctttaatcaccgtgggagacgcctgtttcctctctgccttcaatggctggtttcccacttcgccggtgccgatctccctgcctagcgccgttccttctccctagtggcttatataagcccgccggaggagtgtcctcgccagtgaccagtgaagacgccatcgtcttcttcctccaacagcgcatccaacctcaccggagtgccatcccgcaacgccgtcgctgccgccagcctcgcctcattgagatcttcctcgtccacgccttcaccaagatcagcaagcaccggacctccatcctcaccgtcaacccgagctacccacctctccttcttcgtcagccggaagtgattgtagctcaccggtggcagtgataatggcatgttgacatcagatctatgaccaatggaccggatgcaaacatggaagcactggtggagaaaccatctttggtcggtcggccgaaatccacaatagtcccggttccactaaaaactgggacatctttagtcccggatcaaaaggttagagctacttttttgatctttagtcccagttggtaacatcaaccaggactaaagatcatttttagtccccgtttaaaagacagcaagctgtgtcagacccctctgtatatttagtcacgggtggtaacacccacccgcactaaagatctatttntaggctcggntgtg

SEQ ID NO: 3582 - DNA, 15687 bp, Oryza sativa
  unsure (1)..(15687): unsure at all n locations
cgcactggtgattgacattgcagctggcacattggcacatcatatacatcccacttgatttgggagaaaataaaaagaaaatggaccaaccgggactgcccctatcctctctttagtctcggttggtagcattaaccgggactaaagatccctctttttagtcccggttggttaccaactgggattaaagatcgatgtttactctcgattatttcacccgggacttaagccctgggactacaggggttataaaccgggagtaaagatgatttctctatcagtgaaggataccagtgaaggagaggatgactgttgtgaagaggagggaagctttattatttttggcatcttcacaatttttttctggattttctttcttattgaaaaattctagattcatcttattgaagaagataaaaatggattgaataagtcgaccttggaatcagggtaccttttctttaacatttatcattttcttttcgcgcggatgtttctagaattacctggatgttgctactctcttcattttcttgtgctccgttgatgcatgcacgtgggcagcgtttcccatggccaagcacagtgaggtttgttttaatcctaaaatccttaattaatttatcttaaaggttaactccaattaatcaacgataaactaaaaggcgacataatttatttatttatttagtaaaattaaaccttttccaattacaaagattttattaagttattttaggtaaataaacacggatgtgaattttcgagttcaggaaaattaaaaaacacgaaaaacgggagtaagatgcctcagtgctccatctctgtatctccaacccccaaaatgatggttgatccccataaccaaacatgatacgaaaatcatcccaagttaccaacgggcccgggaccatcccatcctatattttctctaaaccgaattcatgattattactccctctatttcgtattttaagtcgtttaactttttttcataaacaaattttgttatgtttgactaagtttatagaaaaatctagcaacatttattaattagttcgttaaatctaacattgaatatattttaacaatatatttgttttgggttcaaaacattaatatatttttctataaatttgatcgaattaattaaatgaagtttgactagagaaaaagtcaaacgtcttatataatatgaaacttaaaacttagagagtagaattatctgtgcgctattgtcaagagccataacaagtgggtctgatttaaaaccttatccaatccaaaacgtacacatctactccagcagtccagccccgtgttcagatctttgattcttgagagaaggcgtgcacgaacggatcggtttcactagaaaacggcgaaagggccctatcgaaaaaaaaagtagtagtagtccacagcccggcccaatacgcatcagattctaatcggagacgaaatccgagccgacttcgctctctggctctcgcaccgtcgcacgaatttgcctattatatctggctttttctgaatctgaaggggatcacacagcgaaggctccaagcacgcgcatgtctgacgagagacaggaggctgttgttgttgcggaagaagccgagcagacgaaggagatggagcgcgtgcgaggtaatagcagcagcagtaagcgctcagagcctgtggatcttgtcaaggaggaggaggaggatggggaggactggttcgatgcgttgttgagaaaactcggccaccccttcaccgtcgacgagaagggcaggtccgtcccagatcccgactggtgtccctacgcccacggagatcccagacacgtgctctatgttgataggagaaacacccccgacgtcgatatgttcgctttcattctcggacagatgtacgtatcctgatcctttctttctaagttcttgcttttattgatttgggttcataaacctctcgtttcatttacatatgctattaatcatgtttactctagctagctatagtattactttctgtcatagaatacaaggaagtatgaatttggtagtatgtcaataataagtgttctaacaaagccgggctggttggtatgatattatttggtttgctttttgtaaagtataaaagtcttactatataatcaaaaattggttgctttgtttatttttcttggcttacttataagccatagttgcaacaatgagacattgacgataataactatatcttggccgacgtatttaggataaggtcagtgatactattgtgttaatttgaaaactattgctggtcatgggcaatgggcactgctctagtagagctaactataaaaaccatcatacatatgaaatatgcaatgctcatacaatttatagcatttgcattactttttttttcttaaacaagctgacaataattcataagattatgtattctatagtttaaagttccatgcatgtttaattaattagtgtaactgccaattcgatatagtttacactttgctaattatgattactcttcgatgctagacctgtggatgatgctgatgacagggaaaagggcatctggaatgcttctatggtttacatgagagctcaaaacatggtaatgcatttagttagtgcttgggatacctttcttgaatttttatcatttcctttgtcaataataaaatcaatgtaatataatattggagtaaaaaagaaaaacggatatagcattcccaaaagatcgatcggattacatattgcattcactttgtgatagtgctcttacctgatttacccacaatgcaactaccaacatgtatatgcaattgatgctctttgaccagttgaccatagttagagaatttatgcaactgcaaactaatttaaattcttctacacatgcatgtcaaattattcagagtcatttgcgcatggaaagacacaagtcataagataatattattataaataagtcgagaaaatgttaagctattacatttctttttaccagatgctactacataaatttgcatttaatagcatttaaccattcaaaagtcaacttcttttgacatgctttaatttggtgaactagcaaaggtaaaagagaagccacattatttagttcatctggggcaatatcattgcttgaagtccataaaactttttggggaactatttcttctggatagagtatgtcctattatgttccttaggatttttagtgtgtttcatctagttatgacttatcagaagacaaggtccaagaaaataattccagaaaaaattctcctaatggtggtgctagctccactgaataaaataaaagaaagaccagacggttcttatctaatttgaaacaaatttgaataataatcagtgttggatgtgcttgcagtcatagttgtcaattggaaccaaatattcgtcataaattttttatttaattaaggtataaaccagaagaatttgtggatcttagtttaaaaattagtgtttgtggcctcgtgggaactactggcaagtggaaaccattcaattacataaatgggatatccaacgacctttctggaagttattataaggctagtagaattgtgttacaatttgttcctcccatacaatatgccaactcatttctggtttatgcatatgttacattcaaaattctgacttctaaagtgctagtactaattattatattttctttagtcgtcagagtatgatatggttccaaacaacttggtcttgtatcctatgatgtttgagaagcgccgttggtatcactgtaacatcttgggatgtaaacgtttaaacgattctacgggggaacactccacacaacaacggttttttgttgagcttatcattaatggtggattcatctaccatgtgctttcttgcaccaaagttggtatgccatttcttcctttttaatctgatgttaatgtttcatgtcataattccatcattttataaatttgtttttatcaaatttcccttttgtagatggtgacatcgacaacaatctatgtatagcttgtccgcccaacagtggcatagtgcatccacctgcaggtggatttatttgtggggtttcgaaagatcagaagatattcaaggtccccttctattaattagaatttagattttagagcttatatagcaatagtagaattagttgggccttttttggttgttttctatttttcagccttagctttaagtagacagctaagaatagaagtacaacatgttttgccctaatattatttttttgttgcttgcacttactgtctttgccttataagttgtaaaaaaaagctaccaatgtctttgtggaaactctatgatgtatacgctgtcatgtcatgtaacttatatgctttattttcctatctattattctcatgttggatgttctaccagctgcctgttggtacaggtggcacaaccctattttttgacgcatgtactattggcggctgttaaataccaaattcacgccgtcaatacctgcataaaactgaaatataatataaaatatccaacatagtagtagggtttatttctaacaaaatccacaagtgttggcgtatatttagatgcaggtgacaaactactagagttgagaagaaatatacataaagaaggaagataatcaaactcatattcaagcctatggagttttgggggccacaaacctaacgaaacacgttcaaatgggcccattcaccaaacatatgggttgagggattctccaccagagcccaggagaaaaggctgggtcaaatgggccagccatggtttggtcgaaccgacattggtgctgttcgccatcttcttccacgtggacgatctagatagcctcctaatgacggtggagaggtagttgggacatttccaactgccaaaccgtcatatgaaggctataaaaggagctcacatgcttcatttcaatacacaccaaagcatgagctgaattataagaggctctattgcatctttttttacattagaatagggagaaattaaagaagaaagagtcagaggaattccagagttgtcggtactttcctctttactttgtgtaccttgtcaagtactcagctttaattgatattatctttatcgagtaattgagatttgctttctgaggattatctcttagttcctggatcattgttcactatttgtcaattaatagataatgattactttagtgtttagataacgctagagtagtaattaattgcatagatgcgatgttaaggttgttaattaccggtgattgttgcgtatcccacagttcgttagaagttggtgtagaggtggtgacagcccttgagatcactgcagtccttcttgttcgggtacggagtatagtgcgttctggtagcagtgagcaagctagtgcctgaagtattgcgatagaattgaataaactttctatagacaatgttcctcactaggaaatcctctctaccctttgcctatttttgctttgtgtccttggatgaagaggagctgaacacacatgttccctattaaaattcgatatcttcgtgcgcttgcggatttcatctgtgaccgtaagaaatatcaacatgtacgagtgagcgagcccgagctagcttaacgccgcctgtacacggttgcgcatggctcatgcagcatcattagccaggtgccacacatgattaaatggactaggtagacccacgtaggaagaaagaaaagatgaaaagattggtctatcactatacgcatttatttggatacttatgtttacggcataattttgacaaattaatccttctataaaaattattttaataataaaccgtgtcaaaaactaatttcaaaaatagatcgtgacctcagtgctaccctgataatgctaaactaaaatgtctcagtgcacctaacgtggcacaaattagacatgtaaaagtaactcagcgtcactatacattacactgacatcttaatataggtttaaaatatacggcatgtgctgaaatcatgagtagtattaaactttatccgttttataaaaaagtgcctataagtaataaaaatagacaaaacaattttaaagttaagaagtgaatttaaatgtattcgagtaattcatagcacatacatatgtaattttcagttattaaatagaccaagattagtattactatgttttaagcatatggttaaggttatagcatatatactttagaaaagtgctatcacgaattgtgtgtatcgttaggtattcttgcagaacgcaattaatcctagaatgagttcatattggtatatgtatttctccctgaaaagagaaaatgaacgtgcatttttccaaaaagaaaaaaaaagatatgttcaaagtgcttaaatacaaaacgtgcaatttcattaaaaacaatttacttattcacccaataaaacctagctagcgtatgttactactctttctgcagtcttttactaacacaaaattaagaaaaaaatatttaagagttttgtggattgtaagttttctataaacaattaacacgaaatgagtttattcatgtaaaatcttatgtattcttacttgacaagagaacataaatagcatgtttgtgttatataccaatagatctgttatagttttgttcatcgtgtattttaaacctaaattttaaaacccattaattaatattacaggatataaatattgcacgcgccaacgggcacatcgattttctagttatgttccattatgggggaattccaggaaattggaaaatgaaaatatcgcttacttctcaaaaaaaaaacaattgtctctgcaatctcttatttatcaaagccattttgtacttataccagatatgcggataatccaaccattatttgacatgttaagttttgaacactcgaaccgattaactcctcatagcacgatgttcaatgttactaaaaaaaattgtattgatgctggttgcgaaacccccataggtgccgggttttctagccgacacccctcaggtggcaccgatgacaaaagccatcgactagcacctatagcatatagacagttgtaaccatgaaccgacacctatatattgttataggtgccagttcttggcccccaagcgccatgtggtggttgttgtcacagcctgattttcgtttcaggatttataaattacttaataaattattaatagaatttatattaaatgttcattaatttacaagtgaagttaaatgtgggaaataaaatttcctaaatataaagcatggctggatttaatttttattaaattctccatgattaattatactctttgaaattttctcagatttttcagagctcaattcctaaatgatacaaagaacagttcaataattagttaatcaataatcattaatgatctagttataattatgttaaatgcttttctcgtttaaaaatccttaaattataaattgtggtttaaaaggaattattagaaatgatcttaaaagcctaaaagagaagatctaattttaatttgttaaatctcaatataaaagtgggctagataaaattttgttaaatacttctcttgtttctatagttcctagatttttctgggatttatttgagccaaggaagtatttttaatcaatggaatatcatttcatgaataatttaaatataaaaaggttttaaatctctcttttagctttgggccgaaagtcagcccaagtctctctcaccctcctttcagcctgctcgcgcccggcccaagccggcccagaccgccgcgcccctccctcctctcttccttttgctgacaggtgggactcacctgtcagtcgtcttcaacctccggccgcatttagccgcgccgcaagccgccgcctccttccaaaatccggccgcccctttccttctccggccaaatcaattgaggggaaataatctcctcgatctcctcttccttttctctttaggaatcccgacctaattcgtttggaaatcatcggattcaatgccgatttggttagcttctctttccaaaaccctagaccttccatctccttgccgccggccatgggcctccatcgccgccccctagcccctataaaaggacctccgggacctcctctccacatcaccatctccacctttgactgccgccttctctagcgccgcctctgtgtggctctttgcgtcgtcgccgccggcgggtgtccagtcgggcgccgccgtcccttcgattgtcgtcgtcggacgccgtctccttcatcagcatcgcgaggtcatcgccgtcctcgtcccgtcttccgtttccgccgcagatcaccgaagcgcagccgacactgtcgacccgaagctctccaccgtcgccgtcggtccagccgtgccgtgccaccgttgcagccaccgccttcggtcgtcgtcgccaccgtcgggatcacgaggaggagcagcacctcgtccaccccttcgttgccgccgtttcccaccgaagcaccgccgtcaccgccgacccgaagaccgccgtcgtcatccatcgtcgtttgccgtcgtccaagccactggtgagttcgctgagccgagctctacgcgttggtgccctccgtttgcgccgccgtgccgtcgttcgccggcgagcacgaggtgccgagccgccgccggagatgacatcatcgctgatgttagcactttgtcagccgtagacccgtggtagaccggatcgatctcggccgttcgattcagtcaattttaggtcaattagatcttggccgttggttccgtggaccgcttctgtgaacccggtttaccatggaccgtctttgatgatgcaataaatctattttccttttcaaaaataattctttattgcgtcataattcaatttaaaatccatataaatgctttaatgcggtttaatctttagaaatgcataactaattcattgtaactcggtttaatgtggttcaagttgcaaaagttgtataaaataaagatctatatattaaaattatccataaattgtgttaaatttatttaatcctttttaaatgggctttaattagattaaatcttgtacaattcgtaattaattcatatgaagtcagaatgaggccattcaagtctcataattcatctaaaattatgatctacatgtttgtttactttatatgtattgtttatttggagtttcttagtctttttcctcgttttgcgtgttagcttgtcgtttccgtcattgtgaaggttcgcgagtgtgtcggaagtgttccagaagacaaattgaagacccattattgcaagtcaagtcacacagatcccaaacataattcctttgagcatgttgatcctatatttaaattctctatttatttcaactgtgcattttttttcgaatgtcatcgggtggtgtgaacctattcctttgttatggccaatttgcattgattaccctatttcttgattacctcgggttataatttgactagttggatttatatattggttcaattagatatattagatataattacttagtcatgcttagaaacattagcacactattgggataactaaggtttcactattacttaatgatgtacatggcaaagatagctcatgatggtcaatcgtgattggttaattaattaatttgccaactaaaacttgataatggtgggttgtgagcacatggttttgatgatagtgctcatgaaaattaaggaccggttcacaagtttcggttgtgaaacattaaccatgccaaccacaagccagaatgggcaacgactggacactttctatagcaaagctcattgtggtgtgccagactgagaagtggcggagataagcccacgggggtcgctggagagtccatgcctctggtttttgagggggtgactatgatccaggaaaggtgtgctgctttgagttgagctatgcgaggggtcttgtcacaactacacaaatggtgacatgttcagcatgggcacataatgatatggtgacatattatggagttgtgtcttgtgggtacagtggtacacctctagctagagtaaaactattcgaatagccatgcccgcggttatgggcgggtctaacaatgtctttcgtgattagtcctacactactcattaataataatgtggtaattgatggtaattaatttagctcctggtttggaatgacacatccctggtttggagatagatctgtacagccgggtatggttattcaggaaggttgggcctgtgcagtatggatgtgctattcagtgttgataaatattgatgattaattactctactgttttacaattctcaaatgtttgctaaatgctgcttttgcaaatgagccctatattatgccattctttggtatccttgtgcacttgcatatttgctgtgtggcttgctaagtatgtcatatgctcaccttgcaataatcaatcaaacctcagttgaagacaagttgcgaaggagaagacgtttgacttataccccagttgagttgcctgtgggagtggagccggagcttcgctagaccgtaattccgctgctattttcttttcttttgtaagtatgtaacgttattattatgatgaatctgtatattaaattatctgtttgtgtaccttggctgattcctggacgaggattttatgcacaaattggttcggaaattactagtgaatttctgggcgtgatagttgtcaaaggtgtcgtttctacgtaacatttgacacctataagaatatattggtgttggttatcgcttgagctggacacgtggcagcactataggggtcggtttttaccaacaactgtcacctatatgccggtatgaaaaaaaatagtagaccttacaaatttcacagaatcataaaaaatcacagatcatacacgatacattcaaagacacaggtacacatccacatggacaatgcattaaccatcaatacatatatctcccaaaatccctcgcaaagttcagtttgaaacattcacattcaacacacaaatatatatctctactattataaaaattgaagatgtttttatcagtactttggtacgtcatccgtatttgagttggttttaaagttcatttcatttggaaatacaaatccgtttttgagttgtttgtttaagttcattcgttttacaaatacgggagacatataagaaatatcttttaagaaactatgcatgctacctttagatgatcggactccgatcctaattgcagctcatgcgaattcccacagtgaattttaccttagttaaaccgtacaacaataataaaattaaaatagtcttcactcattacaatgaacggatattttttcctaatacatgcatatatgtatgtatacatacaaatatagggacataataaagcgcacatacggtgcacaataactaaaatgctcccctcacctactctccccacccaccaaaaccccccacccccaccccaaaaacaaaaaacccacacccctccccaatccaattttttccgtctgcactccgttccccatttcttttttttttgtttttttccttctgtttacttcattggcccatgggtaaaaagattactagctctactatcaacctacgagtaaaagtattactgagagaaagaaaggccattagtaaacccatgtacttatattattgagatctgctatacgtccgaccaagttatacgactagcgtacaactaaaacagcgaacggtgacggcgtgaagtgatgctgtagattggacctgtgccacaagcccatacactctcatatcatatacataggcccatgtacaagtctaaacccacaatatcatgtcaacatggccgcatgatgcttctgccgaagctttaggtcaatctgaaatgctgaatccactcactgtcaacttgatctcaacattctagtattattttcagtgtagcagatgttaccaagaccagttcatacaactaggtaaagcaagttattttttttattcttttatatagtgtaaccaccaagatcagtttttataactagcttatcattattgattgcgcttatgtcaacaattaagctatgcatgattaactgagggccataagcatttgaatagcatgtgaaaacccacttatactgtcacagccgtaacatacaaacaaatcgtcttaacggacttgtacaatgtaatgatatgaatagaagaaactaagaaaataattgaaaattagcacctgaagaagatccattaaaagctcatgtaagacggtgattccacgcacacgcgaatctgttagtagtatttgtttgttgctgattgcacgaacgcggtcagacatggtagttagccacgattgtgactggcttttggaaggcccaacgagaatgagattcggatcacagcccaaactggtcagctcgcagacgtcacatacgccgtcaccgtggtcgtacgagagttggacgctcgtgatcgtacttaaagcattttcctttttttcttttgggaatttgaatggtaaaaattgctctgaaaattggcacatgatggttctttttttgagcctcaaatgggagcatcgattttattcatctttagtaaaagatggagtatatatttacagctcttagttcgtttgggatggttgggaaccaaactcctccgcacggaaaacgaaacaatctattagcacgtgattaaataaatattagctattttttttcaaaaatggaacaatatgattttttaaacgactttcgtataaaaactttttacaaaatacgcaccaaaatagcagtttgaaaagcgtacgcgcggaaaacgataagggagagttgggaagcaaagtgttccctaaaaaactgatttgaagttggtgagagaacatgacaaacatacttcgacatgtgggactttgtctatagtctgtgtattacagctcatgtttttagttcatataatatcatgtatgccactatgattaggctcctttgacgcacgttgcagggacatgtgcctccaatgtgtgggaccgtgaaggtgagccccacatcttagggactcacgcccctatgtgtaagaggagctgatttcaagccattgatgaccgaattacaagcctcatctttttcttatgcctatgcttataagccagaatttaaatttttaaccttcaatttagagttgattttgggtttttttgataacatttattcagagccaagcaatacctaagttcatccaagcacgatagaccttccaatcaatacatctgaatatatgaaaggcacatagaggacggtacaatagatgccgaaacagctaaaatcggcacctatagtactttttccatccacacaggtacccgtgggggcgtcaaacgaaaaaaccacgtcaccttccaatggaaataggtgctgcttttttaaatagaaccaatacttatatttcctgtcagagataggtgccggttccatataaaatccaacacctttgacatgcatcccatcagaattgttggtcgtgaggcccaccctataaccggcacctttgaggctgtcatagaaaggtgtccattcttagctagaaccagcaactttgactctaccacctagctagtagccattgaagggcccacacttaaaaattggcacctatatttttgttagagatatgtgtcgattctagttaaaaaccggcacctactatcacaatatataccactttcctgtcccctcaagctgatcgagcgaagaacagagcggcacctcttgttcttgcttgaccagctataggaggagggaggttttgctctattttttttttgtcttgttggagcttgaagcatacaaggttagttttcattattatttctcactccatttcactcttgcatgttgaattgaatcgtttgctacatacacatataaagtgcgcaaccgaaacaaattatttgtatttgttttgtaggggaaatatttttttatcatttttgtgttcatttaattatatcatcctcagatgagaccacatgctaattttgaattgaaatattgacatgagagtatgtatttgacaggactacacgacaaagtactccacctggttggagcgcaccccacatgggcctcacttgggtcggggttccagatgaagttacaagcaaataggcccatcataggtttcgcaacacattgtttctgtgattgtggatgactgagataaaatttggcgatgagactggattcgttggaaaaaggactgtgagagcttttcatcaagtacacatggaccaaaaacggagaaggtggacgaattggattccagcacttggaggacttgatcatgatgtcattttattgatccatgatatgaacaacaattatattcatagtagccatggtcacatcaacatcttattgttattacaagtgcggatatttttaacccatgatgaaaaaataaaggaaaacgtactccctccatccacaaaagttgcacatattacttttgacaccaagaccaaggagaaattaaatcaccttggatgttacaaaatcaataagtgaatccaagcatgcaaccaataagcatttagatgactccttgggttctaataaaacatttaatttatctcttcattaagtcttgaatgcataaagactacaaataggaacaacttatttggaaaaactcaaatatgtaatatgtgtaacttttgaggatggagggagtacgaattagccctccgaactatcgcggtcaaccaaattaccccctaaacccgaaaaccagacatcgttcacccagaacttttaataacggacaaattatccccctcaaaccaatccagaatggttttatcctacgtggcgtacacatggcagaccagtcactcttcccctctctctcttctctctcgcgggtcggcggcaggctagggacacggagcggtggtagcgggtgacgcagaggcggcaaggaacgaggaggtggcggcggctatggccgcggccacgacgagcagccgccccctcggcatggggatggatggcggcgggggcgggcggagggcggacgtggacggcggacacggagaccctcctgcaccggagggagttcgccggagctccttcctggagttcgccgctccctcctctctgtcccgcactgtcgccgcctccacgttctgcatcgccgcttcttcctcgtccccggccgccgccgcctccatccggacacgcaggggcggtcggcccgggaatgggcggggttgcggcggcgcactgggggtgggcggtcagcgcggggacggacggtgggcggcgacacgcacggcgcgcccttgcctcgcccgctagggcaaccgccgccgtgtgccgacctcccccattccctcgccttttcaccgtgcccctggctcgcctgccatgggcggcgtcatgcgccaacctcctccattccctttacctgtcgggttgacggcggtcacggtgctcgcctgcccatccacaggcgcttgcacccaccggccatctcgattcaaagtggtcctccgattaacgtgatacggggcgcgctctggcctcccccgctattgaatatcgaatgcgtatcgatctggactgtggcatccttngtcgtgaatgaatcaagggtctcgcccccc

SEQ ID NO: 3583 - DNA, 17836 bp, Oryza sativa
  unsure (1)..(17836): unsure at all n locations
agcattggggggttagaagtttatgcgattaaganataaaggnaacttccccttccccatcgacctcccccatcccctccacctccccgggcgcgtttgcccgcccgtccatgagcaccaccacacgctcactgcccgtccccgcgcctcaattaagagagagagaaagagaagaagaggggaagatgataggtgggtcccatcttttttttaaaaaaaaaaaggtgctgactggattgccacgcatacgccacgtaggacaaaccgctatagattgagtcgaggggggtaattcgtctactattaaaagttgaaggtgaataatgcatgtctggttttcgggttaaggggggtaattcgatcgaccgcgatagctaggggggtaatttgtactttttccaaaaataaaatccagttgttgaaaaaaaaaggttttatattgtgaaatttgcaagatttggaagggttatttctgtcgaaagacaaataggccgacctaaacataactgtcgtgattacggaagtgctaatgggcgatcgatcgcccggcgacaagggtagcgatcgatcccccttcccccctccctccacctggtttcctttttggcaccgcattactttcctattttagtaaatttatgtacctaaagtttatacacctcaagtttacacatctaaagtttatacacctcaagtttacacatctaaagtttagagaccaaaagtttataagtcaaaagtttatatatccgattcaaatttgaatttgaattcaaatattttttatatatagtatttctatacatctaaagtttatagagctgaagtttatagacccaaagtttataagtcaaaagtttacatacccgattcaaatttgaatttgaattatgtcgggaatcaaatttgaatttgaattcaaatattttctatatatagtatttttatgcatctaaagtttatacaactaaagtttatagacccaaagtttataagtcaaaagtttacatacccgattcaaatttgaatttgaattatatccgttcaaatttgaatctgaattcaaatattttctatatatagtatttctatacatctaaagtttatacacctaaagtttataaacccaaagtttataagtcaaaagtttacatacccgattcaaatttgaatttatattcaaatattaatttatagacccaaagtttataggtcaaaagtttacatacccgtttcaaatttgaatttgaattcaaatattagtttatagacccaaagtttataagtaaaaagtttacatacccatttcaaatttaaattttaattcaaatttatatggtgtagcagtaagagaagaaggggaggtaaagtagtaaaggggaggtgcgggtgatcgcttggaaggggagggagcgatcacccgtccgttaggagtaccctgcagactagttcaggataaaatagtgcaggaggaaagcaaagataaaaaagacgggggaaatactacgcaaggaagataatcaagaagtcgtgggctcgtggctatatccttgccgtttacgtgaaatcaacaaggccaaacggcagagaatacgtatcgatcggggtggtgaaaaacccaacctcccccgccgtacgccctcccgaactgatcgacgccggcgccgccaaatcttttcactcctcgagtgctcgatccgccgtgatcatccccgcaattcgcctccgtgctccgcgcctccgccccgctgtccgctataggtaagccgccatctgtaaagtctcattggaagcttatacgtaattcacaaaggtatacacgttattcggtatcttcattcgtttttctccttttattttcttaataatgaataataaatccagccctacatggagatgaatgtacatgggctccttttattttcttaataatgaataatcaatccagccctacatgtctacatgtgagatgaatgtacatgggcacacatggccaatcatcatttgttggaatcgtatgctttgagtttcagaattagtgctatgttttactagaacatgcatctcatcagctgcaaatataatgcttctcgtgagggggagaaacgtttaagcttggtggctcggttcaaaattaattgctcccatgacttggttgctccgactgatctagttttctttttaaataaaaattatttaattgtgaatgaaagtcgttttcacctaggctatgctcgttagtttgttagcaaaaataatctggaatgatataaaaaataagcaaatcataaaaaagttaaatctgatgaaagctcgacaaagacctgatcaagctttttttttccccacaatgttgctactgaagactaattttctatttattcagttttaactgaacttatattgcattcatggttcaaatatcttacaattctggttgaattatacgtcttctagtccagatggttactactttatctttcgtgtcgttttggttcaagaaaagttgttctgcatgtactttattgagggggtacgttttttttcagtactaactagacaaaattgctttgtttatatatactccagcacaggaaaaagtgtcacgaactgttgatagctgatgcatggcaagttcaactccacaatggcaaacgatacgaacaacacctcctcctctgtcattgctactgaaaccacgagcgcgtcacatgtaatcaagattgatggatacacagtaactaaggatctgatggagaatggcgaatttgtgtcatctatcccgttcagtgttggggacttcctctggaacgtcagatactaccccaatggcaactgctcaaagaacgcagactacctgtcgttttctgtgtttcttgagtctcactgggccgaggacgtgaaggcaaagttcagcttcaaactgctggacacgaataataaaccggtgcgatcgcgcaacttcatctccaatacgcacaatttcagcagaagaggttcaaactggggctactccaggttcatcaagaaaagggatttggaacaatcggagcatctaatagacgattcatttactatcaggtgtgatcttactgtcatgaagggcttctctagcaaaggaagccactgtaagccgtctgtggaagttcctgcaggccgtctggacctgcatttgggcaacctcctgagtaataagaagatgaatggaaaagacgtcacgatctacgttggtaaggagagattcagagcacacaaatgcatactcgccgctcgttcgtctgtcttcagggcgttgttcttcggtgccatgattgcggaaacccctaggaccattgaaatcgaagatatggaagctggtgtgttcagattattgctacatttcatgtacaatgactcgctgccagagacgtggtctcaagatgcaatgatggctcagcacctgcttgtcgctgcggattggtacaatgttgggaggctgaagctgatatgcgaggagaagctagcaaagcacattgactgcaacatggtggcgaccactttggctctagctgagcagcatagctgccaaggactcaaggaagcttgcctcgaattccttgcttcaaccaaccaatcttgagaggatgatgagaactgatggttataagcatctgaaaatcagttgcccaattgttctcaatgaactcattgcgagattgctgcctcctaacttgaaagcagcaagacagatagctatggatcttcggtagtgttggtgaacttttattattattatagtagtttgccttgctattattattattattattattatagtttcatcggtaaagataccttgccttgaatgtttagggagaacagaagtaaagttagaatttatctgatgttgcatataacgtcacaaaaaatagttctaacggcaatccacgtcaggattaattttcctgactgataagccagtcctaatggagtaatggtaccccattaggaagcattttcctttaggcaattttacggttcttaaagaggtatcatgaggtaccaaattttacactaatatttggtacctctcatggtacctcatagtacctagctattaagaggtatcaaatttacaataaaaaaattagtacctcatggtacctcctcaagtaccataaaattgtttttttcctttatgtgaatagtgtttttcctaacggtttgtggctatcaggagtaatccggtttgtagtagcaaggccagatgcattggatttgatatgcaactcgtcagttttatttttatacatgcaatttatcaggggcagagctagtggataatagggggtgttcaggaacccggtcaagaaaattttttagctatacctcatctattttcaccatgtatgcaccccttcaatacaaacttaagcaccagcattaacttaaactcgatttaaagtagagtaaattaagcaagtggcatcaccctccatttcgctctagctccgccactgcaatttatattttatatgcaatctttacctacttaaaaaattgatgttgcttaggttcctgtctgtcatatctgcccgactgtgattcgtgcgttcagttcgtaggcagagcctgtctctgaaattgcccgggtacgtatgggacagaacgcaatgggcaagcgtgtgcgttcttgaaaatgcgatgggcttcggttatgattgatcatttccacccagagcagcgtggttccgatccagcatctatcttatgcaccccacgggcatggccgcccaccaggatttcaaattttgaaattagattttctgtcgcgggttgggggggggaggggggaggggcgaaattttgactggttttaaataaaatttgaccaaattcataaaaatcaaaagtttcggacgagatgtgagcattttggttgggggaggtgggtgaaattaccgaaatttcaaaaatttcagaaatttcgaaccgaaatttcaaaccctgccgcccaacaacaaactcaatgcgcggtatccccttgctgtcggggcgtgggctcaacgcaaccagtggcgggagggatagccggaagcatggcgaggagtggctgcgccatggcgacaagccggcgtgcccgttgtgctgtcgatgttctaggtcatcatcgaacatcgggcggtctagctgggtgatgtttccaggtagccttagttcatggcagtggtggctatcatggcggacaccagcgtcaacacattatgcacatcattttcttcccaaaacaccaaaatgggatccccacatctagggacacgtgatgctcactctttcctgtgtcgtttctaactttccatgccgaagttatatatcaatcccattcacaacgtcgttatagttgtagatctagaacttgctttctgaccaactcaaatctttcttatctgagtacgccatccaaattcgtttaatattcggctcgtttactgtttctttgtgttttgtttccttgtagggtatgctagatcttcatcggatgtagacctacactaaaaaaacggaatgtccttggcggccaaaaaccgccaaggatagcatataaaccgcctaggataattattccgtcggccgaccaccaagaaactaccaccaagtctagagtgccaaggatatttaaatttattggcggctaaccgtaagtaaaaatattcatggcggtcaaaccaccaagcaaattaagaagattgccatctttcgaaagcgtcaggaaaaatagccttgtcggttttccaccgccaagaataactttaacttggtggctgcgaaaccgttaagaatactaactgaaacgtcccgcctctcttacatctagcagcttttctaggacatagactgccctcacaaaccaacacaagtattttctacacaatatgtcctcactcgcttaacctcagagttctttggagatcaacttcatcttgttacaaatacctgaaaccaaaaataattattttttctttcacaagctctagccaaatttttttttattagtacaaggctatgaatgcacggagcaacaggctaaggtcttccatgccgctggccagctgcggcatggcctccagcttctcctcctcaggctcctccatggcgtcctcctcctcctctgcgcggttcagccgctcgagtagcatccacctcctcctgtggcgcccatcgggacggcgagccgggcccgaaccggtggcaccatgttggcgcggacggcacgaaggcggtgccccttcaccgtgatggtgtcgcggtgggcggtaatcctggcctcgatggagcggatcctcgcaacggcggcggcgacggcgtgctcctgcacaaggtgccggaactggatctcctggcgcgcgtaggcggctagcgtggggctccccaaccagagaagctcctccacggtgtcgagcgcccgcgggacgacggaggttgtggggggggggggggcgacagcggaagaggtcgatgttgttgaactcgtcgatttggtcgaagcacgcctcctcaacaattccggtggtgtggggattggaggagaagaggatggagtggggaagaaaggggacgagaggatggagtggggaggcagttgccattggatgaggagggaatggacggttgggattgagatcacgggaggaggcgcggattgatgacatggcatgagggcagatcagtgatttggcaggatagcgggaattttcgtggtctgagaggcggccaactcaaatttttgacctgcaggtgcgcgaccctggtaatagggagttggaatttatattgacagttttgcttgtaaccgccaagcaaaatacatatttctttgtctgctatggaatagccgccaataaaatttctttatgcttggtggcaagtttgaaccgccaaattaaagtgtaatcttggcggctgatttcagaccgccaaaaaaatcgcatggccgctaggggcattcctttcttgtagtgctgcggcatgaccagatgagccgggcagtcttattcttattgtgtgtggggcatgttagatccgatcaaggccctattatgcatgaatggcgtaacgagtacgccctaggatggtgaccacgcaaatgccatatatattaccaccgtcacccttggtcgtcctacatggctgcatgtatagctatcaccatcatgggtagcagtgatagccgatgctgatcaagtgaaagaacaatctaaagaaacatgtgcatgcttgagatcgcacttcccacgatgcaaatatgcacaatccggtgaatccatcaatagtaataaggaatctgatcaacaagattgctcgagtggtggggagaagagaggagaggccagggctggctcaacattttcgagggctctaggcgaacttcacactataggcccttaagaattaaggctatttcttttaacttataatatatactctataaagcacctatactatagtgatataaataaacatttctaacatggtaaataataaatcaagcagtttgcaaattgcaatatagtaatttgttctcgataaataatatcgatagtatgattgacaacttaaaacactacaccggattaggttacctctgatggctccaaaccaacactacaccggattaggttacctctgatggctccaaaccctcaccattgacaggtttgggcttggtaacagattagtggtcactagtgaggaccagtcacctttgacggaggaccgtcactggtaacagtcacctctgacggacaagaactctatggcccgttaaaggtaagtgtctccgctaacccatggcatgttacaacccgtcataggtaactcatttgtgacgggtcggagagtaaaaaccgtcacaggtgactttcttgtgacggcatgtatgtgcagagccgtcacaggtgacatcacaagtgacggcttttgcaatatcaaccgtcggtgatgagcaacatgtagaaaaaagtttctaaagattggctagcctcccatgccctctaaaagaatagaatagtcacatgcattcaaactaacatcacacatgcattccaagttgtcaccgaaaatcaacaagaagttaatagatcaaatgttcatcaaactagaagtataagcgcggcgtgacctgcaatcagaaggatgattaacagcttaagcaaagcaattgttaaacatttgtagcttctttttttcaaccaattcccattctccagacaaacaagaattaggaccatgtctcttacattcgtactgccaaaattgctcatagaaaaagaaattacaaattcaaaaattagaaagtaatgatgccatatcagaaaagagctcttttgagttttcaaatatagagacatgctaccaggccaacatcatcaagttcgagaattaatataaaactcaaagaacacaatggcttgcacttagaaaagcagagtcattcaattatctgctatgtcagcaactccatagtctatggagcacctatttacctgcaagcaaaaagatggcactgaattagtttgatatgagaacaatttgcagaattaaataagatgaataactaaagataagcaaaggagaataggagtggaagatattagctaggtaatccatagtacgtgcaacctatggaacaatagagatcatgtattctatctgagacaacagagatatatttttcaacaactcttccaggacctatgcacatataatgagatacacggcacaaaacaatttatgatcgtcaatctactaaattcaagaaggcatgtggataagcaaaaggattgcagcaaacttgtacaccaccttatgggagaagaggatcttgcagcaaaattgattttctgtaattcctgcagccatctcatgggagaggatcttgaatctctgaatctcaaagagctgcagcaactggagaagcagctgaaaaatacatcgaaacatatcagatccagaaaggtactatttgtcatgagaacctgaatagaatagtcaaatcagttctgcaagaacattttagatcatgcacataggtttgctgtatttgacaaacagattcagatatatcacttcagcgcaataggaatctacacatcattcagaggatcagagtatgacaaactgactagcagcttatttaatgctcaactcaactaaaatagaagcagcaaccttatttaagcgtggatacattcctacagacaacaaatttagccatgcaaagaaagaaaaaagaggataacacagaagctcacctccaaagatgtctagctaatgtagccggtaggtggtgactgcacaggatgaggagaagcacatgctcgccgtacagccgataggccttgacggcggacggcagcgcacacagccgattggaggagagaggagacgccatccactcaccatgagcctggatctggcgctgttggcgccgaaggccactggatctggagtacccaaactcgggacagctagatccacagccccccgagctcgggttgtccaaacttggagccctagccggcttgtggtcaccggcgttgcacctccacaccgttcgccatgaccgtgcctctcctcctgctcctgttagatctggtggaggggagggcgccgccgccgttgggccgccgcacgctcccctctgtccctgccaggccgccgctgcacacagagagaaagggagagagagagaagtggagaaatcgaaagaaatggagagagagagagaagtcggccttatctcctccgggagtgggcaccgccggaagaagaaatatctccttcggtttgggtatatagtggcacaactcaccggacgggttagtgcttaaatccgtttgaggtgagtaacctcacttctgatgggtcatccggttacgacccgtcacaggtaactagtcacctgtgacgggctggaagtagaacccgttacaaagtactatgacctaaaatcagtgagggaaaaatctatataatcaagggcctaggcctaatgaaaactaatccaccatataccttaatttaattaacttatggacttatggtgcactaaatggttgtatacttgtattgattcctttaacggttgaacccaaaacggtagcaccctaagtctctaatcaaggtaatttaatggggaacaaaaataaattagaagaacagatcaattctaatcagtgagaaggatcgatggattggatcatcaattctaatcagtgagaaggatcaattctaagctattgggctaaatacctatacaggatatatacctggatcggggctccgattttggctgggccctaggccatcgcccttatggccctgctccaaagccggccctgggagaggcggagagggagataaaggagttgacgagaagaatcggggagatattttcttttcctcccatccatgcttggctcagctcaatatgtgatggttctttaaaacaatctgacacagatatttataggtgccaatttttttataagatgctcaagatgaatgcgaaatatcttatatgtgtcatttagagcaactggcgcatataaaggtgtctgttgatgaaaaaaacacatactggtctaagagatttgctttactctaatgcaggtccaaatcttaattactttcgggttgagagcgtgccaactggtttaattctacagccagcaagaaaaacaagaagcaaagttagatgaacaatagtcgatcggctagtaagccgatgtcgtatcgtcaagaattaagccaatgcaatcagatcgaatcagctcttgtatgatggattaaaaagagcaaaaccctaaatatgattcattggctataatattaatcatgtagtttaatcaatattggaaaaatcaaccgatgacccaatatttagagcaatgtattactctaatacaaacttatataaaagtgttgatcaaatcaaatgcaccaaatatgccccaatcctcagatatgatgatctgagctagattgaatcatgcttgatatatttaaaaagacaattctcttatataagtggtagatacaattatcaaacaagttaaaagataaattcaactgtatcaggtaagatcggttgaaactccgatgctatccttatttttaatcaattccagattagtttttagagttctagacaagagtagggttgatgcaactcaaagtatgtaaagaaaccttgattgagctacgattgggttctcattctcccacgtgtcgctctagcacatgctgtatggatgcatgctatggcggcattctggcgatttgtacccgaagactaattaaaattgcatccaaaaaacaaattagatttggattatgagtacagagtcgcgaagcataattttgcattcgattaaggattccaatttttaaaatatcagtaaaggaccttcggtccatagattctaccgacccgcctagcaatcaagctcttgctgctctgcgagactgggttttttggaaagttggaacgacatacaaatgttgttaaatgccgcacactggtaaaaccctccaagcttacttccccctaccaatctgaatgtaaaagaagaactaaatactactatccatgagatcatcataacaaaaactagaattgcccagctaaataggaatagaaataaatccagggtaagaaagaccctttctctaaaccctaaagctttgcagaagtacgaatttgaaaaggaataggtcttgcttggaagaaaagggaatttggttgttgcaaagcaaggggaaaactcatcctcaagtaaggcaatagttgcttgcacagaaacagaaccatggggaaagtgatctctgaccgcgtgcctgttgaagaatgagctagggtcaaacctatccttggtttaggcaatgccaacctttcctttcgaacaacggtacttactgcccgtaaaacagatcggcacctatcctcggtctcggctatctttacgccttagaattcattcataaaatgacaatgaacagtctttatggctgttttgctatatcgcctgaaagcactatgaccgtcggtgaaaaagaatcaaagagaatggtccatgaattggtggcaagagagcgagttcgactcgcgaacgacccgcaagtgaaggaccgatcctttaacgccagtagtgttgcgagactggtacttgggggctcacgagcaacatatagactaaggttacccatcactccctcgctcctttttgaaggcccactgctccccctttctttaagcatctatcccggcttgcattttgggggcgagtactacaattcctccataatcacacagaacgcccagcttcgcgggctttgcctgccgacgttctaataaagaattctggctcggcccaggaaagtgctggcaacaacataaagaaaggcaatgagcaaaaatgtcactcaccggcctaaacgacgagcaaacactcgaacgtgagagcaagggatcacccaatgaatgggcgacccccaaggaagggggagagagggaggcaagaaccatgctttcagagaagtggcggtccgaatccactctgtcaaaaaaaaatagcagactaagccgtgccgagatttttacccttctctaaaaagaagtgtctctatttagagatttctctacttagatgaataaatcatactctagatatattattaacgaatatgtatcccaatccatctcgagtaatttgagaatatgcatttcgaaatgaaaagctatccccagaaaacaaagaaaacgaataggggcgtagcgaaggcacgtgacgaggcacctcgagggcaattagcagatagaatatctcctcctttgctgtatctccccagcaaaacacgtgcacaaagtaaacaatccagcaactgactaattttcagaatggtagataccttagctaatctaatctagcaagataatttaacagataccagttgtcgacgggcaataccgtgactacggtattttgcatagtatggggatcattggtaccaggatatatgcgagattgaagtaaaagagatggagacaaggttttttatacaggtttgagccctttacctgacagataatatccctactcctattgtctgaagcatgtgttgctctttattcatcataaccacaccagtacaatgtttgggataacctatctaaccgttatcgacttggcggcctagaatacaaacacgtagtcagcaacagggtagtttttctcctcgaatccgtacttagcgagatcagagatagcgctagatccttcttgccggcctccacagacactatctagggcttgtctaggcttactctgacatcgatatttggcggcttgttttggcgtgtgttggcttgtattggtctatgtatgttgtgccttcgtgtgtcctctccccctcctcctagggggtctatttatacgcataggtgtccacttaaccaagtagaactagggagaccaatatagatacaatccgagtagtccatatagtttccatattgaactctattcatccttccttatccggaactccttgtatattcgaggtatgattccgtataagattttgtcaaggttatggataccacatacctaatagtagttgactaaatctcggcaagacccaccacataccatgtcttatacgggaactgacttcagatatggagggagttccggataaggaaagacgaccagagttctacatggaaatgacaaggactactcggattgtatccatattggtttccctagttctacttggacaaggggacacctatgggtataaatacaaggccccctaggaggagaggagggacaatcaacacccaccatagagaatacaaaacaatagatcaacacagaagatcaacataccagccaacatacgccaagacaagacgtcggatatcgacttcagagataggcacagctagtcccctacggtgtctccggatactaggagagacattgcgctgtctttgatctcgccgggcacgaactcgaggaggaaggctaccctgttgtcgactacgagtcagaccttcagaccgctatgtcgacaacagttagataggctaccccaaatattgtactggtgtgattattgtgaataagagcaataccggcttcggccaacaggatgtagggttattacctgacaatgcaggggcctgaacctatataaaaaccctcgtctccgtctcttttacctcagtctcgcgtataccctagcaccgacgatccccatactatgcaaataccggaaccgcgacatcaaacgtcgacagatttggtatatggtgggccctaccgagcttagtaaactactattaggtatatgatatccataaccatgacaccagtataaacctgttaacaaccaaatttggcagtatcaacatcggagatggagattagatcgaggtggaatcgaagacgaagatcgatttgggaacagagtaagagtcggctggagtccaaatcggctacgattaggatcggctgagtccgagtcaggctgggtaagccgatacagccgattccggcaagatgacttggtgtacgacatcaggttgacttgatatgcttcaagatgattgccatgcatggatagagtcctgagaaggcaattatatctattaattaggatattttatgtaattttcttagagatatgtttgggcaaaagtctaccataaagacttatggtatcttagagtttgttagagataagaatcgtgtccgatatggacatagtttgtaattatcgggtacaaatagaccccgaaccccatgtaatcaattaacacacacgttcgatacaatctcggtgcatcgccacccttcttgctttagttttatttcgacaagttcttgtttttgggttgagctgcatcggtttcgatcttcaacaagaggtaaaacttgttatgacggcatgtgttctcgggattagttcttccatcttatgatactctaatcttgtttatgtaaatccaccgagttatcatatatgttccataatctctagcaatatcgctatttaacctacaatcgactaacatctgtcagtagagggcagccaattaggttaaatatcgatgttgatttagattatataagatatccaccactctatgaaacttccggcggcttgattatctagatattgttcttcttttcatacttaatgccgcattagttgagtttgatctattaagtcgtgcttggaatatcaatctctaacctgccttctggttgccgattagggtagtatcgggatttcagctgatcttatctgatttaactacatttgctctatatgttttattgacatgttaaatctgccctttatgtcaagatcttattgcatctaagtatattaagcttctgtttggtacattctgtttgttttaatatcttaacatagagtcgtattggagtattagccgatacatgctagatctatctgatcggctatgctatgaacatatatagtcttgttgttaatatatatttcgatctaagtgatttatactgtctcggcacggtgaccgatctatcccaatcacttgatttaagtatatatcgacaccaggattatatattgttaatatctacagccgatcgagtagatttagttctttattatctatttataattgccgatcgatttacatatgacatcggctcaaagataaatgatacgtcatcggcacctagccgatcggctatcatttatggatttaactacggtttttttgtctttatttcttgttgattacaggaccaaatcaactggcacgctagcatacccaaaggcgagttttggacctgcactggagttaagaagatctcctaggcctcgtgtttttcatcaacacgcttttggcacgcctggtgtgacctgataagaagtcagcatcgcagcagcggtttttctccatggaggaaaagccactagcatcaccatcctcggctagcccaggttctgttaaagagaagatctagcagttgggcctatccgaggttaatgaaggcaacattgtgaccatcactccagacaagctgcacctgatcaaaagaaggattttgaagtgatgatgcagcaagcacggaaccagtttttaagctcatttatgcaaactcgcaagggaatagtggtgcagaagtataaggtaaaggttgtcgctgatgttcctgggactggttcttctaaggatggagaggtgaaacaagctctagatggctcggctcaaccgagtgataaaggtgctacaaatggttctcaaggaaatcaaggtgacaactctcaaggagtacagggagttcaaggtgatggtgctcagggagttcaaggtggaggtgttaatcaagacagcaatacaacacagttgcagttcaacaacttccaagatcaggttgactatgctgtacaccatgctttgatcaatcaatctggaatattaaccaatactttggcaaacatggtgaaatcaatggttgatggttcaatggctgagtataaagctacaggaccagtttatatactaggaggagtgttcccaaattataggccattaatcactgacaatcaaccagttgtccagtcaatccctctcaatgcaccatcggctcagccgacggcaccaataccggctcatgcacctgctgcaccgtcatcggcgccaggccaattagttaatcctcggttgctggtgagagaacaaccacagcacagcggacagaatgtgaatcggctaacgcaagaccaggttgcgtctacgttcttatctccccaacacactgctgatccaacccagcagtagctgattcagcaaacgccaccaaggcagcaggttgtgcagccgacccaaaaaacacccccaatccaacaggtcgtacaaccagttcagcagacgcttcagagatggtaggttttgcagccaattcaatagacgccattaaggcaacaggttgttcagtcgattcagcagcaaggcttaatgaatgcatcagctgggtttgcgacacctgatggtcagcttgtgcagcatgctgcaaatcaggtcgtcccagagcacttggttcatcacgtgcaaccggatggcacggtgatacctcaatacctcaggttattcctgagcatttggtgcgcaatattcagccggaccttcagaattaccaggggggcaatttgagttatcagtatcagccgccatccccgcaagttcaataccagtaggcaggatcggctcaaccccagtttgttcctcaatacaatcaattcgagcccatgacacagcaacctcaaggaacacctcagcaacgaccatggaccgatatgattgcggatgtcatgaaggagcagtttgggcttaggccgaaagatgctggaaatttgtatcgacaaccttaccctgaatggtttgagagtgttcctctacctaatcggttcaaagttccagatttttcaaaattctcaagacaagatagtacttcaacatacaaacttgttagccgattcttagctcagtgtggtgaagcatcggctgtggatgccttgagggttaggttgttccggttgtctttgtctggatcagctttcacttggttttcttctttgccatatgggtcgattaacagttgggccggttgggagaaacattttcacagatatttctatagtggggtactttaaaaacgtcgagcctggtaaaccccaggcgatcccaaacttaatcaccttgtggaacatccccctttcgctatagggcgtg

SEQ ID NO: 3584 - DNA, 772 bp, Oryza sativa
  unsure (1)..(772): unsure at all n locations
tggttgacattggatgcctcatgcatncagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcn

SEQ ID NO: 3585 - DNA, 35834 bp, Oryza sativa
  unsure (1)..(35834): unsure at all n locations
ggaggatgantttcgataactgatgtaactattccatcagcccacagctgaccantggtctgcatttttgctagtggctgccttaaatgggctgcttgttctaacacatctacagtggaagttgtttcatttttgcagcaaatgaaaaaaaaggggtggcgctagcctaaaccatttttgaagtagtgaacgtgcaaaacttgtgcagaaattaaagaaacgtattatgtgattgttcttaacagaagagtttaattattgtcaccattcaagggagtaaatacaaggtttgtctaggagattgtctatctgtgtgaaatcatgaaagagtgagtgctattcttctgtcagtatcttgaaccactatctttgatcatggaccagcttagtacaatgttctactgggctgaaggtaaggggatcctgctgatgaggtgagatgtcctagtaaaaaattgagaagttgtgatggaggccttcaatgacatgaaaagtgatgccaaggtaatgtttccatcgatgaaagagtgttgtggacttagtgaatgcattacatgtgtcacgtatagttctcttgtatgttgtatggaacccgtatgttggaaggtaagggatctgccgagcttatagaattggtcaagacaagattgtgtacacatacaatctaatcatagaaggaagaaaggagagaaacaaatacgacagacaagccaagaaggatcatatgtatcaagcttgttacaaagaagtgatgttcaatgacaagatagaagcaatggcatcacataggagctcaaaggcatgtttgtgttgattcttcattttcaatgcctgtaaacttagagctaaatcttataatttgattattatcagattaaaatgtcatttcgattcatctgcaacaaaaatgtttgtaatcttttcatgttgtttgtagaagtagacatgacattttctaagattcatcaatatctaaactatttgcttctctagaagagaagcacctggagcccagctaaacagtttcagctccacctaaaataggagcggagttgggtggaacactctcacaaaataaactaaaaatgtggagcatgagttcagcctactccactatagacctaatggaacaataaatttagaagttgaagctttaataaatagccccttgctattcatacttaaacatttaaaaaaatctttaaattgggtatatactcaatctgaatgttggtgccccagttaattttactctttgtgtgtgtgtgagtgtgtgtttgtgtgtgtgtgtccgtgtgtgtgtgtgggtcatctttgatgggccaaaaatatcatgttcaaaatatggttactggggaggacccatcacacatatgaggtcatctatgacgtgtcgtagttgtaacccgtcatagatgatttgtgatgggtgacaaccatggctcgtcatggatgacatgcatccctgacaagtgtaatatcatggactatcatagatgagaccacttatgtatgacgggtctttaactgacacacgtcatagataaagttatctctgaatggatgctagctttacgacccactaatgatgagtgaaaatttaaaagtttcgaattttgcaaaagaaaaactcagattgagacatgccctatataaagttgtagttctcaatgatatctacaactttataactaacaatattttcattacagatcgtttacatcctcgggtaagaattacaagtgatgagatctacttttaaaaacaaaattttgagttttttcaaatgacctggatggaaacatgccccatatgaaagtcatagagcttaaacagatctacaatattataattgacaatattttcatttgaaatagttttgcatacctgaatatccattataaggtgtgatctattttgaaaaatgaaaaattttatttttcttcaaatgacatcggatgaagatattctccatgtaaaagttatagaacacgatgagatctataactgcttagttgataatgttttcatttgatgtcattttgagtattaaataaatgttaaattattcgaacattaaatatctgttaaattattcgaacatttatagaaaaaataataacaatgaatgagtactcaacatgtgatgagtaggtgagttggtaagggggttctttgtggatgtggatgtcttgagtttgaaactcactatacacatgcatgtctatattgtgcggaaaattgtggatttgtaggtagtgatgtgtgaccatgtataggatggctagtaaaataaaaaaatattttttttgagtttttttgttgctttaaaagttcaaaaatcgtaattcttgctttgtcattagtgatggatcacaagttacaacccttcataaatgagtcatcagcgatggacggcaagttacgacatgccactaatgactcatctgtaacgagtgacaagttatgactcctcaaagatgacttacaaacctgtcagagatgagttgtctatgccaggtgttcacccgtcacatgtgagatttcgtcatcagtgaccacttatctctgacgagggctgaatccgttagagatgacggtttgggcctatcagtgttgacctcgtccggcgtagtgacaagcatgattaaagtttcttcattgattaaataagtctcaactaaataagtaacacttatatactttttctaataggacgaacagtgaaacatcatgttaaaattcaaaggtctcatccatttaaaaaattgaacggaatatgtgctgctggcattgacctagataaccgtgtacttcttcatgtgcagcagggtgaccgagtgtccggccatgagaaagacgacctgcagagctctggagtctggaggtctagctctttactgaacatgttgtccatagctcaaacgctgaaaatagcaagaggtagtactttactggaggtctagctctttactgaacatgttgtccatagctcaaacgctgaaaacagcaaggggtagtacattactatcaattttcagtaaactgattactgaaagcatctcgaggtgcctctgctcatatttttttcgtttgacttactctcctacattcagatcggtctagcttaactcatcacgcctctactattaaacattgcaagaccttcagaatgctccatccatctccagaatcacatcctaccttcagaatgacagacaactgcaacactttctccaccattgtcgcggaggccgtgagcgggtcacatgtgatcaagatagctgggtactcaagaatcaaggtgttactccgcaacggtgagtccctgacatccatccctttcagcgttgcaggccacagctggaccatcagattctaccccaacggtgattccgcggagagccaagattacctatcgttctatctgatccttgactccgccaattcctacgacgtgaaggtgattttcagcttcgagttgcttggcaagaatgggagatcagtgtcgtcttacagcttcactacagatctccgcaccttctcctacaaaggctcattgtggggatacaacaagttcattcaccaaacggtattggaagaatcgtcagcccatttaagagacgattcgttttccatcaggtgtgacatcaaagtgttcaaggagatctacagccaagaaaccaagggtgttcatagcaagtttgtggaggttcctccaagcaacctgcatcaacatctaggcaacctcctagacagcatggatggatcagacgtggtcttcgaggtcggcgaggagagattctctgctcataggtgcgttcttgctgctcggtcatcggtcttcaaggccgagcttcttggcaccatgaaggagaaagccgatggagccattcaagtcgatgatatggagcctggagtgtttaagtctttgctgcatttcatttacaccgattccctggacacgatggctcaagaagatcagagcagagacgaagcaagcgaggaggaggatttggtgatggctcagcatctacttgtcgcagcggaccggtacaacgtcgagagactgaagctgatatgcgaggagaagctatgcgagagcattgactccagcatggtggcaaccagtttggcgttagctgagcagcacaattgcaatgggctcaaggaagcttgctttgagttccttgcatctccttccaacctactggagatgatggcaagcgatggttatgaccatcttaaaaccagctgccctgctgttctcaaggagctcactacaagatttctgcctccggaaacgaaagcatcagaagagataaccattggtctatataattagttcttcaagtatgcttattttgattgtgataatcgaaaagaaagttttttttagtgctaatgccgtggtatttctgcaccttagaaagctaccaagtttatctttcctggaagtaatggccttctatggatcaagtttttcagttgtttctgacattttttttccttggttttttctgaagtgcaaaatttgaccatgtatagttagtccctctatactgatatgctattactctatagcccttagaaattccatgcgtactatcatatctgaaaaataattaattgtgtgcatttcaatagtcctatttgtaagaatttctttgtttagtagatctaattccagaaactaacataccgtgaaaaactatatatattaatatcacagtgcttttacatgtatatttccaatacgatccatgagcacagaggaattttagagaaatattgtaggatcgaataacaagactaagccttccagagagaggtgaatggtcccaacaccaaaaaccgaaaacttttaactgaatgaaaagtcactctcgaactgatggagatcggtctgaccggagttgaggcgctggtctgaccgcacagatgcatccggtctgaccgctgtagccgctccgatctgaacgtccgtggcattgccgtcgtccattgctgctgaggtgacgccggtctaaccgctagtattcctctagtgtgacaaagttgaaagtagattgatttttattacttctatttgtgtttacaaagtgcaacaacaacactcctcgcacaaacccttctccatcggaaagatttatggaatggatcagtcatgggtcaggcttatccaaggtcactgccggacccaggggttccaggtgtgcaccggcatactcaaaacttccgaagtaattgtagacctccgtttttcaatagatggcactgttgactttttgtcgtacgtttgaccattcgttttattgaaaaaaaatgtgagttgttttatcactcaaactactttaagcatgatttataccgtatacatttgcataaaatttttaaataagacaaatggtcaaatatttgttcaaaagtcaacgacgttatctattaaaaaatggagggagtacgtatgagtagtttgtagcagtgggctgaatgatcaatgttcgcaacaaagacttcattgactttttaggccatgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccttagtccttctaggacaagacccattgcaggaaagacttcattgacaaaacctattccataatcctgggactaattttagtctctgtcacatcggatgtttggttactgattagaagtattaaacgttgactaataataaaactaattgcataaataagagctaattcgcgagacaatttttttaagcctaattaatctataattagcatgtgtttactgtaacatcacatatactaatcatggattaattaggctcaatatattcgtctcgcgaattagtttagggttatggaacgggttttatcattagtcaacgtttaatacttctaattagtgtcaaatatccgatatgacatgtagtcccttgatccaaacaggcacatagtccattcgctgatttctgaccatgattcccaaacggaggcacgccgtggctcaccgccaatcgggtccagcaaagtggcgatgtagctcaacaagtctttcacatttttacaaactttacttcctgttggggccaaggttatattcagtggcaaaaatgttcagtagtgacctggcagaggtctttcatatgccactctcatatcaagattgtcaggaattcctgaaaattagctcggaaatacaaggcacggtgttaagctccaatgcagataaccggagtactggacatatatatggggtcgacacatattttttttatgttttgaacttttttattttttaacttaaaaatagaccctgcaaaagttatttccatattatgatccttttggctacgtcattccatctgacgtggcaaaacattactgacacgccacgcatagcgggcaaaacaatactgacacgctacgcatagcgggcatgatagttctattttgccatgccagcgagggagacgtggccaaataacgctgccatgccaaccagatcggcgtgaaactgttgttttgtcacgttagtccagttcgcgtagccaaaaggttcgtatcttgaaaataagtgttgaaagggtttatttttaaaattaaaaattgaaaaagttcaaaagataaaaagaattcgtcgacgcacctactcaaagattgtgcaaattcttcttcgctggaatgcaacctccgacggggtcttttgatatggaagaaaaggtgtataataaaaataaaagttttttggctggttattgttcaatgatcagctaaatacaagagaaatgatggatctcgaacattgtgcatctctaaatgcaatactcacttgttctttgtgtgtcactgcatcaagagaaactagaacctagctgttctttgactgccctttcagcagggcctgctggagttggataggaatgcaatagtctctaaacttctataaaatcgttgttcttgtgagattgacactgttacagaaatgatttttctggatgcccgtcccggtagattccagacgggttgtaagtggcaccgtctggaaaaaccgggcgaccggtgccgggctgtcgcccgtacagaaaaatgcattatctcatgtggtcgacttaagaggaccacacggaaaaatcaattttcgcgtgcgagcctcttaagtgaaccgcacgggaaaatacatctccatcttttccctgtcacccacttcaaattttcacatcctctctcttccttttccctctcaccacttcaaatttttcacatcctctctctttcttttccctctcacccacttcaaaatttccacatcctctctcttccttttcccttttattctccctcactccctcctctctctctccttttcctatcctctccccctcccctctctctctctcctctctctctgcctctttcctctcgtcgaagacgaatccatccaaagctaagctagcctgcatgcacttggtcgatgaagtacggggcgtcgccaccaccaccgctgatggcgcgggaggaggcgcagtggctgctggcagaggcggcggagcggcggctgttggtggaggcggcgtggcggcgacggcggatggtcacggcagaggccgggagcggccgcggtgcaacgaccagcgacgacgaggacgacggtgaccacgagcggtagcgcgacgacgacgaccacgagcggcggcggcgcaccgacggtgacgacgacgggagtggcggcggtgcgacgacggcgacgacgaggacagcgacgatcgcgagcggcagtggcggcgggaggagcggtggctgcgcgaccacggcgacgacgacgggatttcttcgattttatttttctcggtttcttttatttccgtgcgggtggtataatttgtccgcacgggataatcgattatctcatgcggtcaacttaacacaaccgcaaccgcctggatgcgaaaatattgattttcgcagacacctgggtgcagacgggcaggacctctgtacgaaaaaatgcattttgaccacacggagaaatcgattctgtagtagtgtgacattcaggaggaacggatttatggaaatagcactactagctttgctggcatttcggaaacaaagaaatgctcttatctttcagcagattcagcctaatgttaacagatggtttgactgcttcagaaatgggattatcttgcttcaggatgaatgagcaactatacaatatagtgctgttacaatttctgaaattgttctgttttcctcttcctttttcttttgtacttaatgttttctttctttaatccgtaatatttaactactgggccttaccagtaatgttcccttcaaaaaagatcatacttcaaacaaagtgaaaaattatatttattagcaaccttttgaattaggactagttgtttagtagtcaatagaaagctcaaagtacgaatctactactaattacatgattccttatttttgatccaaatcacaataacttggaatttatgaagtaatgtatctggtatatgtacgataaatttttgaaaattaataacatcaataataacctgagggagtagtatttacctaatgtatagtttctatacgtgggaccaaatataataaatttatctattatcttctcttttttgtatttattgatttgcctgccgatttgtgtcatatacacttttttggggaaagtgtcatatacactattttgatcctagtacaattttacttgtttcttttttcagtacaatcttacttgtttcttttcttggtgtactcggtgtcttggtaaaacatagtttatatttttcagacctcactaattctcttgtaaaattgtctcgtgccatgtcatttggagtttttttactacctctcgttcttaaatctaatgatggctctttggccagcctccatatccatggtacgattggtcagccattctgaaacagggcaagcaaatcacaaggtttgtcttggagattgtccatctttggtgaagccatgaaagagcgagagcttgtgttcaatcaatgtcttgaaccactgtctttgattatgcaccagcttagcacaatattccattggactaaaggtaaagagatcctactgatgagtggaaatgtcctaggaaaattttgagaaactgtgattgaggccttcaatgacatgaaaagcaatgccaatgtaatgcttgcatcaaccgcggagtgctataaaggtattacacttgttggggcatcgcatgtagttctccttgatgttgtatggaacccttatgttcgaaggtaggtaagcaaccaagcttatagaattggtcaagagaagattgtgtacacatacattctaatcgcagaaggaacctagtagaaagacaaataagacaaacaagcaaggaaggatcatatgtccaaactattgttttcgaaagaaccacatcaataccaaagcctgcaggatttcaacttgtcaaaaaaagtgatatccaatgataagatattggaagcaatgacatcacaaggggagctcaaagacatgtttgtaaagattattcactcattgcctgcaaacttagagctaaatctagtaatttgatatttggaggttgaaatgtaatttgatcttttgagattaaaatgccagttcggttcatttgagaataaatatttatattttttttattatgttgtctgcagaagtagacatgatattttctaagattcatcaatatatgaactcttggcttctccggaagaaaatatccagaatgtggagtatgataagctcaggatgttgatctggttaaattattcattgtcaggctatgtgttgattgcttcaatattaaaactaggactatttgctcccgtgtaatataatgatttgctctctttcgaaaactgttgcaatggaaacatgaagtttccatatcgttggtaactggtaagtatatggaatggcactatagcacatccatataagtgcttccaacactagttgctcagcatctacatcctttaattatctcaaaatttatgaaagcagctacttatgtgtttcttatttagagatgcaacagagcatcttatctgtggagaagaaaatatatgtgtgcacctccattctatcaagatggtgcttcatcgaaatttctttacattatgctcagataatttaatagaaatagtagaaaactaagggtagtttcttcctgattttggaagaactgagattatggtaattctcttaattgcttgagctccagggttcattgagttcttaagctagatgcacgaacggatgactcttgagatgatctgttcttaaacatgcacgatggattgatcacttgattgtagcatttttacaataactggttggtgattgtttagcattttacttttgcattctggtcatcgtaataggctgatgcatgcagatatgatgctggagtctgtgctatccatttcacctgtgtggtggtgtgtttgtgttgttgttgccggtttatatgcaatctaaacttatttggtatatgtatataataaatagagaaaatccaagaaatgcctttgacaagcgcccaattctaagaaactagataattccccacgctttgctgaggaaattaccaagtaatttttattttttaataatcgagcaaaaagtaaaaattatattagttattaacaacaaataaaactggtttgtcaaactacgttaacagagaaataaatttagtagactctgtatgagattgtagatgaaatatgatatcccgcactttgattatatggatgaatatatgttaattattataaaaatgatatatatatatatgtgtgtgtgtgtgtgtgttaaaaatattgtgaagaagatgattggatgttgatttgtagaattcaatgaattatagatgatgttgcatgcttgtataagttttatatgtaattattgctagtgaatgatgaggtgacatgttttcatgttgagtttttatagatgatgttgcatgctggcataagttttatatgtaattattgctagtggatgatgaggtggcatatttgcatgttgagctttagaattagtgggttataactttatagtaagatatgacgcattgataagtacgagttccatgaaatatcattgtataagtgactatgtcctagaagtgtgatcatcgttagagttttgttagtaaccctccgttaagtgttataggataaacagtgctagttaagtgttataggatgaacagtgcatttaacagggtaggatggatggaaccttaatggcgatgacattttatggacaaagtcgcttgtacaatggtattttatgaaacttgcactcttcaatggtatttcttggacttgggcatttgtcaatggtatttctggcattttctctaataaataacacgtctcattcacaatttcatttgcatatccctgtttgtaattctagaactcaatgcttcaaaaagtagcatttaagtgcacgaaaaatttttattttaatatgtaaattgcagatatcgtatactttcttgtctgttttacatactacatgattgaattttcctgtcagactgcatatttgaaatgtgctcacacggtcataccgctcagaaagttttcgatctccttaattgctcgttctagtttgctgctaatatcacccaattcccacaacaatgatgtatgtggtcgtggattttgccataagttcaaaataaacagggagaattgcaaatagatcccctcgctgcctcctctctcctggataagaaccgatcccctccctctcactgcaagaaagggatacagggtagcggtaggtacttcgtcggcggcaatgcgcggcaagcagcagcagctcaggacagcgcagcagccagcaactagtgggtaggctggcagcggcagcagcagctcgcggcaagcggcaacagcacaaggcagcaacagcagctcccggaagcggcagcagcacgagcgctcgcggcaagcggcagcagcgtagcagctcgcggcagcagcagcaggctggtcgtgttgagcaggcgcaggaagcagtagcgggaggcatggggcatccttgtcctaatttttatgagaactcacattctcacggtgttagtttgatctgtcagtttaatggcaagtattataggttccaaccatttttggtggcaactaggcaattatgttttttataatggcaaatccacgataccgattcaaaccaatggcaaatatgtaattggcccaaataaaaaccaagtgagtcaatttgcacaaatgtgatgagacggtaaaaagatagtgatactgggagtgcctttcatctggtgatattcacatttgagcgttcaaactgaagcacaagtacttaatagattaagcagacacaatagagagatggcaacaaacaagttgcagcagtgaaaaactggtctggtgccaatgagctcccatgtggcagtggggtgtgccacagaatggaggtgcgggtcacgagaggaggtaagggcggcggtggtggcagccgctagattggtaggggagggagatcagagttaggaggagtcatatatgggaggccgtcaaacaacctaaatcgttgcggttggcaaagccatcctacatgttcccctgtatgcgcaatcgctagaaacatgcacacacttgttcgtctaatatcccttcacgctacaagtgtggtttgccatatggcaaaatcttaagctcatcacgtgtctggatgggtactccgacctggcaaccaaccaggtgggcagacgctagatgttcgctagaaagccagggcaaaatggtatttgatgccgcaatctgccttgtttccttgaggatttgaaaggaaaggaatgcccgcatcttcaacatggtgtcttcctcgttggcagaagtagccgattagataattgaagaatgttgcacttggcgtgtggctggcctagcaggtccggttgtagatgaccatgaaggcgtttgtttgtatatgtgtatttccttgtgcattacatagctccatacttagccgcatagaagctcttgtggagctgcggttttaaccttcagtgcatgttgatggcaacccaactatcctgttggttttctgctttgcaactttttttttctccaaatcttaatgaaaatgatccacgttccatcgcaggctcggcaaagaaaagagatgggaggccctggcccagatagtccttgtgattgttgggtttggttgggcctttctgcgtttgtaagttataccataaatggtaggcacacaatgacgtaaaatttatctagtgataaatggtaggcacacagtgagtcagcgaggggtagggcgccgtaatggctaattagcgaacatccgctaactagtgatctagcgaatggatctactttcttttttccgattattccaattatcactaataattgcctatttctatttttggcaagttaatcctcgtaacgtacgcatgtgtatggggtgtggctgatcggcgaccagccgcgcgggcccgtactcgcgccgttcttagtccattagtacaactactactgctacaataataatactactactaatactactactaagtacattattactactactagtaatactagtactactataattgtttttatatgtatatatacacatatacaaagtttatatatgacgtatacaaaatttatatacgcgtatacaaattttgtatacgtgtatttttggttttttatacacgtgtatatatatatatatatatatatataaccttgtatacgcgtatacaaagtttgtattaccatatacaaactttatacaaactttgtatatgcgtatacaaaagttttgggtttttatatacgtgtatgtattaaaataaaaaaaacacatatataaactttgtatacgcgtatacaaagtttatatatacccgtatacaaactttgtgtaggcctgtacaaagtttgtatacgtatatataaaaccgaaaataactgaaaaaatatacgaaaaggaaaaaaacagaaaaaaccaaaaaaggaaagaaaaaacagaaaaaagaaaaaaaaccgtccgccagaaaaaaaaattccacacgtcgtcctctgcctttctccccgcgcgatacgtgtccggtcgcgtgggggagggggcgcacgactgaacgcttattagagttctcgctcgcatgtgtatgtgcaatgtacccactgcatgcgagttttggggccctatttttcatgggccagtttaagcccaatacaaagctttcatctttaaatttgtttttaaattcgtttagaattcatttccaaagagtttctatatctaacgtcatacgtggaaagtctgtggatataaactttgcatgtataaagtttggtcatataaagtatgcacatataaaatttacaggtcaaagtttgtgtgtataaagtttacgcgtgtaaaaattagacatacaaaaaatttgtacgtaggtgggctagaaggcctacaaaaataatacaaaggaaacggttgaaatagaattttcgggaataaggggcctagcttgaaacttctttgtgaaagtaggctatattttgacacattcacatatggatcctgtattatcctccttgggcatttcccattcgttttgttccttcttacacacatgaaggggttggtacggtgcatgatgcagccattcgcaaggtgtagcgcgcgcacacacgcgcactagactcacccggggaaggccgcaactgcaagacaagttttacccagtgctccctgctccggtaattttcgttggtgaggacctcaagaatgtcgccgatgttgatgaacgaacgcgaccggcagcgagcgcaccggaaaccactggctgtcatattgctgacctgcagatcaaggggtatcgtcaacgtggagtagcagctctaggcttaggccatcggagtgcggcgtgatgcctgtcaccttcagtgggtggcggcagggaggattgcagtggcagtgcagagccatgctctgtcgcacgcttccttgcggaaggcggtgagaagcgtctctcgttcaactccaaggacggtgaccatggatgctagtagtaacgccgttgccagattccacatctctgtcgcgtgtttgtcaagcaaatccgtgtatatatactaatataggccttgtttggatccttcgggctattaaatagccctccgaaattttactatttaggagtattaaacgtaaattattgacaaaaccaattctataacccctaggctattttatgagacgaatctaacaaggtatattaatccatgattagcggatgattactgtagcattactgtagcaaatcatggattaatatacctcgttagattcgtcttgcaaaatagcctaggggttatggaatgggttttatcagtaatttacgtttgatactcttaaataacaagatttcggagggctatttaatagctcagagcatccaaacagggcaatagagtactataagcttaagctatatgtacagatgaaactgaatcttcttattgttttttgtgaatagcccgtactatcctttgagtttcactccggggttagtttaatctctgatgtttcattttatccaaacaaaccgttgaaatctagcatttggcttaacgcggtcgttaaaccgaacaaaaaaacaccacgtggcattgccatgtcatcctcgcatgcaaggacaacaatcaaactaccattccatccttatatatacaccatattgcagaaaaaggaaaataagtaacaagccagaaactcatgacataaataatatcgggtgggctttctatgattttaccttttcacgtcatttttttcttgacaattatactcctcaacgtgtttactattatcaaacgaggtggtactataaatagatctaaacccttagataaaattaggtctacaatttagattattttttattactagtaaagagcatcatagtgtaccttttaaaacaagcatgtcctagctataactaagatctagagaaaatacttaagctgttagggtgcgcccggcccattgtactatgggccacccatattacattgggcttgctccaccacagacccaactggagccacaactttagctcttttctcgcaaaattaggaagccacatcaccggagaaacatagagcatttgatttcagctccaaacgatgtaaaccgttggatccttaaattcgtgaaacttactcctgactcttgacgaaacttcttttgcaaagaagacccttccgcatcctcacgtgagagaaaaggagaaaaaaaaagaaggaaaaaaacttgctttccttcgtcgcttccgctcctaaatcacgccgcatcctcttctctcttctcctcatcgttgtcgccgccaccgccgcttcctccaactcctccaatgcctctgcagtcgccactcctccttgtcatccacgcattcaccatccacgtcgcctccgtatgcctccctccatgcctctggtgactggtgacagcacggcggtggtaaggcacatcgcccctccatctgcattgccacctgcaatctgccattcgcttccacagaacaaatggtaaggacattactgaaactataaagggtcactggtgttccaaatcactaaattctccatattccaaaatgagcaaacaacaggtgtgtttctagcatgaatttcaatcatccatccaccgatcatcatatttgcaaaccaccgaatcagtggtgtacacaaataaaaggtgactaatgtagtaatatttataataatgatgatataatctgctggttcaaacatgaaaaagacctgattatggacattgtctttccgttctttacatggtacatatattactcaactcacaaaagactaatgctctgtgcagattataaaagctcttctggaggaagaacaattaattattcttgatgagttagtgcgtctgaacaatcttaacatcgacgtacatttatgatagtaattcctactccctccgtcccataatataaaggattttaagtttttgcctacaacatttgaccactcgtcttattcaaaaaattttaaaattattaattattttatttgtgacttactttattatctacagtattttaagcacaactttccgttttttgtatttacaaaaaaaaattgaataggacgagtgatcaaatgttgcaagcaaaaattgaaaatcccttatatttcgggacgtagggagtatgttgcagataactacagtgccctccaagcaaatgttgcagattagaatctgtaatgaaatgctctaagttgttttaagactgtgtcatgttagagttagaatctattgtgtcatgttagagttagaatctattttctgcagtcgacctcatatgtaatcatttgtagtacaataagatatttaatttttaatgttagttagattccaaatgaaagtatagtactaaattaaatttatgacaagggcatgcatgttagtatgttacataatgtaattaagaccaaatttgacctagaattttctaatattatcttataagaactaattcacctagagttttctatggaagtatggatgcttttaaatcttgatgacagagaaggatgtgcaatatctgtacatcttagatagctaccttaatatctttatctaaaaaaaagaagttcagatgaattctgcaacttctgactgaatatattttagttaaatttgaagaatcgaatagcaacaactaagctaaccaaaaggggggtgaatggttgtagctacaatagtcctcacatcaaacctagaaaatattgaggaggagatcatcccctttttgcagctcaatactattctgatgatcaccatccaattgaggttcttgagagattaatttgaattgtgtcatcaagattcagatgccatggataataaccattgatgccatgaaagggtgatcaacattggcccgagtacagatttcctccgaattacatggcattacatcgtccatcgttttttcttagtgaaaattgaaactgatgcaagttttttagacttgaaattttattttgtactgaactgggcggtcaccacgcctcgaaatctcaatgtatactgatgatgcagtagtcttcatcaacccaaagaaggatgatgtacaagcattccctgcgctccttgaatgcttctgacaggcaacaaggctttgcaccaacatacataaatctcaggtgatgctaatcaggtatgcctgcttagacctcgacgatgtgctagaaggcacgccggtgactagagcgagcttccctatgaaatacctggggctacccgtagccatgacaagactacgtaaggcagacctccatccattatttgacaaatccgttggacgcctagtgaggaagaaacattgggatagtagggcaaacaactctagtcaactcaatcctcacatcgcaacttgtctacttcccgatacccctaaaatttacaaaggaatccctagaggtgcttgagaaatagaggaaacggttcctctgggcaggggcctgatagcatcacggacgaaaaatgcaaggtcaactaggcaagaacttgtatgccaacaacttatggaggactggggatgctcaacctggaaaatttcatgagagcgctgagggtaagatggatatggcacgagtggaagtaacaaaaaaaaggcatgggtcatctagacactccatgcaaaatatcttataggctactatttacgacagcgacagcaataacaactggagatggggaagtgatcctttcctagaactcggcatagatgcaaggaagacgcccaaaagacatggcgccaaaagtctacgcgatctccaagaaaaaataggcccctccgagaggccatcgaggacaacacatggttacgggatctcaacttatctcaacttatcaactagtacggacatgacggtggaactcctagaacaaccagtcaccatctagatagcagtgcaaaacatcaaactcaactttaaggaaaagaatgagatcaaatggaagctcatatgccaaggagaatacacagctctttcaacctacgaggcacaattctttggcttagtcaatacgaattatgagatgttgatctggaaaccatgggtgctgaaaaaaatgccagattttcacctagctagttgtccagaatagagtttggactttcgacaaacttgcaacacgtgagtggccaaacaactcctactgtccactctgccgccacacgctagaaacatccttccacctcctggtggactgcagatacacaagtaaaatttgggagaccttagcaaattgcgagcagcacaagccgacagagtggagtgcaaccacaataatccatgactggtgggcagagctagcaaccaccaaatgactattgaaaaagggagtctacacctaatcctcctcacggcatgggaagtctggaaggaaagaaacaaaagagtcttccagcataaggagtttatatccatcagatccttgggagcaaagatcaaggaggaaggcaaaacttgggcctcagcgggagccaaacaccatgcgcttttaattccttaggccttttccctattgtacaattctttctttttattctacatgtaacttttacttctcctatattcaatgaaattggcacatcctgaaaaacgagcgagcatgtagtcttttatcatgtaaatatcatggcatgagcaagttgatatgtggctacagtggtagcagtgtgcacttgttagggcatgtacaataagtatatatgttataacaccgatggcagaagttcttccacatatattaagaataagagttggctcagtttataaggaagatcgggccaaaactatacaactagacggttaattgaggggaactatcaaaacctacactgagggcaaaaggagaaaacaaccttctacaacaaaactactaaggcacacggctcaaataattgttgccaagctcatcaaccgatgagcagcaccgacttctcaagatgggccacaacctccaaccagacccatacaattaaaaaccattaaccatggcggatggcttggcagctgagtgatgccacgtaagataggaatagttttttttccttttttgtctttttattcgccgctcgccatgcccaaccattaaccaagcttcttggtgggtcgtggttgcctctggtgttgcgagtagtttgcctggccaatggcgttgcgaataagtgtagttgcgcttggccaatcaccgtcattagatgtgctggccctaggagctagggatgggcgtggtctggggtgggctgacccaaactcgtcccatgtgacccaccaattctacaacaacactagttccaatgggtaccatgggtcgacccatgaaaattgctagtgtactgaatttagaagacactcgacagagcaaaccaagtaaaagaaactaggtaaaaccccgcgcattgctgcgggaatttagtatgataacaataaaaaaaataacgtgtaagatagctagataacatcagattaagtaaattaatgtggtttatgataatttaaatttaaatagtatgtagaatgatgagtcaaacgtaaaaagtaaggtggtatgacttcatggaagaagaaaagtagggagatagtttggaccgtagattaatcatctaaaggctaaaaacaattaatgtgatatgacttaattagaggaaaagagaaagataatttggaccatagattaatcatttaagcactaagtgaggatgaactatattagtatataggatatcataaaacgtaataaagatatacattgaaacattatgtgaattatgttggatgataatttaacatgtttgtatttgaaaaagctcttaaattataaaaactataaagatatagcatgtttgcatgatgtttaaatgtgatgattgttagtggatgatgatgtggcatcttgttaattagtgaatgatgatgtggcatcttgttagtggatgatgatgtgtcatctttgtatgttaagcttaaggagttagttagaggaaaaaaagagaaagataatttggaccatagattaatcatttaagcactaaccaagtgaggatgaactatataagtatgtaggatattataaaacatagtaaagatatacattgatacattatgtgaattatgtgggatgataatttaacttgcttgaattttaaaatctcttaaattataaaaactataaaattatagataatataacatgtttgcatgatgtttaaatgtgatgattgttagtggataatgatgtggcatcttgttaattagtggattagtagatgatgatgtgacatcttgttagtggatgatgatgtggcatctttgcatgttaagcttaaggagttagtgggggataactttatagtaagataggatgtgtacgcttgtattcctttgtgaactatgaaatcaatgttatgttgaagcaatcgtggaagcaaaaacaaaaggaacaggcttttcattgtttcactagacctatctaatttcagagaaccaattaaggaagtatcatgagaaccaataacaaacaaaccggctatgaggatttgggtgaagggagaaaatgacggtgccgtcgcgtgcctgatgcaagggatcgatcgatacctactgaagcagacccaaatacccacttgaaccggtctttttagtttgggccgggccacatacccattaaagccaaatttatgggacaggccaatgaggctcgtgggtagacttggaccatgccaatccctactaggagccaatcacatcgcttacatggggccattagattagaaatactaataatatagagggaaataaaaaaaaacccaacatatacgcaggcaacgtccatgctcctctgagaataagaatatatgaattggcctatagttcgatatgccaactagaatcactatgagatattccttccctcccaaaaaacccaacctaattagggatgagacacaaatggtacaacaaatatggatagcctgttcagattcgttgtcccatgttgtgtcccattctctactagcttaggttttttgggacgcatggagtattagagaggagaggagaggagaggagaggagggtgagagtcaactttttgcttaaggaaatgttggagttgcagtagcaggtcaggagtgatgaacatggcgcgcactgcattaatgctctaagagtcacaacataagtaggcgattcttcataaattttgataatttgaccctttgcaaaaactatttttacaaactgaatgtacgttggcacgctgacttagcctcccatccgcggtggcacggtattcagcgccacttgacgtggcgctgaggtgtctaagttcagcgccacatgatttggcgctgaaaaaggggtcattttttaaataacttttggcggcagttcatttgtaaaattagttttttcaaagggtcaaattgtcaaaatttgtggtgattcttgatgcacatagctgcctgtggagattatgggtaccacatgcccacacggtatggttatccgactggttataggggataacttatatctatagaatatgtaacagatcatgatttaggtattacgtttccctgtatattatggaacggcctaaagtcctgatttgataatattgtaaaatagatttaggaaactgataccgtatttgttaaggtttttatcttgtaatcccgccctccatcctatataaggtgggcaggagtccctctagggggcatgagcacatatgatcgtcagatctatactacacccggcggattcaaatccccaaacatgagtagggtattacctctcattgagagggcctgaacctgtctaaatcctttgtctccgcatccatccacttttatgtctcgtgcgctacccccttttattattgccgaattcatgtttcgacagttggcgcgccaggtaggggtacgccgagtttcctattgaggaatgcgatggaatcaattttatgagccgccggcttcgccttagcctcaggagcttcgacttcgtcgccaccgacaacttcaacaagcctcactctttgactttgattcaaatcagttggagaagatctaatctagctaaggaggataacaaccactctaccacgttgagtttcagattcgatctactatggccgccgccagcgtcaccttcatcagcaagctttttcgcttcagagagagaaactttatcgtcaggagaataaccggatactactgtcaacaggatcgtcaatagcatgggccgcatgccttggacgatacacggcatgctacaaagtttgcagtcctgatcttgcgacatatgtggtgtgcggttggctacgcacgcgcatcatggcccggccgactgcttcgatagccaaacagtccggtcagcatctttcctcgatctcacagcgacataatcaggggcttcggagcagctctcttattacatgcatctactcatcatcaccatgtattgcatggctgcctgctacaagccaaccaatcaagattccttaatctacaggctgctaccaacaatcgcaggcttgagaccgatcgtccaataagcatcgatcagtgcatatgagtcaattaatctactggagcaaatacagatgcatgcttgcacattcttttatctcctaatcagatatgatttgtatttacatgtccgactatgcgacagccatataacaggcacgttgtttccgatatcactgacacgatcttcatggacatggacttcatcgctgactggtttgttcgtcctcacggccggcctactacgttgctactgatagcgacatcatcttcaccgaccgtctcgcttccgtcgctgctgccgactggtttctccgcctacacggctggcctattatgccgccgttggtgggcatcgctttcaccgtcgaccgccttcgtcgccgccgattggtgtcttcattgttattgatggacgactttgttcccacattggccacctctgccatcaccaaggggaatattacaaagctaagtcatcattatttttctttatatgatatttttcttttcctctacctcactacatcaattggttcgccgttgactagtgagtcgggggctacatatgttatatcatattttttaacaattttcataatatttatcttgattgcttgcgacataatctgagtacaaaagtgcctatcgagttatggagttccatcttcctatgctttccgtttggtttgccaatggatagttgcctttgggccgattcctagcacccgggggctcgttggatggaccgaataacgcaaggtgcttagtattactcggaataattaaatcagaagcatagagatgagataaatttattttctgctcttaataattgcaaaagtacccgagtagtaaattctgatccgtgaaactttgttccattaatgacgaactcatgtcactcatatgcatgtttgggaagtacttaggctgactcccggtgcctggtggctatgactagtcgggcagagtgtttaaacgtaatgagtcatttgctcgtggaaatcaaaattgacaagagaagaaatacatatttataaatattttaaagtacttgaattttcatcgaggactgtttttacatcagatactactcatcctatatgtttgttctgcaagatccagatccagatatgcacaaaagggattcatggctttaagcttatctcttacgctccaggaatgaatcagtcagaacatcaccaccagcttgccgtcgtcgccgccgactggtgtcttcgcctatacggttggttggtcacaccaccgttgttgggcgtctacgtcttcaccgaccggccgcctcatccgccgccgactggtgtttccgcctacacggctggcctattatgccgccgttgttgggcgtctacgtcttcaccgaccggccgcctcgtccgccgccgactggtgtttccgcctgcacggcttgcctattatgccgccgttgttggatgtctacgtcttcaccgaccggccgcctcgtccaccgccgactggtgtttccgcctgcacggctggcctgttatgacgccaactgatgctatcttcttcacggctggctacgtcgccgccaccgctaataggcgtcatcatcttcaacgcaagctgtctacgtctgctgccgactagtttattcatttccatggctgcatgattctgccagtgttaattggccttatcttcttcactgccggtcatctcgtctgctgttgactagtgccctcacctctacatatggtttataccgctaccactactgatggacatcatcgtcttccgtcgccgactggttatgccaccgccgactggtgcttttatcttcacaactgcgcatcttcactaccggtttgcttctgttgccgctgactcatgtgcaacttcattactgctatgcaactttgtcaccatggtggagcaacttcatcttcatggtcttctgcaccggcaatctctattgctgctacttcgcaagttgtgctacttcaccaactacgacgtctacatgagcctcgacatattggcatgcgtcacgaaatttgacgtcgtgctaatctactactacaagtagttctataattttcaagacttatactcggacatcttcaacatgtaacctcacttaagcaatgagtactcgacgacaagctacagttctcgactctatgttcagttgtttcccaactaaccaaagagtcggaggctacacaaatacaagactcaaaatccgacaagttttatgtcaagataaagcaatcaatcaatcaaggagtcaactttaggagtcattatcttcgtctttacttcagagcagacgttctacttcagcaactcttattatttcactggcaattttgacttctggatgccgccacaatctgcttcaaattgctcaagtgtcaagtttgagatttaatatacatgtccgggagtttagagttatcaatcaatcagctcagtttcgacgagttggacaacaacatctacattcctctaagtgaagcttctacaacagctataacatcaagttctactgtcatttttataaatcaaggggcattgcatcatcttcgttatgcacatgctcgccgttacctatatatacttcatcggccctgacgtcttcgccgttgctaatggctattatcaatggacaattatgactacgacagaaggataagctacatgcataggggctcatcaactcaagcgcgagaattatatcttcaatttggacttgttccagatacattcaacttgaatttatggtcatgagtcgatttcttattctcaatgactggattattcattattccccgtaagggctatcaaccgaatacttgtgccagtcgggatttaatttttatatctattttggagtatcccatgagggataatcactcagatcagaagctattcacatgagctacacttggtatatatcacccagaagatttattacttaggagcatgttatatgcgtcatcctttaaagggtgtcgaaggcatattttttggcctaggcctaatatgtctgcagcccatattttcaggtgtggcctgtcacgttattttagggacttaggcactttttgcttaggccaaagtgcacgtgatcaagtgcccaataccttaaaatccttttataccgcagttgctcaactttttaagagttggtacaatgcatcttaaaaggtacccaacggtgaagtttttcatagctgccccgctgacttttttatatatagtcaaggcgctgtttgggttaataaagcaattgattggatacgatatcattgctttttggcacgtaagtgtgcacttttattgaccaatattatggcttaggctgattatatattgtggtaattttctaggtggttggtaaatcatttatgagtttatttactcggatgttacaccacatatgccatatatttttaggtgtggtgaaaccatgtgtcttttagggacttaagcacatctgttaaagcagtgtgcgcatggcgtatgcccaatactttagaaaattctttattcacagcatacaagcttctttatggctattttgctatgtgaattttcaatgatgtagccaactttaggttgcacacatcatattttacaaagcagtcggtatattactcggatcatattattcggagattcacaccgcatatgctatatattgatatcaattcacttggttgattacaattatcaaagccactcggttggttgaattatttattccttgactatatgcttagtttatttagctaaccacatagtcgggggctacacctattaggtgcgtctaatcgatgcacctgactttatttttcagccctccacagtcttcatatttggtaaaagtactcgagagaccatggcaaagataattgaagcatttggctttggagtaatctggttcgagagaagattgttttttgactgtgaaggtctcaggggctactatggagattatgggtaccacatgcccacacgacatggttatccgactggttatatgggataacttatatctatagaatatgtaacggatcatgacttgggtattacgtttccctgtatattatggaacggcctaaagtcttgatttgataatattgtaaaatagatttaggaaaccgataccgtattggttaaggtttctatcttgtaatcctgccgcccatcctatataagatgggcaggaggccctctagggtgcatgagcacatatgatcgtcagatctatactacacccggcggattcaaatctccaaataggagtagggtattatctctcattgagagggcctgaacctatctaaatcctttgtctccgcatccatccacttttaggtctcgtgcgctaccccttttattattgccgaattcatgtttcgacactgccagttgttgaatatatctcacctaaatcaatgtcaaatttccttggttatttgatttttacaaaaaaaaaagagatagtacaaagttggatgccgctatatatatctcagctgcataaaaaaaagagcaaatatccagcataacgttatcatttttcagaaaagaacgcaacactagctaacacatgtgcatatgttgacatgttgatgcgtggtgtgtgctttagcatatagggcttaggagaccttgggaactagttatacggtgatgcataggagagtatttcctgattccccaagacctgtgcttgattgtaacctgcttccagctcagagtctgtgaccaagtaaagcaaatgcagaaggaaggagggttacatagagcctcatcgattgtcataataggctaaagccaaaatcaaaatttaaaatttcaaacataattttgaaactgatataatgtagttcttttagcatttatttttaactcgtcaggaacacatatataaaaactttacttataaattaatttttattttataataaattaaaatagcttattaggaaatatgggtaatcgatgaggctgatatgctactactgctgtcggccggctggactagctgcaggcaagttcgtttcttgcacgtcatgaccatatttcagcaccgcgcgtgcggagcaaacggtcaatgactcagtcggcctcgtccgcattgttttacttttttgagaaataaaccaacggtatatttgcaatcgaaaataatttgtaaaatacatgttcttaacgatgtaaaaataaaagctaaaaaataaacttcgatgaaaataactcggttagcctcagtacgcaatgtttttaaggttaaaaataaaattttagctaataaacataaacattagcgaaaagatgaggttgctcgctatctttcgctgtcgagctacactcatcttctaattttacaattacttgtggtgtaaccaatcgatatgctatctatgtgtgaatgattgatcaatggatcagtgatgccgctgtgcagtagaacagaggtgagccaggggtactgttgggatacccgtaggttacgatagcttaatcaaaattttatatcgtgtaaatcaggaaccatacaagtattagatcatagatcgttaccactcgacaagctgcacagcggaagacgctgagaagttgaaggaactctcgcgaagtagcgggcgtcgatgtagaggaagtagtcgatcacaccggctcgaccttctcctcctcgtgctcgccgtactcccacgccgatcagcaccgtaaaccagcagcgcctctatcggtatccacacgtacagggatggaacgccacgcgcagatgtgctgcaccctcgtgcggctagggttctgctcgggaagggagtggcggctagggtttctcacgtgatgcaatatctccgccggtcacactcctcacgaatatataagatccattactcggacctccaaggcccgtaggactcatatttggattcctatccgaattaagctcatattagatctccatccaatccccttattccggcccattaagcgtgcgaccctataggttcatgtacactcggctataacccgaaaactctttttcggtccacgcatcaacagcggcccctagcagaacatattgagccaccgggcatacaaaaagatcatatcgactgaacctctagtgtatacttatatgaacccctttgcctcacgatatcgattaagctcaaggctagatatgtgccatcctctaatagctcaatcattcactcgaacctgttgatagattatataactcgtgattgactcctcaatcacctttggcatggccatgcatttccataatctacaacatcgaagggcccagagatatttctccatagaaggggcaaatcccatcttgattattcatattccactacatatttcatagcatacccgaaaactagttttataactacccaattacagagtagcgtttagcaatccctaagtaagctactacacatgttagctaggaaccatgataatctaaggattcaacaccaacactaaatgagatcactgatgacacaacacatatggctcttgcagtgtctcatgttggatctatccaacaacatgttcaccaacatgtgtccacattattaatttgttatctctataccatgatccatgagacatgatcattaattaacatatgtgctgatcatctaaatatatttgttccacatatgatatttgatcaggaatcctttagaaatagcaacacacaacataaagagtctcatgaaagaatcacatatttattaaccaataatgagttatctatttcaagaaataaagtcggataaatatataaacatagtatgtgatacaatcatctctatgattgcctgcagggcatatcactgacacttcggtccttccattccacggatcagctgagaattgattatttcaatcattaaactactctgaaactttacccttttttttttcttttgacaaactcacgatcggcaagttccgtggacttgtgcttgtggagtagtaaatcgcagcgacataatcttagtacttgcagattaattagggggaaggttgatgataatttaactttggcatttgtacagtacgctttctcaatatattgagctggtggcatcttaatatgtgaaagcaccaaagttatctcaaagagaatgagccacatcttctaaaatacgagtaacgtttgataaaactgataaataaaactacaccattagatcatatatgagacatatattggactaatcaggaggctcgcacaacttttatctctactctttttaatattatgtttgattaattaatcggttgataaataaaggaaaaagaataaaagtgacctcaaccttgaattcataatggagttattaatccctgtgattatcattaataatgtgatttgctgcaagattaacaagagagtttatttccctggatggagcacgtacatatgagaagtcgtatattgtatatattgatcactggacgtcaggtttaaatatatatgtatacgtttatgtgtaattttcatatgtttccaatttacttttatagatataccagctataatgtataagcgagtttataaatattatattactttcggtggtatgggagcacacaatagcagagtgccatctatcattgtgtcaattttattactccttccatctcaatatattgctgcctttaacatttaaaatgtgtcctaaaaatatataaatagctaattcacatattccctcatcccaactaattacaaccatcaagataaaaaaaactacttacaaccatattatatttatttctttttgtctattagttttttcagggcaattgcatttttgacgctattttgaggactagctactaatttggcccttcttttttgagtttgacccatttgaccctcttttttacaaggaaaaaagtacgaattacccccgaactatcgcggtcatccgaattacccccgaaccacaaaaccggacattcttcacctccaactatgcaaaccggacgaattacccccctcgacccaatccgcggtggttttggtctacgtgacgtacacgtggcagtccagtcagcaacttatttattaaaaaataggtggccccacctgtcggtttttgtatctctcttctatctcttctatccctcactcactctctctctctcttgtccttcagagttcagacggcgacggcgaaggcagcgagcgtgggcagcagcgaggtgaggcgaggcggtagccgccagggggctgcgcgccgcggccgcgtcgaccacaggggcctcccggtggatggcggcggcgcgagacaagggagcggcggatgggcggacggcggcgcgcgaggccgggcagtaggcaggcggcggcgcgagatgagtgggtgggcgctggacggcggacggctgcatgcagcggcgcaggcgtcggtgaatggcggcggtgcgagacgagggagcggcggacgggcgaacggtggcgtgcggggcagggaggtgggcagtggcgagagacgaggcggcggcgcgagacgagggggcgggagctggacagcggaggctgcatgcggcgacagcgagtacaagcaccgccgcctcgtccgctcccgcggcgccgccaccaccgccgtggccggaatcccggggttccacttcgccaccatcccggacggcctaccggagtccgacgccctcgcagctgcccacgctcgctgcctccgccgtcgcccctctgccgtcaccaccgctggacctggaggaagaaggggaaaggaaggggaggagcggctgcggcgaggggggagcagaccgcgagccacgggaccccgcctccggtgacgccatgctcgcctcgcgctgtcgcccaccgcccgccccttcctcacagcgtgccgccgcccaccgccgctcgcgctgccgctcatgcgcgccccgtgagagagagagagtgaagagagaggaagaggggaagggtatgtatgacatatgggtcccacaattttttaaaaaaaaatgctgactggattggcacgcgtacgctacgtaggataaaaccgctctggattgggtcgaggggggtaattcgtccggtattgaaagttcaggatgagcaatgtccggtttttaggttcagggggtaattcggacgaccacgatagttcagggggtaattcatactttttccttttactaatgaagatgagacttggccctattccatgaagtcaacatgacggtgttaactcaagacaaatatgtcatttatacccttgtgaatttaacctggtttcttaaagttttttattcaatgcagttttgtgcactaattagtatatattaaattgcctcaaacagaaatacatggcacagatttatgtgtaccaaaaaaagaaaagaaaaaaacatgttgacaccgcgccgccgacggcaaactctcaagcccatccatgcggagcagccgcttccaccaatcctccctccgaccctccgcgagccatcgtcgcctgcctcaccatgcgccgccgccaccggtgttccctccctccccgcagaaccgcctcctccccaccgaagtccgccaccgccgcgccgccttcgccgaccgctggagccagatccatcgcatgtgcgtctcggcgccaccggatccgtcgcctcatcgccgagcctttgccggatccaccctgtcggcgtcgcccctcctcctcctcgtcgagccaccgccgccactccttcgcctcgttgagccactgccgaccctcctcctcatcaagccgccgtcgctcctcctcttcgttgagccactgccatccctcccatgccgctgtcgtcgcagccactcctccacctcatcgagccgccgccgaccgcagcgcggctgccgttgcacaaggagggcagcgggaggaagttgctcttaggccgccgacgtcgctccctccctccacgagccagcgccgtgtggattcccccgctccgcgccctgcggccgctgccacggccgctccctccacgagccgccaccggcactcgccgagagagagatagacgagaaacggggagagacaggatagataaggatagggtttgttcgatggtattttggtcattaagaaaagtaattatatttcattcttttttttaaataaaaacttaatggtgctacggaaaaagggccaaacggagtgtttgttttaaaaaggtagggtcaaataagcaaactaaaaaaaatagggtcatattggtagttaggctttaaaacagggtcaaataagcaattgtcccttgaagataatattatatgtctaatcaattaactattttataaacttgtaatttttacttttgcttttaccttttataatagagtaaattttacaaaactacatgatttatggttcaagttgaagaaaaccacacacattttgacacttggcacttaagtacctatattttggtagtttagtttcacaaaaccacagtatcgatgaatggatttacccatgtgatgacgtggttgttacatctaggatgatgacgtggcatatcctattaatttcgtgcgatggctgataataggatcacacgtcctcgtcctatgtgaaacaaccatgtcatctcgcgggtgaatccattcattgatagtgtggttttgtaaaactacactaccaaatatatgtaattaagtgctaagtgtcaaagtgtgtgtggttttctacaacttggaccataaaacgtgtagttttatgaaatttactctttataatataattacaacgcacatgctttagcttgtacttagaggtaaaatgcagggtacgtgatttcgcccttaataagtcaccgtttgcccctagtcaggatggcagctctgtgggtccaaaactatggaattaaagaaatgataaagaaagaatccaatgatttacggtatatgaattgacctttctatccctagttatatctctcacccaaaaccaagtgtaaactgttcgggccaagtgcggggacgagttaattccaggttgctaatgttctttcacagaaccatcttcatttatctcttttcagtgctacctgtgtcctgtgggctgtggtcgtacgtttggagttggggcttagatccctatgttttagtgttgtttgaaactgatgaagagataaagattaagctgacgtacgtaaaacgaaaaaactttaacacatgattaattaaattttaattattacaaacttaacaaatggatatatttaatattttaaaacaatttatagatatttttcgcacgaaacgtatcgtttaatagtttgaaaagtgtgctaaagaaaatcaagaaaaaaatctttatctcaccgagataaaatttgtctatgcgctttccgtctcagttggtagatattttcgaagaaattaaactaacaagatgcgatactcaatactcctatctgcagccggcagccccgtaaagaaaccatatgtctagtattaatccaatctgcaattcaggctgaaagttaccacatatactatatatatatataggagaggctggtatatatgctggtgctggtgctggtgctatagcgtatagggcttagaaggcatcgggtactcgacgtgtccatgaagatatgtttggccatcgcattttttttcttccataactctgcgcttctagtaggagtacacgggttgtggcatggagaaaaaacagattaggcaaaaaagaaaaaggttaggaaagagggcaatatattttccctgagctgcaggtgagtgtac

SEQ ID NO: 3586 - DNA, 8910 bp, Oryza sativa
ttctcagtttgcagatcgatcacttaattagagcacatgcaaaatatgtaattgcatatatagaagcagctaatcgattatagaaatgggattgaagcaacaaatcttgcttgttcacggaagaacatatattcagactgaatgactaacttgatataagatcttaattgaacagggagagctcctccctccagctattgtagacttctcttcaacctctttcctcttactgtttgcgcgaattattttactccaactatcttagatttcgtgttctcttttcctagtttggactatatttttaattttcaattactcactcaaagcaaaaaggaactgctacttgttgtattaggtggttttgtagcacaatctatcttaatatattaccaaaagaggatagaaaggagatacatgttcgctccgggtccctataaattacaaagttaatagaagaaaatgagaaaaatgcatcattcgatattggtagaacgaatttataacattagatattaattgatagagttgcatacaaaatgcaattgcatttgcagaaaaaagacaaaattatataccagatacaattagggaaaatcgcattatcagttgcacaggattagctaattatgtacagggtttacactttcggaaatggctgaatttttttgtcatttcagtggtcaccgaaatttcgtgaacctcgggattactggaacttttttgcacgaaatatttgatattgtaacaaattttaattgaatttgactaaattttgacttttttttaaaaaaaatggacaatctgagaaatcctggagagatagttgcttggtggtcggttgcttgatgtatatggacacacatttgaagtattaaatatagactaataaaaaataaattacagattccgcttgtaaactgcgagatgaatctattaagcctaattaatccgtcattagcaaatgtttactgtagcaccacattgtcaaatcatggcacaattagactcaaaagattcgtttcacaatttatatgcaaactgtgcaattgattttttttgtccacattttatgtttcatacatatgtccaaatatttaatatgacagaagaaaaaattggaagtttgaatggatccgaacacagcctagcctatgtaccgatttatcggccttcattttctctctcccatgttatagtgtgatcttgttgcagacttacagttgtggttgcagtagtggtacatatgcatgatggcagtcaagcatgtcgtgttctggataatattgttgaacgccccgatatatgttgaccgctctgtttagatcacgaaaagaatatttttaagtgtcacatcgaatgcttgatcggatattgaaatgggtttttggacatgaatcaaaaaactaatttcataactcgtctggaaaccatgaaatgaatctagcctaattaagccgtcattagtatatgtgggttactatagcatttatggctaattatagactaattaggctcaaaagattcgtctcgctatttaccgtataattagttttcgtttttatctatatttaatgcttcatgcatgtgtccaaagatttaatatgacgtttttggaaaaaaaaatttggaaaataaaacaggcctcagtacggctctacctattgaaagcatatttctccggctatgaagtgtagctaggtttatctgctttaacagtagtttctttgtaaactccgtaatctgttatgaacctttcttttccattaacggaagagggagaagaatagtttcaatgttataaaaaaatccagcgtgaacaagaagcgtcttgtgcccatagtagaaaaaaccggaccgaacaggcagttcaaccggagaaaaccgaaaatagaggttggcatagttcggtcgaatagaaagacaggacatgcaattgaatcgattcagaccactttaaccggcaggttttatgatgaactgggcaataaaccgccttcagtcggaccagactaaggcaagtcattgaatgaatgggcgacaggacagcctagttagttcttaggctcgttttttgggccgcacttgttttttttttagcaaaaatcaaatgaaaaggtgcgttggtggggagtcaacccgtggtcaagggttgcaaggcaactgccgactgccgtagccatcctaccagccagatgtttgtattgtaaaatcaaaggtgtttttgattattattgtgtgatgaacaattgggcattggaaattattggttttgttatttggaatttattcacgaagtggttttggagatgattggattcataggtgatcgcaggattttattattttatgtgaccggtcagaccgggctgtgtatgccggtcagaccggcggtgaccaagcggtcaggccggtcagactgtgtcgttttcggtttcgggttatttgtttggatatccgtgattatttcatgattatggcttctagatggatactatacgtatgtaatactgttatttgctactaatgagtcaagttggagatagcttggtctcggaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttgatgagcgtggttgatggagattccatatggcatacgatggaggtattgtgtgcgtatgggatgcggagtcgaatttggaaggagtccgaatttgatatgattggttatgtaaagtttgtttcttgtactagagggttttctaaggtgtttaggactcctagtatgagtttggttcgtggctttaggctctctacctcgagtataaatagagggggagcgtgaggcttcccggtatcgctttagagagcaattgaattgagttttgagttagggtttcgagtttagtcaaaatttttgtaaggagtgctgttggtgcactttgtaaacacagagagaatcaataaagtcgtcatccactttaagagttcttcgatttgtgtttatcgggtttcggcggtctaaccggcgatctaccggcggtcaaaccggcggcaagcggcagttagaccggcggcattcgggcggtccgaccggcggcggcgacaggcgcggcaggcgacatcggtggtcaaactgggtgatctataccagtcagacttacgacatccacacgatcagaccggcagatcgatctccgtcgatttcaagggtaacttttatttccgctaaaagttttcggtttttgggtataccaaccattcatcccccctctggttggcttagttcttgtgattcgatcctacaagtggtatcagagccttgttttcttctttggatttttatcgatctagagtttttaccatggctactcctgctaagttttcaactaagcctcatgtttttgatggaaaggatttttctcattggtgtattagggtgcaatcttatattatggctgaagattatgatatttggagaaaagtttctcatccttatgtgattcctgaagctattaatactgctgctgaaaaactgcttttgaacaaaattgcaaagctcgcaacattcttttgagtggtatttctcgttcggattatgatcgtgttgcgcactttcgaactgctcatgaaatttggaatgctttgagtaactttcatcaaggaagaaataacattaaagaacttcgtcgtgatattttcaaaaaggagtatattaaatttgagatgaaacctggagaagctttggatgactatctctctaggtttaataaaatttcgagtgatcttagatctgtagattcttcttatgatgctaattatccacaatatgagatttctcgtcactttttgaatggtcttgatatgtctatttgggtgatgaaagttacatctatttaggagtctgttaacatgtctactttgactttggattcactttatacaaaattgaaaacacatgagatgaatgttctttctcgaaaagttgattctaagtcgagtgctttggtttcttcttcttcctctttggatgttgatgcttcttcatctaaatcttcttttcttactgtttttaatgccacatccgatgatcaactcgaacaaatcgaggaggaggatttggctttggttgctaacagaattgctcgagctatgaataatgccaggaacaggaaaagaggtggtccaaatcattgctttgaatgtggttcaattgatcatcttcgttcgcattatcctaagcttgggagaggcaaaagagaagacaaagatggtgagaagaccaacatcaacaacaagccgaagggttcatcccaagggaggaagctggacaatcttaggaaggcttttcaacaagtttgcgccgccttcgagccactaagtgatgtagatggtgaaagtggagatgatgataagggaaagaacatctccgatgtttgcttcatggcgcgtggtgaatctgacacagagtatgaagataatgaggtaggtgcttttgaggaagctattaatattttgagtgcaaaaaataagaagtgtgagaagatgtatagaaaacaggaatttatcactgaatctcttaaatctgaaattgctagattaaaatctcttattcctaatgatgataattgctcaaattgttaggttttaatgaatgagatttcaaaaattagagatgttaatgctgcacatgatttgaaaaatagatcttctcttgcttgtagttttgctttgcacacacgcactttggatgagtttttttaactaaaaagttgttgtaaaaatatataattgcttttcatgctagattgatgtttaacatgatttctgctaaaaagttaaaacaacctcatgatgttttcgattgctcaacatgtaatttgaataagttgaaattgaaagatgctttaggtcgtgttgagtacatggaagatgttgtgaaaaacaatgaagtgctttcttgccccaaatgtcataaaagcaaaagtgtcatggtagattgtgaaaattgtgctaatttggaaaaaagaggtttcttatttgaaaaattctttgctaagattttctgatggtaaagagaacctcaacatgattttggatcaatcaaaggttagcacacataaccgtggtttagattttaatccttatgctcataattctagacatcctcctgttgtgttaggtgttggtgctagaagtggtgagattttggttaaacctgatactaacaaaactgtgtttaaatctgctggtatcatgtctaccttgaatgcatcttcttcaaaatctcctgttgttgcttgtgttgctaagtcttctaattctacgaatgtgtctaatcatcgccaaaaatatacttgttccttttgtggcaaagatggacatattgttggtttttgttttagattagcacataaacagaaaaaggagagagagattgcttttgcaaaatcaaagtggcaaaaatctggttttccctcgaggaaaccggtcagaccgcactaggtcctgcggtcagacctgctactgagcatcggtcagaccggcggtacagaagcggtcagaccggcccccggtctgaccggctgctgtacctcggttagaccggcctcggaggaatttttctgaaaattctaaaattgattttgcacatggatatatgcctattggatcttctggtcgtatgtctcagtactggattcctaaatttttattatcatctaaccccagtactgaggcttcaacttctgcttctgtgtaggctttggtggcaagaaaggagaacgtgtggatcgtggattccggttgttcgcggcacatgaccggtgtcacgaccggaattaacccaacgggcgttccttacgtgcgtgtattattccttgtcccaggaggcaaggtacaccaaaagttgatacatttcagagtttatcaagcggaagcgtaaatagttaatttattatatgggcggcgaaggcccagcacacacaaagacaaatgggaaacagcggaagactagggcaatgaccataggcgcttgacggcaagcacgagctagacaccaaagccttcatcttccaggggttcctcttctgggtttcggaaaaattgagcaagactgagtacaaccaccgtactcaacaagacacacccacaagtgcaggataaatgcaagggagtacaagggggttataatataaagggttagggtttgcagtaaacagcattaagagacacttagttgctcaaagctattttgtaaacacgattccagagctatacgatattattaatcaaggccgtgaacccacacgaacctgccttaacccaaggtctacgatgattcagaccgaactggcaacccgaccctgggtcccagctcgtcccaagccaacccaggccaaccattccatattttagttgttaagctggttttaagaattaaaacactaacttgggtacattgctcggcatgcccataaccgagggcgcggctattcgaatagattatactctgatcagaggtgtacatctttacccacaagacacatcttcctcacgtgtaatcacgtgccacataccaccacggtatacggacggaagacgtgacatagtttccaacccatcctagccatagacaagagtaccgacccaaccccacctacggccggaacccccgggacaggtaggcaggactgaacccctagcagcaggacaccggccctgtgccatgacatctcgactaccgggccgcagctcgtgtagccttcatttgtcctagagatatccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctaatatcaaaaccatgcaccccgagcccagcctaaaaccattttgaggattttgaatagagggggaggtgtgaatccaattccacaataatccaaccattccatagtgtccaggtgatatgaatatcccaaagtctagagttgtaaaaccacctaatgttgcctaattaaccagcgaagcatctacctaaaatcatactagtggtactatgagtagagtgtccactagttggggttttgtttattctagggtgaataaggaaataataacaataacaataataaggtcataacaaaggtaaataggcatggctagataaaacagtaataacgcgggaatttaaataaagcgataatgcaataattttaatcaacataattttataaactgggattcaatatgttcaaggatgatgtgacttgccttgctcgctttcccaaacgtcggcttcaacttccacgaagagcggatcttccgaagctgcagcgtctagacgaccaacggaaaagaaaagtcttttactctaataaactccatataacaagcaggaacaaagcacaaaaatgggttcttgacttcttaaggaaaaattagagacttgaacggtccaattccgaattcaaatggccaagttatggccatttgaagtttatatgctctttaaatgaatatttgcgaatttcttcagttaaattttaattttaaaagggtttattgcgttagccgaggggagggggcgcgtggaccgggtccacgggagtggggcccacgcggcagtctcacggtccacggtggaccgggtgcactcgggctcacaccggccggcgccgtgggtcccacgcgtcagccgcacccgagggcgcgggcggctgacggccgggccccacgcggcagccgctcggtgcgcccgaaggcggccacgtcggcgcggccggcgggaggcggcgcgcccgcgcccctatggtggccggcggcggccatgggcacatcggagcggcagccgagagaggggagggaaagggggaaacgaggcggtggtccaaggctcaccctaggtcgacggcgacgacgaaaaggcaaccggagcggaggaaggcggcggcgcggctcgggtcaacggggacggcggcgctccggtggtcgacgagcgaaacggaggggtggacgaggtcggcgaggatgcggcgaagccgaaggaggcagcgccgaggtgggaggtggtctggggcgacgacggcggcggaccggagctcggcggcaatggcggagagagagagcgacggcgcgagctcgattccggcgaggtggaagggcggcgagaggcggaaacggacggaggaggtgcagggagtgtttaaatagggttggaagggggagagagcggccggcggggaaggaataggcgcgggaggtccggccgccatcaatggcgccggcgagatttgcgggggcaaatccacccgtttgaacgcgagagagagagggaaaaatggggggaaagggagaggggatcacggggagtgattttcccctctttattgcacgcggggacggctggaggcggtgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgcggggagaggccggatgggccgcggggagaggagagggagggggagtgagatgggctaacccgcccaagatgtaagggaggaaaggggactctttagaggttttctttttataaacaattttaactttgttatttgttagaaatattaatttgggctctgaaattgccctaaaattatttacgcattttaggctttctgcgaaaact

SEQ ID NO: 3587 - DNA, 4309 bp, Oryza sativa
  unsure (1)..(4309): unsure at all n locations
ngcgggccgccgtcagggcgcgcgcggagaagccgnnatggccgcggganagnaaagnaggggagtannatgnctganccggcccaagagganaaggaggaaagnngnactttttagagtttttctttttataaaatcattttaactttgtttatttcttaataattattatttgtgctctgaaaattgcactaaaatttatttacgcattttaggcttttaggaaatatacaaaaatcctccaagccttatttaacttttaactttgcacattttaattgttggaggctttcacacggattttaattattctaggcataatttagaggatgtattttagagtccttttgggacgtgacaaccggtgataaaaattggttctcctccctcaagaaggcatgcaagactgaatcgattatctttggtgatgcttctacatgtgccgttctcgctacaggtttggttaaagtaaatgaaaattttgaattgaagaatgtagctttggttgagtgctgttggtgcactttgtaaacacagagagaatcaataaagtcatcatctactttaagagttcttcgatttgtgtttaccgggtttcggcggtctaaccggcgatctaccggcggtcagaccggcggcattcgggcggtccgaccggcggcggcgacaggcgcggtaggcgacatcggtagtcagtccgggtgatctataccagtcagaccggcgccatccacacgatcagaccgagaccaatttcggtcagatggatctccgtcgatttcgaaggtggtgaagtggtggagacgccgcaatcggatgcttgtcccagctgcagttgacactccatttcctagaaccacaagcggccatcaatctaccttcctgtttgagttccggccgactgtggttgtgtggtccagtgcaagcagttatcgacttggtcgcagtgaccatctagtcccctcaaactcgtccaaaagatgatcgacttctttacaagttggtggtactgaaactaggaatgaaaaatttaatttgttataaatttgttttccaacctaaaattgttttccgttttaaattttcttagcctatctatactgcagcgtgacaaatctcttatcgaattcaacgctggttccgggcggacggccctgcctcgtggcgtggcgcggttcgaggatgtaaacgcgtgccataattttcgtggcctcgctccttcaatctcgcgactcgtatggcgcttcgtgatttatctggcaggtgcgatagactcatcgaccccatagagtgtcggcgtgcagcccaatggtccaagcagccatacaagcatgtaagccccaatgaaaattttgacagtgcaaggccctttttttttccctttggctatagcagtaattttatacatcagggaaggagatgcatttgtgaaatttctgaacataataagcaagctttcaacagttgattctctatcatcacatgcttaaccttcttctgaaatgcatatggatttcccactctgctaataagaagcagcaaattcacttaggttgtgtttagatccagcggtaaaattttttaccgtgtcacatcggatatacggacacacatttgaagtattaaacgtagtctaacaactaaacaaattacagaatctgcttgtaaactgcgaaacgaatttattaaacctaattaatccatcattagcaaatgtttactgtaacaccacattgccaaatcatggagcaattaggtttaaaagattcgtcttgcattttacacgcaatctgtgtaattagtttttatttttgtctatatttaatacttcatgcatgtgtccaaacattcgatgtgagtgtgaaaaaacttgccagggaatctaaacagggccttatactccatccatcccatttgaagtgcagccatgattttccgtgctcaactttgatcgtctgtcttatttgaaaaaaattaaaaacataagtcacacatatagtgctattcatgttttatcatctcataaaaacaaaaatactaagtataaaaaaaattccaataagatggatgatcaaatttgggcaaaaaaaactcatggttgcacttacaattggacgaggggaatatcacaacataatagtgtttaagaatttcatttgaagtcctcctgacctgaatgtcaaagcatgctgcctttgtaaaaaaaacacaagatttgaagggattgtgagcgtgttggatattaaacacgggacctgggggttgagaccatatacctcctatgaccgcatatcaagtgtatctcctatgttgcctttgtgacaatttcagtgtgtcctaatcagtaaataaggaaaaacatttgtcagttgattgtttgacatgtttacataataaagttgtttcttcagtagcttagaatttaaccgaccaactttattctgttcactttgacaatagagatacataagatagccggataggtgatgatggatcatataatacttgaaattaacaatcaagacacacattacttggcaattgatttggtagcatagaaataccacaggttggaaaatgtatattatatgttcctttcaagaaacagaatgtatcaatgctatcttatttcctgataacttggtttcacagtatagaatgaattctaaaacgtttagataatatcacataaaatgagtattgcacggtttataaaaccactagtagaaagcgcgtcaactagtgtgcctatcttatattctaatgctgatattgctagcaagctttgattaggccacgtggtgcctttcccttagcaaataagtctctagattatttgagagaaaaaatgacgccaagacatggtcactttgccaaaccatctccagattcccacgttcggctttgtggagaaataaaaagattcgtcaagaaaaannnnnnnnnnnnnnnnnnnnnnnnnnnnactatactgcagcatgacaaattagtagactattggcaagcatgcatatattagtaggtgcaactaatgaaattcgagtccaatatcccctacatactccctctgttccataatatagggcgcaactgattttttgaagtgtaccagaatatagggcgcccatgcacatgcaagcaagtagcattaaaacaaaagtatgctctggtcgacttccgtgcgcatgcatgcaaaggttttcaatgcgtggagttggctcttcatttcttgcatgttgcttacggcctctttctttcttttggttgctttaaagctcttggctcactggccggactccatttacaagctcacttgcattagttgtaacacatcggcgagcaccggcgagcagcgatggatatggcagagaagatggtggagtgcccggcgagcggcaagacgaaggccaggagttgccggcgcatgcggcaacaagcagagatggagttcggtcgtgcgcgatcgattcgtgtccacgccatccgaatgcggtagcgtgcgcaaatggagctcagccgtacccgagtgctttgcgacgccgccgtccgcatgcggcagcaagggcaaatggatatagctcttgcgcgaatggtttgtctccacgccgttcgcatgcggctgcaggaggagcgagctaaccacgtcaatgattgcgaggacagcgatggatgccgaaacctgtgatgacagcgtggttgaatcgacgatcatgggcgaaggtctcgcggccagcgctgatcatttaatcaactccgacgatgtacggtatgttattgattcactagcgaacgacactattgttccatattcactcgaacagaccgatgacaaggaagacagctagaattattgtatctgtctctatggaaatggcaaaactaatgttccctgagtatgtgagagagtatgcacattttctaatttgttcaagatcagttctttattttcaaattgttccatcctctattttttaagttcggttaaatgcaagttctttttgttaaagataaaatgaaatcaaacatgaatactccatttttttagttgttggacaaagcacagttacaagagtaaaatcctaagctatgcattgatgaaatccaatgcatcaagatagatttgcttatcacattgcaaccttattggcagcagaccattactttccaatgttcccttcttcagatgtgggatggcataatgttgccctccttttgcacgcataatctctctcacgcaaccctgttgtgtgagaaacacacgattgatagactnctgtnccatctgatagtgcatngcaatcaaaccctg

SEQ ID NO: 3588 - DNA, 18003 bp, Oryza sativa
  unsure (1)..(18003): unsure at all n locations
gatgaganancggtagagctgctctactgcaagtacatcatcaatagaatactcaagctttaggaagagatgggttctaagttgaatttcagtaccgcttatcatccgcagacagacggacaaactgaaagggtaaatcagattttggaagacatgttgagagcttgtgctttagacttcggtggaagttgggataagaatctgccttacgcggaattctcgtacaacaacagttaccaagctagtcttcaaatggctccttatgaagcactatatggtcggaagtgccgcactccgctgtcgtgggatcagacgggagaacgtcaggtttttgggaccgatattctgagggaagcagaagagaaggtaaagatcattcaagaaagattgtgtatagcccagtctcgtcataagaattatgctgacaatcgccgcagggatttaagttttgaggaaggagatcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagctacttggaaacgagaagatgaattaaagtcagctcataagcatcttttcgccagctcttccgaatctcgagaacgagattctgtttaaggggggtaggtttgtcacactctaaaaatcctgaatttataaattgttgtttaaatggaattattagaaatgatttaaaaagcctagaagaaaagatctaattttaaataataaattccaatataaaagtgggctagataaaattttattaaatacttctatagttcctagatttttctggaatttatttgggccaaggaaatatttttaataaatggaattgcatttcatgaataatttaaaaaagaaaaaggttttaaaaatcttcttttggctttgggccgaaagtcggcccaattctctccctctctctcctcggcctgcttgcgcccggcccaaccagccagtcgagccgagccgccgctcgcgctcctctctcccgctgacaggtggggcccacctgtcagggccatcgtcttcctcgcgccgcccagccgcgccctagccgcgcaagccgccgccgcccccttccaaaattcgcccgcgtctttatatctcggatcaaatcaatagaggggaaatgatcctcgggatcccctcttccttttctcttttggaatcttcggctaatttcgtttggaaatcgttgaattcgagcttgattcgaattcgttttttcctcctaaccctagatcttccatcgccgttgccggcggccgtgggcctccatcgctgctcctagcccctatataaggacccccgggacctcctcttttcgtcgctacgctcgcctcagctcgccgccgcttgtagcaccgccttcgcgacaacccgtgcgccgctgtcgccgctgcgagtccagccatgcgccgccgccgctccggtcgtcgtcgtcgctcaggaaggctgccgtcaggttcgccaagtcgtcgccgtcctcatcccatcctccgtttccaccgaggaccgccggagcactgccgtcgtcgtcgacccgaacgcctccgccgcttcgacctcgtcgccgtcgccgtccgttgccgtccgccgttgtccaagctctcggtgacttcaacgcgtcgccctctacgcgtaggcgccctccgtttgcgccgccgcgccgtcgttcgccggtgagcgtgagttgccgagccgccgccggtgatgacgtcatcgccgtgtcatctgtagacccgtggtggattagatcgatctcggccgttcgttttgtctagattagatctcggccgttcgttccgtagaccgtccccgtgcacctggtccaccatgaacccgagcccgctgacgcaataaatcatttttccttttcaaaaataattctttattccgtcataattcaattaaaatctaaataattgatttaatccgatttaatctttaaaaactcataactaattcatcttagctcggatttagttggttcaagtctctaaatttttctaaaattgagatctacaggttaaaagtatccacatgtactgttcatgattgtttatgtgctgttttggtgattttgctcttttatgcttcgattccgacgttcctggagagtccgattttgcaggagaagactttgaagagttccaaggccaacaaggcaagtcacacatatcccaaacaatcctttgagcatgttgatcccgtttaaagctattgtttctattcaactactgcatttattttcgaatgtcattgggtgggaataacctattgcctttgttatactttgtcgtttgattaataattggattagctagaacattatatagttttagctaaaagtgcataggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcgcatggttttgatggtcgtgctcatgacaattaaggaccggttcacgattttcggttgtgaaacattaaccgtgccaaccacaagccagcgtgggcaacggctttactttttatatagtatggttcattctggagcaccagactgtgaagtggcggagataagcacacgggggtttctggggagtctatgccttgtttataagggggtgattatgatccaggaatagtaaactgctttgaattgtgttatgcagagggtattgtcacaatctctattcgggtacttgttaagtatcgcgacgcatggttgacatgatgttgaggttgtgtcttgtgggtacagtggtacacctctgacctgtcacgtcctgataaattcatcccaaaataaaaatcattttataaaaggaataatagaattaattacaattcgaaaagaaattggcaaacactaaaatacgtataagaaaaattcgaatgtggcccagaaaatttttgttaaattctccttggtctaaaaggagctctcaaattttacttgaattttcagagcaccggaattatatattaagcaacaacaacaattaactaaaaagaaaaactaaaaataatcctcctccctcctttgggccgagtccagcccaaagtccttcaatcctccctctgttttccctgtttttcccgggccgccccttcctccttccctcccttaggcccagctccctcctcttctcctcctgggccgcctcggctttgcccggcccaagccgagccgcgcctcccacccgtgccgcgcatgtgcgcgcgcgtgcgcgccgttgccgcgcgttgactgcgcgcctctcgcatgggtcccgcctgccaggcgcgtccccgacctccagccgccggcctccttcctctctctctctcccgtgaaccctagcgttgttcctcctccaaatccaccccattcaagccggctttttccaaattaaatagggggaattaatctccattgattcctctttgatttcccccattttcccccttgaacggcgtcccaatcaccgggaacggacgcgccaacaccgaccgccttccattgccgccggccacaaattccgccgttcccacctctcccgtggccggctccctctcctctcctataaaatggaaccccctcgctccattctcttattttagccccctcccatgctctcccgtgtcctcaccacctctccccgccttctccttctctctctccggcgccggtcgaccttcagccgcaccttccgccacgaccgtgcgccttccggctacgccgtcaccaccctcggccacgtagcctcctcctcacccccgggctgtcctccgtttagcgtggggagcaccagaggcgctttcccgccggcgtccagtggtgttgccgccactgcaccgtctccggccggctgctgttcgtcgccggtgcgccgatcgacgtcgccatctcctccgtcggcgtcgcagcgttgtcctctcctccggctgctcctctgtttcaccagaatgccgtcacccgtgccggcctatccatcctcctcattgtcgacgtcgcctccggcagcccctcccgccgtgcccgtgcattggccgacgtcgccgtctcctcctccagcgtcgcagcggcaaggtcgcccctggcctcgcctccccatcggcggaacaccgccggtgtccgtcgtcgtcttcaccgttcatcctcgccggctcatcgtctcgctgcgccgccaccgtcgtcggcatcgcagcggcgtgttccatgccgtccttgtctccgtgcagctgctgccggctgccctcgtcgcctcctcgccggttccggtcgtcgtcctcccgtcgttctcggtcgtcgttgcgtttgtccctccgtcaagccgtgctgatcgtcgcccgcgtttcgtcaaggttgctgcagccccatcgtcgttttcgtcctcggctccacgtcgtcaggcctcatgccggccgcgtctcgccttcgtccaaggatcactgccgaagtcgtcccctcgccattcgtctccgtcgttcccgtctgtctccgccgcgcccgttcttcgtcgtcgttcccatgccttgttgcgtggtagtaaggatctctcctctcgctgccctcgttctcatcctatcggtgtcgcccgtgcccgttgtgcggttgtcgaccccggtacccgtgtaccggtgtcggtagtcgttcgcttgtgcgtgtggtgaccgtgttagtgtgcccgcttggtagccgcgtggtttccacgtgtgcagcccgtctggtatctagtggagtccgtttgtcggccactcgcctcggttgacacacgggatctgcttctatcgacccgtggaccgtctctgtgtacccggtccaccgtggtcccttaggtggtccgcatgtcaacggcgcagctttcctgtcttttccaggctagcgcttacacatgttttatagttgtaaaacctaattataataatccacaaatctccatataacagcattaaacttcgaatgaccatgccttggtcatacgaactctgaatcgacccgttcaagtctcctaatgtttgttataacctaaagaaccatgtacttcctttttatgtattgttattgcttctttatagccttgtagctttgcttttgtgcttcgtgtagcttctatcgttccggaggttcccgaagcgtggtttgcgatcgtcgccgaaggttcggaaggccgttctctttgagcaaggcaagtcacatcatcattgagcatattgaatcctagtttataaaattattttgatttaaattaatgcattatcgctttatttcaattcccgcgttatcactgtattatttagccatgcctatttacctttgttatgaccttattattattgctattgttattattaccttgttcaccctaggataaacaaaaccccaactagtgggtactctattcatggttccactagtatgaatttaggtagattcttcgctgattaattatgcaacattaggtggttttataactttagactttgggaattctcatatcatttggacactatggaatggttggattatgatggaattggacatacacctctctttctctttcaaaacccctaaaacctattttccggtggggtttgggtgcatgccagttgtgggaagtagcacccggccaatataaggattaagctcaggcctctattgcaaagcactaccgtacttccacatgtctagtgggtaaggcttagtttgtggctcagtctggttataaacaaaggtacacggatggagatggacgaagtcggggcccgatggacatctctaggacaaatgaaggctacatgagctgcggcccggtagtcgagatgtcatggcacagggccggtgtcctgctgctaggggctcaaccttggttgcccgtctcgggaatcccggccgtagccagggttaggtcggtactcttgtttatggctaggatgggttgggaactatgtcacgtctttcgtccgtatgccgtggtggtatgtggcgcgttgttagacgtgaggaagacgtgtcttgtggataaagatttacacctctgatcagagtataatctattcgaatagccgcgccctcggttatgggcaagcctagcaatgtacccaagttagtggtttacttcttaaaatttgcttaacaactataatgtggaatggttggcctgggttggcttgggacaagctgggacctaggtcgggttgtcagttcggtctgaatcatcgtaggccttgggttaaggcaggttcgtgagggttcacggccttgattaataacagtgtagctctaggatcgtctttataaaatggctttgggcaactaagtgacttttaaatgctgtttactgcaaaacttaacccctatattattaccccttgtacccccttgcattaatcatgcatctcccggtgtggcttgctgagtactgtggttgtactcattcttgctctatcttccctccccttcagtacgagaagctttggagaagaagtcctaagtggactcctagcttataccccagttgagcgcctgtgaagatggagccgtaggcccgctagtccgctgctgtttatttttgattgtcaggccttaagtgtctttgtaataatgtaaatattatcgatataataaagatgtgccttttgtatcatgtttgagtggtgtacctcggcttttcctgggacggggattaatacactagcgtttgggaaaaggtaatttttccgggcgcgacatggccagagtaaaactattcgaatagtcgtgcccgcggttatgggcgggtctaataatgtttagtttcatacctctcaccatattaaatgatgatgataataatttgtttagctcctggtttggaatggtatattcctggtttggaggtagaactgtgtagccgggattggttgttcagaatggttgggcctatgcaacgggtatgttgtatagcgttggattaatactgtttaattaaatactttactattttattaaattctggagtatttattaaatgccatttatgcaaatgagactatattatgccattctttgttattccctgcacttgcatatttgctgcgtgacttgttgagtatgtcatatactcaccttgcaatcattcatcagacgaagagttctacagtgatgctgaaggtgtggaggattaggtgtagccctggtcaagctgcttgtgggatggagtcgtctgcgccgttcatcttatttttccgctgcatggatttttattgtttgagaggaactatctacctctgtaataactttatattcgcttattaattagagtaatgattgcactctattatcaatttgttattgtgtgccttggctgattcttgtacgagggtttacacacatgtaagcgtttggaattttggatagaaattccgcgcgtgacagtggcgaaaggttttagacaaatttaaggtgttgattatgatgaaaccttctcaccagtcgccatgctaaaatctattcggattgttttagcgattgctgcctatttcgatttttgatatggcaaatggatgtcaaaacaactttcattaatggaaatcttgatgaggatgtgtacatgacacaacccaagggatttgttgatccacaataagctaaaaaatatgcaagttgcagaaatccatttatgggttgaagcaagcatctcggagttggaatatttgttttaatgaagtagccaaggtgttgggctttgtcaaaaatgaagaagagccttgtgtatacaagaagattagtgggagcgcacaggtgtttctaatcctatatgtagatgacatattgttgattgggaatgatattcctatgcttggatccgttaagacatcgttggaaaatagtttttcaatgaaggactttggagaagtagcatatattctgggcataaggatctatagagatagatcaaggaggctaattggattaagccagagtacatacattgacaatgtgttgaagaggttcaacatgcaagattctaagaaaggtttcttaccgatgtcacatggcattaatcttggcaagaatcagtgtcctcaaacgactgattagcaaaacaagatgagtgtgaatccatatgcctcggcaattggatccatcatgtatgcctgttatctacacgtccagatgtttcatatgcaattagtgcaacaagccgataccaatcagatccaggtaagagtcactggattgctataaagaatatcctaaagtacttgagaagaactaaggatatgttcctagtctatggaggacaggaactgctcgttgtaaatggttacaccaacacaagcatccaaatcgataaagatgattttagaccgcagtctgaatttgtgttctgcctaaatggaggcgctgtgagctggaagagttccaagcaagatatagtcgctgactctacaacagaagttgaatacattaccgcttctgaagcagcaaaggaggctatttggataaagaaatttgtttctcaattgggtgtgatggccagtgctcccagccctgtgaacctctattgcaataatagtgatgccattgcgcaagcaaaggagcctagatcgcatcaaaattccaaatacattttacggcggtatcacctcattcgcgagatagtgggtagaggagatgtgaagatatgcaaaatacatatggatttaatgttgcagatccattgacaaagccactctctcagcctaagcatgaggcacacactagggcaatgggaatagagacatgcgtgattgactctagtgcaagtgggagactgttggtgatatgccctagaggcaatcatagagatgattgaatcacatactatgtttacatatttatccgacattattccttgaaatagataactcattattggttaatgaatatgtgattctttcatgagactctttatgttgtatgttactatttctaaaggatcccttatcaaatatcatatgtggaacaaatatgtttaaatgatcagtacatgtattaattgatgatcatgtctcatggatcatggtatggagataccaaattaataatgtggacacatattggggaacatgttgttggatagtcccaacatgagacagtgcaagagccatatgttgttggatatggcggtcggagggtattaccgacctttccaactgccataaccgtcattacctgcctatttaaggagctcactctcttcatttcttcacacacttcaagcatgagctttctcatttctctcacgtttagtttagtagtatgaagctagtggagtaggaatagaatagaaatcggagtctggaagtcttcggaagagttcgggtatgactctagtagctctcctttcctcttttgtaagatttgtactttgtttagaatattcgtctttatacattttttttgcattgaaatactttctgagtatacgaatgccaactttgctttatgttcatgttatactgattatactgctagcttatctgggagttgcataggtacgggtataatgtttgctattgcaattattctctgtcatgacgatgatattagagtagtatctggtagtttaggcgtagtgtctagattattgggtatcattatttggggttatatgctgcggatgagaggtgggtcgctgatggtgatagctcactacgggtattcctccgcgcgtgtatatagtcctaagttaatttcatgggaagggtactcctccgtatttagccccggttgtatggttacgacgggctgtcgtaaggaactcgacagttaggggtggcttctcgaagtactagaaaggcatcagaaagagggtattagctagttaatcgtataattagaatgtatgtataatttgtatacaagaagtataggaatagattcttttctattttctttccacttagcttagataatttagtatgagaatgagtagtgctatgcttgtgtgtcaacctatcctttggattatattaacccctgcttagactatgattattacaagtaacatataaattattagtacggttctttctactatgatcttcccacgagattaaacaaatacgatacccttggaatactcttgggtgaaatgctacaatggtatatacgtgtgcttgcggataaactctgtaaccataatatttctgcagtaatgtagtaagaaataccaacacacggcaataaagtaaaatttaagaaattgtgcaactctaaatttaccatcaccacaagtatatcactagcatacactgtatttgtttttgaccctatcggcattctcattttttttcaataatttctcttcaattgagctgaaagtgtcctccagtaaattactagttattcaagtatcttttagccatgacacgttttaacagtatctaatttcaaattacacaatgtttgagtgtcctgtagtaaattttgccatgacagaatcaacacatagcgaagagaacgaatattttttttttattccttgctagtatattgtactactattttgtgacatttcttgcttagtacagaccttttagtatttattattggaaaaagtatgaattaccccctccctccgaaccacaaaaccagacatattaaacctcaaactattgaaaccggacaaattaccatcctattagattcggagcggtttcaatcctacaaggcgttgacgtggaaatccaatcagcaaaaaaaaaaaacagggctcacaagtcatattaattcccatttaccggcactgttgggcgagcggcggcactacaagaggaacctccctttagcaatacatatatgtattgcaaaaagtgaaaataagcattgctagggtctgtatcaacgcatttaatatgcgttacctatgctgctgttgctagcaccaataacaacacatacacaatcgttggtaacatgtaagaataaacattgctagttagcaacaaagtaaatagttttcagccatacttgtatgcgttggcagtttcggtgatgaacaattatatataatccttgcaatggctataatcaagttgcaccaacacttataagtattgcaatataggcaactattcattccagcatgcctttgcacaattatcttgttgggttagaggcccataaactcaaatgatgtacacatgagaaaaactaagtcattcataaaactaatagtaattaaagagaattttttgtattacatggaaaatcatcctcataagtcatgacattaaattttgttcagaacatcatgcacaaatgtaatctaaactatagaaaaaaaaacatgcatctgaagttgccactatcattgccaccatcttccacattacagtcatcatcatattcacaagggatctttagatgacagttgtccaccttgtagtaaccatattgccccagatcatgatccatttatcttgtcaacctgtaacagaaaaaaaaacaaccattgatacagtattggaagaaagaagatcacatctaaagaatttgagaaatagcaccgtacaaaaattgctggccacgcaatatcaagtcgtacgacattgccaataattttgtagcctttgtatggcctgatcaattcttcatattttgccaatggaaaatgaacatgcaccatcaagtattcagttcctagctcaatacctgcaactttgcgtgttggatcacagcttacaattgaagcaacaaccacattcttatttcgatttttccagcttttcaagaatacattagttccaatctggtgcataaatatatgtccatcagcattatctctatataaagagcaattaagtatggaaaagaacatcatattaaaagttttacctccaatgaattggcatccataatgtccactatgttgcactgttgtttctgtacaaagttatttggatcaagattcaataatttaactataaagtacaaacatattataccaaatagaattctatagcttatctttatattaggtggctccagaagtgaaaatttaccttataagcattagaattattcttcccttgttgcatgtgatcattctggttcatgtttcctttattctgcacggaatatcaaaatattggcacaaactacaataatctagttatttttataatcaaacactgtcagttccaatcaataaaaaagtgaagactagccttcacacaaataatcttcctctgtttctcaaggtgattttggccataagtttgattgctgtgtaataagataagacataagattgtaatgaacagctacaataaacgttgacagttgcaaacaatattgagatcatataatgctatgtagtgagttcgacataacaaataggaagagaatgaccttatctacagtagattgcttggttggtagttgcaaaaccttgtcctgaacatggatatttgtttaagaatgtcctttttaacttttaattcattttttttctctctctctttcctattagaaatctccagtctgtgtagcttaagctacacaaagtaccattcctagctaccattccaagaaatttagacaaaattccagcttcatctcctactgcctgattgagatcattgcactgaaccacaatcctaagacctttcggaaggttccaaatatctttcagttttgtcttcccacgtgtttcaattgttccattttcatctgttcaatgttaaattgcaaagataaaagtgatgctcaacagtccaggataagaagaataatttcattatttcttaccatcaagatttagtatttacctcgaacattaattttaacatcatcatcagattcttcattgccttctccagcattcatactagcatcgtcatcagtatcttcattgacttctccaacatcgtcatcagtatcttcattaccctcttgaacatcactgcatattgtttctcttcagatggtgtggcaagctgtttaggggcattttcttctgcaatgtgttcctctgacaaatattcctcatggctttgaacaatgcaccgccttctactccttgccatatctgctgcaccaaaacaaaaatagcataaacctatgtattgcagtctgagtaccacttttctctactgctctagaagaataatttcagaattggctaaaactttaggcattttactctactgttgtccaaaaaagtaccactatggtttgtattgatgagaaaggtgctagcctacaggttattagatacctctgttagctaatgaacaattttcaaatagaggtgtcaacacattaaaaattgaacaataaatttactaattccaatttggatttatttgccagtcactaattcctttgtccattttaattggccaacaatttgaaacaagtaattgatagaaagaacaaaatttaatttgacgcaaggagataaaatgcatagatggacagtgaacgatcaaaagcaaaagtggtttattcggctagattgcaacatccaggacagaggaatataaaaagatcacacattggattgcttattggtctgttctagcctaataggctctgtcacctaggattgatcactgcatctgatccaaaacctgcatacagagaacatatatatcaaattagtaatgtagtatagtgctgaaatggaattaggcccgagtgtgatttggcaacacagctgagcagtgaaacgtgtaggaactaggaagggaggcggagatgcaggagcatggcggcagggccgtgggctgcgcgcgcggtgtagacgtaggcgctggggaggcaaaaccgcactagcggtgcagcgcacagccaccgggcatgaggcgtcgccgcgtggccctcagcggccgtgggggagctcgcctactcagggttgttggtcggcggggaggcgtaggtgcagaggatggcagccaacacagattgggagaggtgtggacacgcggagcggctggccagcaaatcaccatggtgccttaccttcagattggtgcctggcttaagcctgaggggaggagcagtgcagagagaagaagagaggggatagagtttcgttggagaagaaaacccacccacgagctctttgttggagaatggagagagaggagatagagtttttcacgggcagttagattttcttggagggataaaatggagggaataaatggcgcgacaacgaaagacgtgagaaaaaaaatattgagaccgaaaatactgaagggagagcaaaataatttaagctcatttttttcgaaggaaagatttggaaaataacgtgagactgaaaaaaaaaaagagggaaagaacggagcgagagcaaacgttctgtcggagataaaaataatgttaaattctgactgagtagatttaagctcaatttttcggagggaatgatttggaataagactgaaaaaagagggaaagaatggagggagagcaaaataatttgcgcaaatacacaaaatgttaaattcacatcaagtaaatttaagctcgatttttttagggcagatttaacctccagttatctaatctagttcagctaatttatttttgtgcggatcaataagaactagttataaaacttcataaatgcactagtaaaaattattttctactaatacaaaccgcgtcgttgccgactcggtcctgagagaccggataaaatccaaaagtaacatattgttttcttaaaatagtagttagttaatttatcttagcacgaccgaaaaatcacgtgttttttcattgtagacccggtctagaaagactggatgaaatccagacgtaacatattgctgtcttaataaaaaagtagttagttaatttatcctagtacgaaaaaaaaccactttattttacattgttgactcggcccagaacatatttttgtcttaaaatagtagttattcaatttatcttagcacgaccgaaaaaacgtttttttttgtcaatctggtccggacagaccggatgaaatcaagacgtaacaattttttgtcctaaaataatcattatttaatttatcttagcacgaccgaaaaagcatgcgttttttcgtcatcgacctggtccggacatacctcatgaaaaacagacgtaatatacttttggtcttaaaaatatagttatttaaattatgttagcacgaccaaacaatcacctattttttcattgtcgacccggtccggacagaccggataaattccggatgtaacataattttttgtcttaaaattatagttatttaaattatgttagcactaccaaacaatcacctgttttttcattgtcaatccggtccggacattccgaataaattccggacgtaatatatttttttgtcttaaaattatagttatttaaattatgttagcgctaccgaaaaaacacttgtggtccagacaccgcggattaaatctagacgtaacatattttttgtcttaaaataatagttatttaaattatgttagcaccacaaaaaagccacgtgttatttcgttgtcgacccgattaggatagaccgcgtgaaatttggacgtaacatattttttttcttaatagttatttaaattatgttaggacgagcgaaaaaccacatattctaaaaatatatttttgaatggtttattttaaaatttagaaataaaaaagttcaagaaatttaaaaaaatctgagcagacagaatttaaaaagttttaggaatcgccactagagaagaaatgaaaaaaaatatgcatttgctagtatttgaactggagtcctcaattcagtagaaacagccaagtaccactaggctatgtccacttcacattggagaagtctgttttatttatttattcacgttaggtgccattgacaatgtaaatagttttctcgaggaatttgtataagatggaaatagaataacacaacacagatagatgcaaaaaatatagtcggccattccattttctcatcatataaacaatatgatatcttatatattgaaaaataagatctaaccaccaattctgtatataactaatgtacaacattattacacaaagcatatatgcaaataaaaaaaatgcatccatctggctcaatcacttggacaatccaatgaaatctacgaacgacacagtaaagctattgtggtgaagaagcctcgatcccagtaaatctccatccaaaattactgccataaaaataaagagctcgccaagtgaggatatcaacgatataaggaaatcagtgataatggacagatagacagagaacaaccttcataacctcacctttaattagttaccatgttatcgacagttgttccttctatatctcttcggacccatgtctgaccatcatgtgcattgtcaaatagctccccaagattattgacatgatatggttcacattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtatgcagccaaacttatctgttttcactctttttcctttagttacatcgacccattcacatttaaacaacacaactgagaaatttccatagtagtctaactcaattatatcaagtatctttccgtaatacatgatatcaccaaggacagggttggtatcactcgcagacgtgtagctcgatgtttttgcagtcacaacaactccactattttgagtcaccctgtcataacgctttgatctgaacctgtacccacgggtattgaatgctctatgtcgttttgctacctcaattggtccacgtgccaaccatctaatatcctcatcaatgctatcaatacctctttgattctccaactgcaaagatctacaccacaccaaaagatacattagttttactcatatttgaaaagaaaaatctaaattttgatacttacatgatctctgaaccaattaggaaattgttcattttgcatgttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgctcggtcctgcttgaccaaggtacggcgcaccctaagcggaggttccaccgtatacatggcatttgttttgccattggggcccacctaacaggaatttttagagtccactggatccattgtaaagaggacttcaagagcttttcattatgggtccataacaaaggtactatgcacaaatggtgacacgttgaagtcactgttggtcaacgtggccgaatcgaattgtttttgcttggttttacatgcctttattgttcgtatagtagtgcatgaacaacattctcgcttccctttcttcaaaggaaaaccggtctcaacttttcccatatgtttgtcgtgaatgttgaggaatgaaatttacgcctcagacgcttgtgccatgaagaaccaccaccact

SEQ ID NO: 3589 - DNA, 21497 bp, Oryza sativa
  unsure (1)..(21497): unsure at all n locations
gctggtcnnaattgacaatccagatgccacagnagnncatcaataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagaggggacttttcccttttggaaggctgaggggaaaggaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagcttgggattgcaccctaagcccctggtcgaaccggcaaaggggggcttgcgcagtctcccggtgaggggcaacgagctccgtcatctggcgcgccaggtaaggggctcagcgtgtgttttctgagctctcatactcttccgtgtgcaccaagtttcccttgttcagcctaatggccgagcaagcaaaggcgcacgacctctctccgagtgtgagcggcgacgacggggagccaaacccgcgccgtcgagctcgtactcccccacctcctccacgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgcctcaaggcgcgcttcaggctgttggcgcgctcctacgtcacccgcctgtcgtccctgacccggagtctccagcccagcgatggctggacgacgtggccaacttggtcatgacggcacagcaacgcctgggtgctggcggacggtccgccaccaccaagacctccggcgccgccactaccggttccgcgtcgtcaagacggagagcgcggcgagcggcggccgctgcacgccattcggctaccactccctcgtcggcgcctccgactcgggaggatcagcatgaagagccggatgcccgcctcgacattgagcgccgacgtagtgatcggcgtactccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcaaggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaaccccttcagttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgctgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccatgcgttgcccggggagggcagattgcgatggtggtttctcccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgtgcggaccacctcgctgcggcgaccaagcccgagggtggtgacgagaggcttggcacttccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtggactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtatacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccactctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccacacttaacgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaaaacaagtgcgcccccaaaggccacttgaacgaagaaccccccgggggtacggcccctagcagagaggatcagccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtataggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccgggctggggatccgccgcctcctggtgttaggcgactctcagctggttgttaaccaagtctgtaaggagtaccggtgctctgacccgcagatggacgcctacgtgcgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgattgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgctttgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggagggggggtcgggtgtcaggttttggctcaggccaaccccgcacccccctcgggtgtgtagggttggccgggggctaccacacatgcattacattcttatttctcttttttcaacatttcaatagaagcagtttcaatttcctaaaggttgtgtctgtgctgttctttccttttgaagaatcttggcttaaaataaggtcactcgtactcaaccttgccatcgggggttcggtccggtcagctaaaatcgccaaacggggcccagaaccgagccgtgccccggggcgtggtgaactccgggggggaatcgacaaaaacccacaatcgggtcacccatacccctcggtcaccacgttcccggcctggccagtctcgacatgtggatctccccaggcactagccccgacccgagccattcgaggactgggacttgggcacgagcccttatttcaagctaagacgcaaaaggaccacggcacagatcatcctcatctcgtatgtatagcaaaataaaactaacacaaaaattttttcatcatttctgattgcagattaagttaatttgtacacaaaagaggcatgaaggccttagaagaaagaaaaagaaaaaagtaaagattggcgggggcccgggggctcattccgacgcgcccgagtcgacggcctcgtcaccaccatcgtctgcactgctggtgttgccctcctcgtcggagctgggggcgaacgcgagccgaggggccgacccctcgaagctttggacgatgtggttagcggcatcccggacccgcgcgcgcgcatcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccaaattggtggggggcaccgtcgtctggcctttccagagacccgcttgccgaccggcgcgcttcaggcgggagaccgcatcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagccttcctccacggcgccggcgtgttcttccagcgccatagcacgggcctcaagggactcctcgcgccgccgggacgccgcctcactctctgttacccgccgctctcgggcagcggcggagtcaaggactccctgggcggcgtcgagcttttctttcagctccgcctcccggttggcgttttgaaggcggagggcgtcttgcgcctcaatcatcgtggtggtagcgataagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgtgagcctccccggaggctgtcgcctgagggttgcccgagggagtgggcccagttgatgcgccagcagcagttgttgcctcagcctggcgagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcactcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgtccctcgcccagcatcactatctcccgaccggtggcggactccggcatgaagcggcgcggcagtccggcgtgcctctcgctcacgatgcgggaaggtggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcatacggcgcatgatgtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcctcgggggtcgggttgcgcttgccccggccccgagggccgaggcaccccgaccccttaaggaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagaggggacttttcccttttggaaggctgaggggaaaggaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagagcttgggattgcaccctaagcccctggtcgaaccggcaaaggggggcttgcgcagtctcccggtgaggggcaacgagctccgtcacatgtcctcaatgttttttttggagttaaccttttgcgcttattccttttcaaatcagcagcatgttctctgcaaaacaaataaacataaaaggctaagcaaaacactttacgccacatataaaaggctatgtcaggacaatacgtactttagatatggtactatagcatcacagttgtatagcacatacctatgggcttgcaatttctctctaccagttaaggagtacactgatggttttcccaatggttttcctactggaggaaacaaagtagattcttgcctactcatgggagtctcaaactgatctggcttgtcattattccttgatggtaggttatgcttggtagggaaaccttccaaatatcgtgaacaaaatgccatacactcatctgccaaatatgattctgcaattgaaccttttggacgcgctttattgcgaacatacgacttcaatttacccaagtacctgtaatatatatacaagacacaaaattaataagttactactatatcatatgacatatgacaaatattataaattgtatactaatatatttaataaagtacctttcaataaagtacatccatcgatagcaaactggcccagcaatcttacattcagtagctaaatggacaaccaagtgaaccataaccgtgaagaatctaggaggaattatcatttccattctgcataatgtgatttgaattgcttcttccaaacggtcaagctcatcaacatgaagaacttttgaacatattccttgaaagtaagcagataagtcaaacaagacggatgtgacatcatcgggaagaatacccctcaaagcaattggcatcaattgttgcattagaacatggcaatcatgtgtcttgagcccatgaatttttccttcggcatagtttacacatctggatatatttgcagaatagccatcaggaacttttatatcccgaagaactttacagaacaattgcttctcgcttttcgacatagtaaagctagcaggtggcaagtaaaacttgcttgaagttctttgttgtggatgcagctcctctctaatgttcatttctttgagatcaagacgagcttggagattatcctttgactttccttctaaattttagaagtgtaccataaatattgtcgcacacatttttttctatgtgcatcacatcaagattatgccgaagaagattgccatcccagtaagataatgtgaatagactacttactgccttataagtttttgacttcttaaaatcaccaatagcatttatttcatccaatactggacgcctatagtaagttataggctctgcactaatctctgtggttccatcaaaagaatttctatcaaaacgaaattcatgattaggtggcaaaaatctacgatgacccataaaacaagattttttcccatgtgccaaacgtttggaccatacatttggaccacaaggcgggcatgcaaattctctatgcaccatatgtgaagcaagcattcctaaagctggcaagtcatttatagtccatagtacagctgccctcaaattaaaagtttcatctctagatgcatcatatgtggaaatgccattgaaaaatatgtctcttaaatcttctagaagtggctggaggaaaacatgaatgtaatctccaggacttttgggcctaggaattattaatggcattagaagattaggttccatcatgcagagccatggtggaagattataaattactaaaacaattggccaacaactgtatgtagagctcaacataccatatgggttaaacccatctgtagctaacccaaaccgtatattacgagaatcagatacaaattgcttgaacctttcatcaaagttcttccatgccggagaatcagttggatgttgaagcgcaccatcctctaagcgctcttcatcatgccaacgtgggagcgatgctgtttctctgcacatgaacaatctttttagcctatcctttattggaaaatatcgtaaaactttgcttggcgttgctttctttctttctttcgttaacttggtttctggctttttacctttccatctagaagccttacaaattgaacaaaaatcatcattaaccttatctttccaaaacagctgacagttattgggacatgcatgaatttgttgataatctagaccaaattttgaaaccaccttcttagcctcataaaagttttttggcaattctttttcatttggaattgccatgtgaaggatatcaagtagatcgccaaatgatttatcactccatttgttcatggatttcatattgaacaaaagcactagcagagataagtgtgatagttcacatccatcccataaaggcttctctgaatctttcaccagcttataaaatgcttgagcttctaaatttggcccatcagtatgtgtacatggtgaatctgcatgatcactcataggcacgtcgtcatacacagtcctaaatgcatcattaattaattcgtgcatgttagcacgcatattttcattgtggggctgtggttgctgattcctagtttgctcctctgaagactcaccatgaaaatcccattggtcataactctggagcattccattgcacaccaaacgatcatagacatcattttttgaaagtagcatagtatgtacgcatgtttcacatggacaataaatctttgtatcctccgacttatctttatatgcaaattcaagaaatccatgtactccagctaagtactcatcagaacctctagggtagcgcaaaagaatcttgatggtttttaaatccattttgacctgtatagaaaaatgatatttaagattcttttagataataacaatgacaaggaattgtctcttctgataattttttgaaagtagcatagtatgtaagccttagtccataaactgtaaaaacaggctatatactacctgaaattaaagaaaagaaaatggattctctcagagaaagtgaacattaagggttaaaatttaccaagaaagaatatatatatagagagagagagaagtgcagcacttaagaaaaacccaggatggctgtagcttgcaagaagatgagatcaagcaaataaatgggacataaatgttctaatttcaaaataactgtatggaaccaaatacgaagtataataaccatcaaacttcatctgccagcagcaagtatctcaacataatcaaatttcatgcactgctatataatgtatatacacacatatcccattcaacttcagtccatcatttttatgaagacatttctaataatttatcaaacaaatacactaatgaaatgagtggagcaggccggggattggactcagaccttagttctgcagcctagccgtagaccaccttcacccgcgtttaccccgtcagcggacgcggaacagatcggggcgctgccaagtggtgagacctccggcgatcgactgcggggttgaaagtcacgacgttgacggaggatcagcgccgggactattaaaggatagagagaatgtttttaagtacaaatgattcaaggttaaacatgagaaataaactatcaaaattatattatcatccataaatgtaaattagtctcttgaaaattcagaacttagttaattcctttaattggaaaagaggcaacataaatgaaggggatcatcgctttggtctaaatccagtgaaaatattgttagcacaaatttatttaaaatcctataggcatggcaatgtagagaaacagattggtaattgttttataaacaaatccagcagcataacatattggtgtaatactttcctactattgactactacctccgtcccattataagtgcagctatagtttttcgcgtccaactttgaccgtccgtcttatttaaaaaatttttgaaaaaaatttaaaaacataagtcacgagtaaagtactattcatgttttatcatctcataacaataaaaatactaattataaaaaaattttaaataagacgaacgatcaaaattgggcgcggaaacttatggttgcacttataatgggaccgagggagtacaactttgcttgattaacagggtagcagaaagtttctgcggcattcaatagaatgctgaatgtccatggtctgctcgtacatggcatgaactagtcagaatatcatgttcaactcaacagctaaataagtttaattggtgtttgcatcattaataatgccatatcatcgaagatcgggcccatcaggtagctatcccatggataatatgctatacgtaggagttcgagagaagcagtagtgcctccaattccaaataccgtcttcggaggctggggttggcagtcggcagcccgacgaacgaggcggcggccggcgtcgctgtgcccggcggcggagggcgacggcggcgcggcacagcggagggggatggtggagcggcgcggtgccggagggggacggcgcggtgtcggtgctgcgcggcgtggcggcggaggccggcgccggcggtgcgctacgacgcgaggaagaggcggagcagagttggggtcgaggaggcggcgctgggttgagcccactgggctatattttgttcacgtatatcgttctgttggttctcattaattaaattactaaatatagtatagtagttatgcctacatataaacacaaagcataacattaccaggttgttaggtgactggacggagagcactttttcacgaatgttgcgtctctgtttcgattaacacaggccgatttgttttttttttaaaaaaaaaactcgcttgaatttttttaaaaaaaaacagctcgcccagtacacagtgtaaaaaaacagctcgctcaattattattattttctaaaaaagcttgctttagtccaaaagtttttacatggcaaaaaaccaactcacttgatgatttcttaaaaaaaacagctcgctagatgtccgaaatgtaaaaaaaatatatctctttcaattattttataaaaataaacaataagtttgcttagtccaaaagtttttacaggacattgagaccattgcaacgcatgttatctattgcaaagtggactcaggcgttgcaatatactcaatctctgcaacatatgttctacaacacatattatctattgcaaattaggctcacccactaataagcgttgttaggctcgcattttggtaacgcatgcttcatgcgttgccaagcatgtattgctagagggggttcctgttgtagtgcggtgggtgcgactccggtcggtggcaagcacgacaaggaggggcgacgagcgcggtaggaaggggggatcggctggcagcgtgtggcgagcggcgagcagcgacgggtgcggctgggtagctccggtcgactacgggtgcagttgggcatgcgtcggcgggtggtgttccggtcggcggtgggcacggcaaggagggtgaactggtcggcggcgagcgacaaggggcgacgggagtggatgggtgcctgtagtcggctacgggcacagctggacgagcatggtttagcgcgtcttctgctggcagcgatcatcgctggcatgagaagttcgtttggttatagtggtaatcagcaaggggcgcggctgggtggccctggtcggtggcgggagcagtggggagggaccgccaccgtcactgatgccgccaccaccgccgtcgctgctttcccggcctgccctgccccccggcggttccttcgccaccaccaccgccagacctggaggaagaaggggaaggaaggggagaagcggctgtggcgaggaggtggcttcgccgacagcggctcgctaccgagctgcactcgtcgccgctggcgacccagctgtgcccgtcgccgccgctcgcaccaccacccacctcccactcctgcgcccccatgagagagataaagtgaagagagagagagaggaaaaagggaagcggagtatgataggtgggtcccataatttttttaaaacaaaatgatgacatgattgccacgtgtatggcatgtaggacaaaatcgctctggattaggtcaaggggggtaattcgtgcggtattgaaagttcagggtgaaataataacaaaaattacatgaaaaaattacagctcataatctttacaaaattagttacaaaaagttcaatcttagataaaaataaagtaaagccatatataacagcataagtacagttaaaaaaggtaaccatacacacgcatacctagtacaattttagacttaggagtgtgcaattttaggctttattttttaatatatgatatcattgactttttcatatatgtttcatcgttcataaaaaattacgtaagtatcattaattttttttgactttagaagagcatgtagacttactgtaagaaacatatttcttaatgaatgagagaaaaaaaataatctgaaactaaggttcatggagttttccatacaagcttaacccgattcaacaaaagaaatatatttttagtgtagtcactagtagaaaaacctcatagatatctgttccaagaccagcaccaatataattaatgaagctagctagtgatggtacttgtaggtgcctcttatatatagtaatcaatatgtgctggtttttcctagtacatatatgccggtttgttataacaaccggcacctattactccttaaaactattaattggtgccgctctgtattttaaaccatcataaatggtgacggattttaatttgaaccagtcaatgaggcttagatggatgagaaattggtcatatttgtgctggttttaagcgaacatgcatgtataaggacgttacatatgtgacgcagtgtattagtgaattattaaattaaattagatgataactagaaaccaattagatctctccttggaagtagactttttgattagtagtatatggacactccagccaatcatttattaattcaacacagtgggattgttgcgcacagctccctccagtgaatcaccaatcctcgactccctcaagtcactactctaacaaccattgtgcgggttggtataatgtttctttcttttaactaatcatgctgaaacttttgcatcgttttgcctgaaaaaagtctgcattaccacggagaaaagatgacaaaataagacaatatccataattccatatatagtcctgccggcgagcttgtcaatcaatcccttaattcatcaaatcttgacgggtcccctatctattaatctcaagccaacagataaattaaaatcacagataaattgattgggccacgttttgtccctgacatcacagataaattttgaatttatataagaagaaaagtataaatctatagtataataatatgagatatatcacattgatgcgagtggatagtcatcgagaaaactctacacaacacataagccatgggctcatggcccgactcaattgatgttagttaggccaaataggcccattcagcaatgtaccatgaggccaagttttaacaaaacacaagaataatttgtagaataataaaaatattctatttgaatgctagaacctattcatagaaatcataggaattgtcgaaactggaatttggcaacaataaacggggtagcgcagagacctaaaaatggatagatgcggagataatggtttagataggttcaggccctctcgatgagaggtaataccgtacttctgtttgaggattgtatccgcgagttatgtattgatttgaaaatttggttgtggttatgtgttcatctacccttgagagggcccctgctcgtcttatataggttgggggtggggcagggttacaaagacagaaacctagccggacacggcattagtttcctaatctactatatgttagataatagagaaatgatgaaatgacttggattgaaatattatgaaaatgatctagcatgtgtatgtttagttttagaatgaagtaaattgtagatataattactatatgtttgcatgttaagccttgtgtgtttaatgggttgatgtggcatgcttgtatgtaggttttaggagtgctaataaatacaatacttgcatgttttgctttaggtagtacccggttgggctctataccatgccttatgatacaaggcaacatagcaaccgagtcctactctataacataatatatgcatcctgcccacctcatatctcttgtcgaatatgcactagaacggataccctcatctcaattgggtggtaagccccatctcaatcgggcatggcgtccgtcacaggctagaagtcactgatgtgaagagctatctcaatcgggcaaacggccgtcacggatgattctatctcaatcgggccctaagtaaagcccgtcaccgatagctttgacccagacgaccagtcaaactatatgacctatctcaatcaggctacaactagcgtccgtcacagatgacccttatctgtgacgggcattaattatagcccgtcacatatgagtcatctgtgacgggcattaacctatgctagagttaatgcctgtcacagatgagtatattccaaaaataaataaattttattttttggctagccctcactcgtcacttaacgtcaaagttctctagagattggcttccggaaaagtaattgtgacatgttggtatgagtattctattaatcctattatgccctagtccaggatgtcaaattgggattattaaatgatttcaaatggaaaagtcaccaaaaccaaagttgtagaactcatcgaggtgcaaaatttttattttggtaatttctccatctgactctatttaaacaatttgaaatttgaaattcaaagtttgaaaagttcaaatagaattttagatcagtgaacgacttcaactgaaaaagtcatcaacaacaaagttgtataactcatcaaaatctataacttttattttggtcatttttctatataacattttttgaaccgtttgaatttgaatnaaaaanannacaantnnaaacaaaatnnnaaaatactaaatnataataanttaaaaagttattaacaaaacnttgaattacttattaaaaactaac

SEQ ID NO: 3590 - DNA, 58638 bp, Oryza sativa
  unsure (1)..(58638): unsure at all n locations
aagtggcaactgtggagaatatggttatcgggtacccacatggcctccatcactagtacagatccctctatctgtgacggactctaatatgcttagaaatagcggcccgtcacaaggaagtcatcacaatcgggccgaaaagtgcctgattgagatatggtcgcacagacatgttagatgggtataaaacttaagcccgtcacggatgacacccatcagtgacgggccacaactttaggcccgtttgagatatgaaatgttatctcaattgggcctaaagttgtggcccgtcactgataggtgtcatccgtgacgggcttaagttttatacccatctaacatgtctgtgcgaccatatctcaatcaggcacttttcggcccgattgagatgacttccttgtgacgggccgctatttctaagcatattagagtccgtcacagatagaaggatctgtactagtgatggaggccatgtgggtacccggtaaccatattctccacagtagccactaagacgaccatcacagtcgaaaagataatcttctgctgaggtaaatcaccaaaaagccaagtatttcaatcatcttcgccatagtctcgcgagcgcttttatcaaatcatgaggctatggagggccgaaaaaatttaaggataatatcgaatatatatttaagtgaattgattagatgcacctaattaagtgtagttcctgactatgtgtttagttgaacaatctaagcatatagtcaagagataaataatttaaccatccaagtggtttaagccacctaagtagcataataatagtagtatgaaccctcgagtatacgatactcaagtgataaaactgactgcttaaaaaatataatgcgtacaacctaaagttgactacatctttcaaaattcacatagaaaaatagctataaagaagcttgtatgctgtgaataaagaaatctctaaagtatcgggcacatgccatgcgcacgctgctttaacaaatatgcttaactcactaaaagacacatggtttcactacaccaagaaatatacggcatatgtggtgtaaaatccgtgtaaataaactcataaaggatttaccagccgcctaaaaaggaccaaaatgtataatcagcctaagccataatattggtctataaataaaaatgcatacttacgtagcaaaaatgccacgatattgtatccaatcgattgctttataaacccgaacaataccctgacttatatatatatacatatatatatatagagaattatatatagagaattactatatggcaccttaaggggctatgtactaaacggcacgtgatacaaccccagcccccagccccacccactgtggaaccccacacccacacacactccccaccctgcctaccactaggtccacagaatgcagttaaaattttactcaccgaccaatctcgatcccacccctatgcccctccccacactcccatagtccaagtaattttttattaaatgttaaccaacttcttagtagttctatatatagttaaaatttaactcatcgacgaccaatctcggtcccacccctgtgccccgtcccccactcccattgtccgagtaatttttttaattaatgttgcccaacttttcaacatatatatacatgtgttgttcccccatcccgtaaccaactgcatatcccaatctgattttttggatatgagggagaggcggtgggtcagtggtgacgggcgtctgcgggcacggcatcggcaagtgggaggtggatctagcacggcacggctgcgagcgcagtggtgacaggcgactatgaacgcgcatcggcaggcgggaggcgtggcggcaccacctctcccgtcgagcggcagagggcgtggcgtcggcggatctggcacagcacatttgcgggcgcagcagtgacgggcgactgtgggcgggaggcgcggcgactccacctccaccaccgagcggcggcgggcgcggtggcggcagatccggcatggcctggctgtgggtgcggcggcgacgggcgactgcgggggtggggggggaggggggtggcgagaagacggcgcatccggctgccgctccgtgccccacgtgcgcggatcctgttgcggtggagcgtatccaagcatggatgcgggcggcgcaacggaggatgcggagtggatcctgcacgggtgacggcgagcgcggctgtgacaggcgggaggcgaggctacggtggatcgggccaccactccgcccccacgcgcacgacgtgacctccgcggcggcgagctcggactccgatggatatggaggaacagctgcggccacctccacgacgcgccgccgtcgatgtccggagcaagtgccaattaaaatttaacttatgcttatagattgtgaggatgtatatgttgagtaaaaaattttttgtcataccaagttaattttttactcaggaaggataccaagttaattttttacatagtcgcccctatgtttttaacattattaagctgcatcccatgtaaaaaacgggtttctaatgaatacaacgtgacaattacgcaacctattttttttcccttaattcacgccaaaaaaatgtgtaacatcattttttgcagatccaaacgaagagtccggttttgttcagaggaattattgcacaaaaaaagcaccttttttgggcacctcgtctaaccgttttttcaattaacaccgaatcaatactccattcaatcatgcatatttttttaaaactaaagttactttttaactatgtttttcagacatcatataggtgttttgaaaactataagttattttttaactattaaatccaacaattatgacatcacacatttttttaaactaaaagttattttttaactatgcatttcaaacatcatataggtgtttttataactataagttgctttttaactattaaatccaacaattataacatcacacaaatttcataaattagtttttaactactattacaagatcttatatttacaagctaaactttaagtacatattcagtccccgtataagtatttctacaacttcatattttttaactaataaaacaaatgtttttaatgtcagttattatcacatcgatttaaagttaatagttaactcatccatattttgagtttacgtaactccaagttcaacaactcacattgtaaagttcaatttttactccacaacaatgtcatctcaatccaccaaccaactgtatcatatttaaattttaactccacagagaggttggttgcctcggtggtgggggaagtcatgagtagcgctacgaagtttcatagcacgcagcgtctgtttgtcgcttcacgtagcgccaccatatatataattatatatgatatatatattggaacatatatatgcataatatataaacatgcaacaagcagcatgaaaaaaaaatctttatacccggttggtggcaccaatcgggactaaagattgatctttagtgccaggtatttgaatcggaacttaaaatagtaatctttagtcccatatacataactccgccaaggggttgcaaccggggttaaaagatggtttgtgcaacagtgatataatcctacaagtcatttttgtgctgaccttaaatattgctttgatcgaagaatagtttcatttatttatattttagtagtcgtttcgattgtcgatctgaaaaacaaaaaaatagggaaggaaaaagtgcgtgtatttattagtacttgtactacttctactccctttatcaaaaaaagtctaacgccaaagatgaacttatgttcagattattcatctgtggaattagatatttttttaataatagatttaaataaaacccggcctctgtctaagttcagcgccacacgatttggcgttgagcaaaagggtcagatttgaaataagttttggcagcgattcatttgtaaaaatagtttttgcaaagggtcaaattgtcaaaattaatggccaattggatgtaccgagtctgattcctgattgagcatagggaagtctaatcctaattgaacgctacggaagtgaacgtcagaacgggacagctgggatagggagatgagggaattcggcagacgaatccacgaattagtacggtggtatactgttgatccacatcaccaagcaccggaatttctgcctgcaggttattctcctccacacaagaccgtataaattgcctcgagtggacccgcagcagttagcgcgcagctctcaatcatggtcaccttgcttgagaactggtcatgataagcaaggaagatacaggagcagttagtcccgacactggtcaccttctcgatcctacgaggcgctgacatggaaatccaatcatattaattcccctttactggcactgttggacgagcgacggtgggtgcgactcgcaacgagtagcaagcggtgacgggcgcggtagggagggggaatcggccggcagcaagtggcgagcggcgatgggtgcagctgggtggctccggtcgactacgggtgcggttcagcatacgtcggcgagcgcggttccgatcggcggcgggcgcggcaaggagggcgaactagtcggcggcgagcgatgagcggcgacggacacggatcggtgcctccagtcagctatgggcgcaactggccgagcggcggcgggcgcgtctccggcatggcggggaggaggagttggttggcagtgagcggcaattggcaaggggcgcggctaggtggccctggtcggaggcgggagtgacaggcagggaccgccactgtcactgatgccgccaccaccgctgtcaccgcttttcctgcctgccctacccccccccccccaagtggttcctccgccgctgccaccgccggacctagaggaagaaggggaagggaaggggaggagcggctgcggcgaggaggtggcgtcgctgacagcggctcgccacccactcggggggtaattcgatcgaccgagatagttcggggggggtaattcatacctttttctttattatttggtataagggatgtatttatcacttactagacccgccttccaggataagttcgttttacacattccacctaccaatacataaccaacacaactagaataccgttactttctcaaaatccaatgccattattcattactaagagtaacaatgctttttttattccttcctatgaggttgtagtgctattacctgatattagttgcttagtatcttcacaatgtttactacttggtataagagatgtatttatcgcttactacacccttatgctaaaataagttttgtttactagctggttgtaatgcaattgtcacatatttgctgcttactacctccaaaatatttactattcgatataagtgatgtatttagtgcttactactacaccctcgtcccaaaataagttcatttttcacacatctcacatgcaccaatacaaaacaaaaagacaataatacacttgctttctcaaatgacaatgcaattatttcttgctaaaagaattaatgttttttattccttactagcaggttatagtcttgcttgatatttgttgcttagtgcctccatcatgtttactggttggtataagggatgtatttattgcttattacaccctgctcgcaaaataagtttatttttcacacatcccacacatagcaaccactatctatttattttactacctattttttcttctcaatcaatcacaaacttcatccaatcatttttacctagctacttccttaatatccatgcccacctaatattagaatggagaaagtatctattttgtgatagagagtatccttttaagagttcactgtggaagccctattatttttacttatttctttaatatccatgcccacctaatatttgaacggagaaagtatctattttgtgacaaagagagtatcctttttaagagtacattctagaagccctatgccttatcctatataaagcagctagctagctagctagctaaagcaacgatcagactaccacactacaatagtatcagtgaactgctattgccctcccaagggaaatatactagtatgtcaacttccatccctctccctttcttcttctctcatggtgttgtgcatgctaggataggccatcgtccaatccagccatcggttgggcttctttctgctggtgccccggcaaaagtctccttccgacgacaaagcagtgcgcatcgacatgctgcacatgttgtgtcctcagaatcaatcactcctgtaaaggaagtatctagctttgagccctctgtatggggggatttctttatcaactatgacccaaagccactacaggtataccttttttattttcatattgtagaaaccctatcttgatccaatacaagcatcgtggcaatcgatatgagatgacataattaaggaataaggacgagatgatgtgagataaagagtcactagaggtcgggcagattgatgggcatattatttaggtttcgcctttttcacacgtggtgctattatgaggccgacctgtcaattgtttttatagacagctctgggtattttctattaaaaaatacgattttctcggcctttaagatgggcacctaaaagaatgatcctatttttctatgtgcctcctagctagcatgcttgcctatgaaaattgactctcatcgtagagccttgaccagagagcctacgcattttcacaggtaggtacttacttaggccgcctataaaaatatacgggttgttcacgaaaatagttctttatagcgtgggcaattactccctccaatgtttctcatttggtattctgacgtgcagattttcccaacacaacttcaactaagacttgacttttatagtaagaatggcatattttagctgtaaaatcaacggcaatattcacatgacaaattatataattaatacttctatatctatttacgtactttaaaaatgtttgcaagcactcattgtagaacggcacatatttggaaattaaaaggatggaggggcgacgtagttcacattttcctagtggatcaatggagttttatcatatttttttattacatttgatttaatgcagcttttggcaagaaaaaatttggtcaaatccacaacacaccaacaagttatctaaaaggaatgttttatttcacctaattattcattcctgtatttctttcatccgatactaacaaatcaaatttatgcatgcaaataaacagagatcggaggattggatgatggaaaaggctgataaactaaaacaggacgtccgtatactgtttgagacgcacaatgatacagccaagaaaatgcacttagtagatgcagttcaacgtcttggaatagatcaccttttccaagatgagataaacaatgcaataagtgacatcaaagaaagtgaattcactagctctagtctccacgaggttgctctccactttcgcttacttagggagcatggcatttgggtatctccaggtactaataaatactgaaagagataacttgcagagtgattttcacaaaattgcaacttggtcaaaactatctcactgcaacatttactatgtattttacaaacaacaacaatgccaaacaagtctattacaaaatacacccttcgtttctataaatctggtcaatcttaaagaagtttgactagcaaaaaagtcaaacgacttataatatgaaaaggagggagtaacaatttatccactatgtgcatatgacagataggcccaattttcaatagtgccagtatttcttatattggtgatgacttacatatacaaatttttgtatttttctctagatcacaaattttaagtcattgtattgtaggtattcattcattttcgtaattatggttgtgtcaaacaacttttcaatacaagtccagattagaatatatacataaaaattagtcaagaatatccgatgtattaaaaaattgtatgaaaagggaatctagtgtcttttggaaggaaaaatccacatttaatttagctgccttgcagatgtattcgaaaaattcaaaggagaggatgggaggttcatcaatacaatagctgatgaaccaagggcattattaagtttgtacaatgcagctcacctccttgtccatgatgagccagaacttgaagaagctatgtcttttgcaaggcaccacctcgaatcaatgagggacggaagtaggctcaaggcccctctagataatcaaatcaaccgtgccctacacttaccattaccgagaacctacaagagagttgaaatgttgcattacatgctggagtacggacaggaggaagaatgtattgttgttcttttagatcttgcaaagctggaatttaaccttctgcagcatgtccacttgaaggagctcaaagctttttctcagtaagagtctttctttgctttgtctttgtacatgtcttgtggatgtagataccaggtttattcatttcctttatctaaaaaaagagtatttatttgatatttatatatataataagtaaatatataccatgaaagtaattgattgtgccctttaggacagaaacaaaccactgtaataatctcaaatctgtgtatgtgcacgatacaactaccaaaatatgtttttcgatcttcgctctacagttagtaaagataatttagagaacatttagttattagtgaatgggccgtgcattacagtggagaatttagaagtatttgttttctaggaaagcttgataaaaacctattggaaattatttactcgtcatacctaaaaggactataatttgagctacgtagaagttgatgtgtaatttcaactcatgaatagttatgacaagtatgagagggattcgatggcttttactttctaggtgagatgttgctcaatacatcttgagctctaaagcaattatactaagtggttaattctgaatacacatgacatgtgggtagctatgatcaaagtaaaggaggaatccaaaggctgttgtatttcagatgaacttaatcaatacatgtggatattttagctctgactatataggatagacagatatagataagtgcaaaattctggagagacgttgtgttccttcgatgtactgaatggtaaatacataaaatgtgtacctcgttttagacaaattgacgctttgtttgtgcaaccaatttaatgttaattaatcacaaaatacatgtacaactttatgttttgtccagaagtagtcaatatatgtcatgttaatgaggtagttagtgtatccgagtttaggtatcgctttatctgtagtttcaagtattgaacaatagaaaattaaggtttatactactatataatttgtccactctcagataaaaaagaaggacagctagccttcaaggaatatccgaatattttatcaatctttgtctcagcatttgcagcagcaatacactagaggcttttatgcggctttaaacatccaataactagtgacatatactgaaataactagcaatatggctcttcatgttgttagtgttttcggtatgcctgatatgctatgtacatattattactatcataaatcaattaatactcattgcttctaatgatctaatatatatatcttaaatatacttcaaaacaagcacctaaaacaatcgatcattttaattttcaggtggtggaaagatctttatggatatgtcgagctaagtcatgttagagatcgtgcagtggagtcatatctttggtcctatgcgctgttctatgaagaaaacttaacactcacacggatgatccttgccaagataattgtattcattgtccttatggatgacacatatgatgatcatgccaccatcgaggaatgcaggaagctgaatgaagccatacaaaggtacgattaattaataggtcaaaaacaacagaaattaatatccttcatctcgagccaccaattgtaagagaaatcaagaaaaccgcacaacaaattatatttaaaagttctaaagtttcacagaatattataatatgttaaagatcaggcttttcaaaattgaaaggtacagatgatcaaatcagaagcccaaaaataaatcaaaatttaactattctacccctatacctgtaaatctgaatcaattgaaacttctaaacgctatgcatgaccgtgtgatataacctcatatacttaaagtaatttctatggaaaaatatccagagatagatagaaagagagagagagagagaacgtgctattgcctaacacgtagcatgttgtttaactaagcaatgtgtcacacgcgtgcccatcgatcctctgcacctctcccaccccttcattagctaccctctgcccctcccatgcagattcaatattttgtgtatttttggaagaccctacctatacttttacttctagatgggatggggaggggatagattgggatggttgtctctgacgcattgtctagatggccaaaagctggcagtctttttatttcaataataggcacatgcacatttttcatcgtaaccactacaaaccatttccgtgtccctatgaagatgactaatgccgcccagggtcatataacaaaagaaaactatttttacagatagctccttatgaaaaattgcatgtgaaaataggtctattaacacaaatgggtcgcgtaatttgaaaggtggggtcatttttatatacggatctcataagaaaaaatcaataaaattgatttttaagggcagttctattaggaaaccacttgtaactctttcctatgatgtcgcctaatgacaaatgttatgtgacaattatagttcttgttgagatgttgtagttaatgtttttctattttaggtagttaatgggatcaaaagttcattataagaagctttaaggtctacattagaattttttgttacatacgttgacgggtacaatttctataaaacaatatagcgctcgacaaggtttgtaactttctagtcaaagttatttcatttaagaacatttaggtgccgaaatattcgttacaaattcggaatctactttttaaaataggatgattttacaaacagatctttatgaagtctaaagttttaaaattcatagaaaatacaccttaagtccaattgagttaatccaaagttctatgagatccttacaatatttcctcaaatatggcctagtcaattttttttttgatatttcctttattatgaacattcacaaatgtcaagttgcataacacatcaaaacatacaatgggaacttgacataagtgaacaaggatattaccaaaatatggaccttacaaatttaatgaaaaaattgttgggatcatatataactttagttcacctcaatcgcacttcaaatgaacactacataaatctttaaggttttaatatgtgttacaagtttaggagagtttaaattagaagaccaacgtctatttcatagtaattaacaaagtgcttcatatgtaagatggtaataagtaagatacacatgaagggagagatcccggatttgaatcctacatactagatgcatattttgtgtgaaaaaattgcgaacttgtgataattaaaatatgaaatactttttgcgcctacaataattaaagacttgaaagtcgaacttaaaatacaaaaaaatagatttgttaacatgcagttgtgcaatccactagcacaaaactgtcgatttctataggccctatgtaacatttggttggctaaacactttcaaaaatgggggtaccaattatattgtaaccgcctataaaagtagttttccgagcattcaacattccacctcttattttagagcagcaaaacatgcgagtttttccaactactatgcaatgaccaagcagagtaccgctcatgcatacacatatattctactgtcattctatcaagaaacagctaaggccaacttttagttaattaaaacagagatgtgcaactggaggtagagctagctacaactaccaaaggtagctggcatcagtattcttgttaccgagctgttgctgccagcatgatatgaaccaacaatttccatgaacccgagctacttagagcaaataaaaaagaaattgtttattttaccttttgatgtttaatgcacctaaacaattaatctgagtaaagcacaactgaaaaaccatgttgatcctctaactaaataaatttgttgtacagttaccatcgaatttatcgatcactatacatctcaattaattatggtcacgcgtttcacacaatgttaacaagtctttcattcgagaaatattaaacatcatcaaaccactttattcgtcactggtacatggcgtgtccatttgagcataatttacaaagtatttcattcatttatttgtggtttcaacgcgatacatccctgtcaaactatctttttcggctagatttatttacacttgcctaattaagtaatttcataaaaattcccaattggcctattggacagatgggatgaaagtgctatctcattactaccagagtacatgaaaaagttctaccgtgcactgctgaattacttcagggagactgaagctcaagtagaggccagtgacaaataccgggtgacctgcatgaaaaaagaggtataccagttatatatgtactgcatctttccacttttatttcctgtatttgtttaaatcttcatattatgcattgatcgttaatggattcttcttactgtatgttatcgatatataccaagaaaagatcgtgtgcaccaatgaaatttgtcatctattggaataaactatccacatttattatatattcaatataagagcatcaccaacagttcccaaaattctatccctgaaatcttttgtttaaatcactaatgagaaaattttgggatagaatctagggctaacttttcaccaccaaacctaaaattttgaaaccatattgaacatctattactgatagaaaatcgtaataatccaggtaccaatacttatagctgtatgctcaacatgaatttgttaaaccatgcctaaacgataacacacgtgctttttcatcctcactttatgtaaaatgtttagtaagtgttgctagaacttggacaactagatacgtaaacttgtgtaaccctcccaaaattagcatggtaggactaaacttctcatttcatactgtacacacgtagacttctatgcactaccagacttgtgctaaccctacggatcaaaaattgtcagaaaaatagggtttatccgtagaaattgtatttttgagggaaccgacaagaattgccgatagaaaaatcacaacggagaaattatattttcctatgggtttccctatgtgtttaacacagaaaacttccattggcatcgggttttgtcgcctaaattgtgacgtgctgccgtcaggaaaaaagatcatgtggcaccataaaataaaatgggttcaagaaaacctcccgcccccccccccccccaacaattcaatccacatatccatatggattattgaacataactttttcaacaaaatatgcaaatgaactcttttttttttactgatacataagtgataaagctacagataggcatgcacaacaattcagcatcaaattttaagcaaacttcaatcctgtaagttatataaccaatacacgtacatgccaattcacatcaacaagaatcttttattcaccactataagttacaagttatggtactacatgtcctccggcagcaatattccaagctagatgagacaatgaatgcagatatcttatcccttttcgatgcatttttatctctatctattttctcctctttacttgccttgagaatactacagattatggtaaaaatatatcaacgtataggagacacacaatattgtaagctggtcaataagatcctgctatatgcttaaaaagttgtggttactgaggatactacaaacagcataatattgaatacatgtaagtaactgtcagtctaagaattccaaggatataaataactgattaatcatatggctgctattatcatgctttaatgttctatactatttatgaaattcatatattatttagcccaatagcttaaatggaattatctgccatatcaatctagctagcaggaagcacaattaacccatagcttatacttaatctaatcgtattccagcgggctttgcacaaaatatatatccttcactgacacacgaactacatatccttaacaagatggacagggactgaagatacacgcaaaataatgaactagctagagactttaagtgtatacatcgatctaaatatgttgttttttaatcataacaatattagaagaaaccaagggaaggccatggcttttttctacaataggaaactatgaagtcacaacctctcagcattcaagcaccttacttaatacagtagacaaaaagcattcgaaagaaaattacagacaaggatcccatcttagcatttcacaatagactggctttggctacaagcaaactggttagtttaaagtaaaatagatgcatcaacctgacattagcgtggatacattgaaacaacgctcacctccaaagatggctagctggctagctcgatcgggtagccggtgggtggtgactgccgaggatgaggggaagggggtggccggcacatgctctccttacagttggttgacctcgaaagcaaacggcagcgcacaaggatagtcaagtggaggaggggggagacactgtccactcacccataaataactcgacgaagttaacctttaactatgtataacttgcctaaaatgataattattggaaccgggtggagtatgtctttgtttgatgagtatggtagtagtgcggtaaaataattataatgatgtagctaactagttttttttggctaatttgatttgcatgggtgcagttccaaaatctatccacgtattacctgcaagaatttgaatggttgcatcaaaattacaagccagcatttaaggagcgggttgctttgtcaaccctgtccagtactgttccactactctgtgtgactgctgcagttggccagggtgatgcagtaacgaaggaatcatttgaattgacaacagtacgttcaagtgccgttatagcttgtgcaaagattatgcgtttcatgaacgacattgctgcattcaaggtatagatgcagtaattcaattttactgttttggaaaaaaaattgagagtactaattccatgtacttccctaatttattgtatttaaatatgtaaggctgtgttcggaactacgattcctaacttctactctcttattttccatgctcaagtttcgtgaactgttgagttgtgctttttttattaaaaaatctataaaaagttgctttaaaaatcatattaattttttcaagtttttaataactaaaagttaattaattgcgcgctaataagtcccctgttttacgtacactgggagaagttcccaacatagtttatggaacacagcctaaatgtgtatgcagtctggaattggatgctgaatgtggtccagctacttaatcactttacattactaaattattagtggagagctgaaatgttatatgtatataactagctatttcctacagcatataatattgaaacaaaaattgtcaagaaaacctaattatatattgtaaaatagaggaagtaacatatatttttttcacactcatgcagtctggaagaaagaacaaaggagatgccgcaaacacagtagagtgctatatcaatgagcacaaggttacaagcgaagttgccttagacaagatcgaatcaatgattgaaagtgaatggagaaccctgaatcaggttcgttgtgatcatcaaaagcagttccatgtggtgcaacgagttatgaatttggccgtagcagtgccattcttttacgataagaagaaagatgcatatacattttcgaagtatcatcagggaaatgttgggaatctgtttgtgaatcctgtcaccctttagaactgagctatcaacaatgcagcaaactatgtgcttacacaatgcttatgtaattctatctccatcttaaaataagttcacttttgtacataaatctggacatggtctatatccagactcatgtatagaatgaaatttattttgtgatgcaggtagcaattcttatgcgtatactctatgtgtacgttggtaattagtaaataaagatggcaccgtccgaagtgcattgccatttatgttgttgggcaggtaattctctatgatgtttaatcatctctggtcccactgcagtcgctgcattgatattgtcacacccagaaattcaagtaatttccgaactaatttgtgcattaaaaccctcgtccagaaatcagccgatgtacacaaattgataattttatatatagattctttaaaataactaaagcgaaaaatactttcataagaggcacttagtcctcaccacgaagaaaactggagcggaaaacaaaatctatcgaagcttcaactttactcccacatgcagctcaactagaatctaagccaaagttcttctccttcttgatcatttttcttcaactgagatttggtgtttattacaaggtgagtacatggaatactccataagccagacaggaaatatgcaagtacacagggataccaaaagaatggcgtaatatagggcttatttgcgaaagcagcatttagcaaagagttgaaaatatgtaaaacagtagagaaatcaattaaacagtattaatccaacaatatacaacatacccgttgcataggtccaaccaaacctgaacaaccaaccctggtcgtacagatcaaacctccaaaccaggaattaaacattccaaaccaggagttaaattaattaccatcaattatcacattattaccattaatgagtagtgtgggattaatcaccaaaacattgttagacccacccataaccgcggacacgagtatataaatagttttactctggccagaggtgtaccacgatacccacaagacacagccccacaacatgtcaccatgcccttagtaccaccatggtacctcgaaacgggactgtgacagtaccctccgtataacgcaattcacagtagtgcacctttcctggatcataatcacccccttatggtatgctttctccagcgacccctatgggcttatctccgccacttcacagtccagtgccccacaatgaaccacactatacaaaaggtaaagtcgttgcccacgctggcttgtggttggtacggttaatgtttcacaacagtagctcgcgaaccggtccttaattgtcatgagcacgactatcaaaaccatgtactcacaacccaccattatcaggttttagttggtaattaattaaccaatcacgattagccattgttagctacctttaaataatcatcaatgatatataagtgaagcattagttatcccaaaagtgtgctaatgtttttcagcatagctaagcaatgatatttaatatctagctgaaccaatatataaagtccaagctagtcaaattataaaccataggaaaataaaataattttcggccataatacagggaaaaggctcacaccacccaatgacattcgaaataaatgcacattttaaataaatagagaatttaaatataggttcaacatgctcaaaggaattgtgtttgggatctgtgtgacttgcctcgcaaacaagcgtcttcaaatcgtcttcaggaactcctccaacgaactaacaatccttccaaatgactaaaaactgaacctagagcacaaaacgaggaaaaacactaacaaaaaccaaataaacattacagttacatcaatgattgggaaatgggtatgttgacggttcttaaatcataacatttgaccatcaatacctgcatataataaaataaaacatggtatccaacttaccggtgttgatgtaaaaacaccaggcctgagagatctgcttaactccagtgcatgtccaaaagcttgcctttaggttcgtgagcgtgccagttgatttgatcctgcaatcaacaagaaagaaagatagaaaccgcggttaaatccataaatgacaaccgatcggctaattgccgatgacatatcatttatctttgagccgatgtcatatatatattgatcggcggtcgtaaataaataataaagaattaaatctactcgatcggctgtagatattagcaatatataatccttatgtcgatatatactgaaatcaagtgattaggatagatcggtcgccatgccgagacagtataaatcacttagatcgaaatatatattaacaactggattatataagtttatagcatagccgatcagatagatctagcatgtatcggctaatactccgatatcactctatattaagatattaaagcaagtaaaatacgtcaaacagaagcctaacgtatctaattacaacaagatcttaatgtaaagggcggatttaacatgtcaatcaagcatataacacataaagtagttaaatcaggtaagatcggctgaaaccccgatgctaccctaatcggcaaccagaaagcaggctagggattaagattctaaacatgacttataaggtcaaactcaattgatgcaactataagtatgaaaagaagaataatatctagacaatcaagccgcttgatgtttcatagagtagtggatattctatataatctaagccaatgttgttacttaacctaatcggctgccttccagtgatagacgttagccgattgaaggttaaatagcaatattgtcagggattgtatagaatatatgatatctcgacgaattacataattaagattagagtatcatgaagatggaagcactaatccaaagaacgcaagccgccataacaagttttaactctagttgaagatcgaaaccgatgcagctcaactcgaaagcaagaactcgttgaaacaaaacgaaagtaaaagggtggcgatgcaccgagattgtattgaacgtgtgttgatttgattacatggggctcgggtctatttatactcgagaattacaagatatatccatgtcggacacgactattatctctaacaaactctaatataccataagtctttgcggcagatttttgcccacacttatctctaaagacattacataaaataccctaattaatagatacaattaccttcttaggactcaatctgtgtgtggcaatccacgtgaagtacatcaatgttgacggttgttatcgatcagttctgaccgtcaatattactaaaacaggagagaactagtgatgcttgcaatgcataaatatgttagaacaataatattccactagtattaggtctactaaccttttgcagagaatgacaataaagtggagaagaattgacatcaacatagacgataaattaatcggacgatgtcgagaaccagacttgtgtatagatgggccaagaacgcagacttgacacgatgaatcaggccaaaattcacaagtctacgaagtgaagcagcagaggaggccgcaacccgaaattgggtgtcacagcctgattttcgtttcaggatttataaatcatttaataaattattaatagaatttatattaaatgttcattaatttacaagtgaagttaaatgtgggaaataaaatttcctaaatataaagcatggatggatttaatttttattaaattctccatgattaattatactctctagaattttctcggatttttcagagctcaattcctaattttaataatacaaagaatatttcagtaattatttaattaataaattaatcatgaaatggtatggttttaatatttttaaatactttgagtgtccaagtatgttcaagatttttcttggaattatttgagcattgaaagtatttttaacaattgaaagatcatctcattggttaatttatttggaaaagtaataaaaatcctcctcctcagcttgggccgaattcagcccattctctcccttcctctcagcccagacaaagtctgatttacctccctcgcgctacagtactccatcttcctcttccagacagagccgagccagccgtgctcgtgcacagtgccgccgccccctcccaccaatccgtcctccccgttgctcctctttccaaattagttgcgggaatggaatcccctcaatctcctcttccttttccccaagaaatccccaaaattttctatggaaattctttccaatttcgcggatcaaatccttcctttttccggcgagaacctagactttcccgatttttttctcgtcgatttgggcctggacccgagctcccgtgcctatataaaggaccccctagtcgtcctctccctatcccttcaagttccgtccgccgccgtcgccggaaacgctctccccgtgctctccttctctctccaagcgccggcgccgctccaaccgtccctagccgccgcctcatctgcctgcttcctgcgccgccacctccatcggctccgcaaggtcgagctccaccccggccgccgttccccttgtgccgaaacctcgccggaggcagtcctcgccatgaaccagtgggttgccgtcatgttccgatctccagccgcagctagcagccgccttagctgccgcttttggtcgccgctgccgccgttgggttcgcaagaaggagagggagcccggcagccatctccccgaagccgaaatccaccggagctccatcgtcgccgtcaacccgaagctcgccgtcgcgttttgatctccggcgaagccctgctgctcctcccgtcatcgccaaggttcgccgctgcctgcattggattcgcggctgcgaagtgaagcccggccacccctccgttgtcgccgcacatcgccggaaagtcgtcgcctccgtggacagtacctcgccgcccttcgaagctcgtcgccggccatcttccgttgccgttcgtcgtcgcgtaagtggtggtaagggtcactttgatcccctctcgctcccggtgccctccgtttgcgttactgtgccgtggttcgccggcaaccgccgctcccatgccgttcacctgtgagtttttccctagggtcttaattcaatctaatccgttgtctatctagcattgccgtcatctccatgtgttgccgccggttcaccgtcgtcatctatctctctccgaccgctttggttcggtgagacttctatccgtgacccctcgggttaggtttcaatccctcggtcatgtcgccgctgttgctctaaccctaacgcagccgctgccgcgtcacttgccggctgccctgtgcatcgtcgctaccggttgtgccgttgttgcttgtcgccgccgttgtgctagccgcctagccaaaccaagttgccctagtgccaccgtgtcgcagctgtgtgccgctttaacctagccgccgctttagctgttgctcggtagccaagttgtctagccgtaggtgcatccctaggttcctaccagcctatcatttgcagtaccggggctttaccgtgaatcgttcctagtccaccggtttagccgtagccgtggttgagtcgttcgctcgttcgttcgaacgaggtgttccctgtgtttcgttcgttcgcccgtgttgagttgtccattagtttagagccgttcagagccgccagtttcgttcgccggtttcggttgaacatttgggtgatcccgtgtcacgtagaattgattcgttgagtcgatatctcgtgaggctcgcttgccagatcaatctaagccatccgatcttggtcaactctcggtcaagattaatcttagccgtccaaaattgatataaatccgttctctcttttcagtggcatattatttatttttaatatatgtcatctaccaaatataatctaatcttttccggaggttgttttaatcttttatctcagttataaatcatttgtaaattgtttaattaatttggaatagtcttttcttcaataggtttaattggaatttaatcttgtaaaatttgtaattaattcatatgaaatcggaatgaggtcgttcaagtctctaaattcatctaaaatcatgacacatgtttgtttacttttatgtactgtttatttggtttttattagtctttttcctcgttttgcatgttagcttgtcgtttccgttatttcgatggttcgcgtgtgcgtcggaagtattcaagaagattaattgaagaccgattattgcaaggcaagtcacacagatcccaaacacaattcctttgagcatgttgatcttatatttaaattctctatttattttaactgtgcatttatttttgaatgtcaccgggtggtgtgaacttattcctttgttatggccaatttgcattgattaccctatttcttgattacctcggggttataatttgactagttggatttatatattagttcagctagatgttagacataattgcttagccatgcttagaaacattagcacactattgggataactaatgcttcactattacttaatgatggatatttaattgtagctcacgatggtcaatcgtgattgtgaattaattaatgtgccaactaaaacttgataatggtgggttgtgagcacatggttttgatggtcgtgttcatgacaattaaggaccggttcacgagtttcggttgtgaaacattaaccgtgccaaccacaagccagcataggcaacggctttaccttttgtatagcatggttcattgtggagcaccagactgagaagtggcagagttaagcccacgggggtcgctggggagtccatgccttgtttataagggggtgattatgatccaggaacagtgcgctgtggtggattgtgttgtgcgatgagtactgttacagctcctttccgtggtaccgtggtggtattgaggcgcatggtgacatgttgtagggctgtgtcttgtgggtacagtggtacacctctggccagagtaaaactattcgaatagccgtgcccgcggttatgggcgggtctaacaatgtctttcgtgattagtcccacactactcattaataataatgtgataattgatggtaattaatttagctcctggtttggaatggtacattcctggtttggagatagatctgtgcagccgggtatggttgttcaggatggttgggcctgatcagcatgggtgtgctgttcagtgttgattaatattgatgattaattactctactgttttgcaattcttaaatgtttgctaaatactgcttttgcaaatgagccctatattatgccatcctttggtatcctatgcacttgcatatttgctgtgtagcttgctgagtatgtcatatgctcaccttgcaataatcaatcaaacctcagttgaagacaagttgcgaaggagaagacgtttggcatataccccagttgagctgcctgtgggagtggagccggagcttcgctagattttatttttcgctgcagttttcttcatggtgaggactaagggcctattaagtaagtatttatcgttttagttaatttgatgaatcagtatattaaattgtcagtttgtgtacctcggctgattcctggacgaggattttatgcacaaataagttcggaaattactagtgaatttctgggcgtgacataacctcatcccttcattccagcataatctaaagaactcacaaccccaatgaggatcaaaaccatcatcgtattcttcataatgcttctcctgctgcttgtcatatttcctttgatatttgttgataatcttagccgaatttacttgaaaaccctttgcacggaccctatcggctatttgaccagccgtatgcaccatattaacaggaaaaggattatcatcgactttcatcggctttttggaatcatcaaacctaatctttcccccctcaatggcaacctgaatttgctgtctaaaaaccttgcaatcattagtggaatgagatccagaattatgccatttgcaatatctctttttgcctaattcctcagccgatgggattatatggccagcaggaagttgaatttgcttctctcggagtagtagatcaaagatcttgtcagctttggtaatattgaagtcatacttcttctcttttctaggactttttacccattggcatgatatgacctttttactcctcacccattcggctgcagctatttcagaatcgtctttctcatcatccgacccatacatgtatggacaaacatgattaaccttcttagagcttttcctgacttctgcctacctatactcatgcaagggtaccttctgtatcagatgtgataagctatcaaagtcttcagacgagaatttctccctgattggagcaatcataccttggaaggccaaatcggctaactgagcatcagttaaactcaagctaaagcatttgttcctcatctccctaaacctttgaatatactcgtgcacgggttcatcataccgctgcttaatcgctgtcaagtcagataacttcatctcatgaatcccaatgtaaaagtagctatggaattgcttctccaaatcggcccaactattgatcgacccatatggcaaagaggaaaaccaaaagacgatccagataaagataacctgaataacctaacctttagagcgtctacagccgatgcttcaccgcactgagctaggaatcggctaatatgctcataagtcgacacaccatcctgtcccgaaaatttggagaagtccagaactttaaatcgattgggaagaggaactctctcaaaccactcagggtagggctgccgatacaagctcctagtctcttttggtttgaggccgaactgttccctcattacgtcggaaatcacgtcggcccacggtcgttgctgaactgctccttgaggctgctgttgcataggctcgaactgactgtactgagaagcaaactgaggttgggttgtcctccctggctaatattgggcttgtggagatggaggctgatactgataatttaagttgctccgatactactttatattaagatattaaagcaagtaaaatactcaagcagaagcctaatatacttagatgcgaccagatcttgatataaagggtagatttaacatgtcaatgaagcatatagagaaaatatagttaaatcaaataagatcggctgaaactctgatgctaccctaatcggcaacaagaaggcaggctagagattgatattctaaacacgactgaatagatcaaactcaactgatgcagcattaagtatgaaaagaagaacaatatctagacaatcaagccgctggaagtttcatagagtggtggatatctcatataatctaaaccaacatcgatatttaacctaatcggctgccctctattagcagatgttagcggattgtaggttagatgacgatattgttagagattatataagatatatgataactcgacgaattacataaaaaagattagagcatcataaagatggaagcactaatcccaagaatataagccgtcataacaagttttaccttttgttgaagatcgaaaccgatgcagctcaacccgaaagcaagaactcgtcgaaacaaaactaaagcaaaagggtggcaatgcgccgaaattgtattgaacgtgtgtgttaaaagttacatagggctcggggtctatttatacccgagaattacaagatatgcccatactagacatgactattatctctaacaaactctaagataccataagtctttgcggcagacttttgcccacatttatctataaggaatttacataaaatatcctaattaatagatacaattgccttcccaggactctatccgtttgtgacaatcatcttgaagcacattaacttgaacccgatgtcgtacacaagtcgtattgtcggaatcggctgaatcacttaacctagtctgaccaagacttagccgatcttaatcgtagctgatccggactccagccgattcttactctgtttccacgacaatccttatctttgattccgcttcgatcccatcttcctctccgatgctgatattaccaaatttggttgttaacactatttagctctcaacttccttgaaattgttcttgcaggtgttagccgatctattctcttttgacatcaaggactacttcgatgagacaaaagaagataccacaagcaaagccttagcccccttatccgatgatgtgaagagaactcttgatgatatctctcatcggatggaagcatcatcactagacagtttggtggtagactgtgggcctatcaggactcggcttcatgaggttcaagctctgatcccagatgagctagccgatgtccttactccagctgtctatcttaagcaacaacaattcaagctggagaaggccaagctgagactagccgagcgtcgggagcgcaaagacatcgaggccacaatccaggctaatcggcagcttgttcatgaagaaaaggccaagcttgatcagttatctgagggcccgatcaaatccaatattgatcgacttgaagctcgcaagattgaactcttggcacaacttcaagaatgcaacaccgagctggacatggaacataaaaagctagccgatctcccacaagctgtcgaagaacagaaggcaagactaaaatcggctatcaagaatgtcgcggatatgaccaagtccctaaaagtcatccctggaaccgatgctcaagatgcccaagccatcgaagaagtagaacaaattaggcaaagagctatatcggctatccaacgatacttgtctcagtgacattctgtaataaggcttagcacattttgtaatcggctaagatgattctgtaactagtcttgacaaaccttgtgccgattaatataactccatgctttttgcttaaaaattttccaaatttgcaacttgtgaatatatgtgccccctacttttgcaatgacaaaggcattgataaaattaaaaaattgaactaagagcgatataccaatatcggccattgtacatcggcaaaatacaaccgattacagtttaaaaacaactaagggcgatataataatatcggccatctcaaggcgatgcgaatacatgagacgatggattacactagctgtgatggcgaggttagttgttaggtattcttgaattatgaatagaagaagcgccgtccttgtttttgagtatattgtcctttgtccttgcatcatatatgggtgttcgcttagatgatgcaagcatgtcggctagaccgcccgtctatttgtcttcagaatcccaacttatcattgtattgaattttgtaattcagattgtttttgtccgtccttgaatccagagcgcagccaccatcacccggagcgtggtaatttggcacaccgccacccgcgctcagcggcgcgccagcgccccgtagcagcgggcgacagctaggggcatcgagcagcgggcgacgggccgacggctagggtggctaggggcgacggctgggggcaccggttggggcagctacgggcgacagctagggcggctgcaggcgatggctaggggcgccggcggtgggctgcgtcagggcggcgaccgacatcgaggcggcgactggcgacttggcgagatggcgattttttttcgatctggatgcggtgcggcgcaatgaggggagacggagggggaagagaacggcgatttagagttaagggagaaaatcacgtcaaacttttttttggccgaaatatttgaccggacctcacttacaatcggaacccaccgaaatgtccaaaatttccaaaatttacaacccagtggtggggaacttggcgaatgagaaggctggcccaaatgccgaccccaacgattctgagacctgcaggacaatccaacagctcaaaaataaacgatgtgtaagttttgtagtaaataattgctgtagtgggtcgatatattctttttatggaaacgcatgcacagtagaggaaaagtattttctgagttcacgcgtcccaagccagatatccaatcaaggctttcatcgctagtcatctatatcagtcagtcaacattggcagatatccaactccgcgtccgtccagctctgcttcctacacaacccccttcaggactctctccccgtcagtcaaaacatggctgccctgctgcagctggccatgtccgtggccgctgttccccacctcccggaggaggagaccacgccaagcgtggacgtggaaatcgcctccccagatcagcagcatctagctgctgctgctgcaccgtcgatggccgtatttcctccggcggccgacgaggaggaggaggaggaggcggtggcggtgttgctgtccggtgagttcttcacgtgctggtcttcgctgtcggagtcgacggatgatgagacgacgaggaggacgaccaccgagtccatgttctacatcccgacgaacgggagtaatgatgttgggaggaggaggaggaaggtccggtcctggagtcgggggagcttcctgggacgtggatcctttgggatggtgttcgaggggatcaccaagtaagtaacaagtcctactcatctaattagaagtaactttggatccatcatttctattccctccatttcatctgtttactttctgctatgatgctaccatctatttctactgccatcttagttgacagtagtagaaacgtaaagagatgtaactgtcaaaaaaaaaaaaaaaaggcattgagaggtaaaatcgtcatttagcatgaactaaatctagcagttataaagctaagtgaaatgctcttcctctcaattactgtcctggggatcagtttataatttaacctcgttattaaatatcattcctcggtatcattaacgtgtttggattttctataatgtttttttcttgtttggtttcaatggtgatttcggggctaattttctaacagatactccgtggagcgagatgctcagatctgagcgagcgatttttttcatagctttttaccattcataaggatataccaccaattgctagctaccaagaggtaaaaaaaaaatctaacagttgattaggcaaggcataggtacgatggggctaacatttttcctgttccatctcagcgccacgattcgccactgactccactcagtggcaccacctactcacctagtgcctcgctgtaattccccatcatccctccccttttcgtgagcgcatacataaattcgtcttcccaatggatcgatcagagtctgcagtgtcctgaattcgttattggtgccgctagaagcttgtttcgttggatatggaatacataactattggggagcaagaagagcatgccgatgttgggcattgacatcgtccaactccagcatcggtggcgtccacgctgtcacggaggcgatgacctggggatttcaatgggtatcggcgtcaatggtggccgtccggatccgcgtctcggaatctatccatagcggggcttttgatttcaccgagcacgtgaacgatttaggcagctaccggtagggcatcagcaccaaatgcagtgacaagctagtattaggccagatttgaggcgtcctaactaattttcgatttacagcggtgtcgatgtgtgcctaatcccgccacggataaaccgatagaagccagagtgtatatgtgaaagtgtagttttaccctacaactaacacacgaaggcacgagacatttgcttagctctcgtacagttatactgcaggtcctatcaatcggatttagagtgtgccacttagttatcatgtaactaacgaaaatacatagaacagtgaattaatcaaataacttaaataatcaaataccgatagagttagggtcattggctacttgaccaatggaatagtgaattaatcaaataacgtaactaaaatgcatagccatcgactggtacggaaactgaacataaccaatcatgaataactctttatttaaaacaaccttgatagttgggaccaaaccatttttttttggaaggcactgtaggggaagcccccacagttaaatagctttattatagaaaataaattacaaaagatataaccaattcaaaagggactatctctcagaaacatttagtctaaaaactaaaagggaaagatcactcttaaagagagctttccaagaagaaattgagggtgctaaattctagaaaatcagggagttcctctgtttccaaatattccaggctgcataaaagaattttcaccataaagtgcgtagacttataagaattcattgtctgatgcagcatatctatgaaggcaagagaaatatcccagacaattccaaactatgtccagcaatcagcactaaaaggacattaaaaaaatagatgaaaggtggtttctcttgcacaggtggagcaaaggacacaagttagatccgaattattgggagggcaatgccttctgttaagcatgtcataagtattgagtcgatcaattaacaggagccatccaaaaactttaaccttcatagcacacttactcttccagatccaagctagataactaggcgcatgtatatgcatgaaattaatgtcatatattttcttggaagagaacaaaccatttccccaaacataagaccagacatcattctcatcagataattgatctaaaggatcagctgcagacattgtatcatactcatggaaggcttgctcagacagagggagattaaaacgctgcgaaatactcttggaagaggttaaactcactgaatccttcaaagaaacagcataagagtgaatccttgggtacattactgacctgactttattattccagaaatcatcccaaaacagacaagtctttccatccccaaccttacaggtggacaatcccctaaaaatgtctgcaaattgtagaacatctttccaccaaaaagaccctctagggcgatcagcatgaggaactttattaatataataagtggaccagatcaagctaacccaaggtattgagagcctattataaaatttgtgcatatttttcattaaaagagcattattatgcagcctcaggttaatgactcctagacctcctctacttttaggttgacaaaccctttcccaaagaaccaaagatttcctgctagaattaatatcagttcctctccataaacaatttcttctagctctatcaatgttttcaattattgactttggaagggaaagagagcacatatagtaagttgggagggaagataaaactgaattgaccatagttaatctatctccataagacagaagagcagaagtagcagacaatcttctctcaaccctatcaactaagggggcaaaatcaattatctttggcctagttgttcccaaaggcagacctaaataggtgaagggtaaagtgcccactgagcaaccaaacatcttggacaaatgctgcaccttttctatatccacattcagaggaatcatccatgacttactgtagttaatcttcaaaccggtagaatctgcataagagttgagaataaccttcaaacagaaaagctcttttgaggaagctgtcaagaaaaggagagtatcgtctgcatactgtacaactggaaagccattatcaggagttgggattggaatagtcaaaacaccctgagaataagctttgttgacaacagactgtagtaaatcagcacctagcacaaataaaagaggtgataatggatccccttgccttacaccccttttgcaataaaaattccttccaagaaccccatttagaagaactgaagaagatgctgaagaaaagatcaaatcaatccaattcaaccactttgaatcaaaacctttttgtctcatgatgtccaaaatagtagagtgctctatagtataaaaagctttctcaaagtccaacttcaacagcactatctccctttttgattgttggcacttgtgtaagtactcaaaagaccaagagagacaatcctgtattgtcctggctttgatgaaaccatattggttttgatggatgagttctgtaattacagactgaagcctatcagcaagaacctttgttaaaagcttgagagccacactttggagagaaatcggtctgtattcattaaccctctcaggtgttgattttttgggaacaagagtaatgaaagatctatttaaactttccaaagctaagttaccttcacaaaactgggaccaaaccattgaaactaacaaaggatgacttagaccctgtttgattcaacttaggattattataatctggattattaggagtaagctgaaacaaacaaatagattatcatgctagattatcataatctataagccagattagtataatctaataatctcctctgaatgagctttttccagattattgagtggctaaagacccactacccttaatgcctctaataatccagagaaacaaacaactcgcagcttattctatgtcagcttattataattcagcttagagtaatctgatttaataatctagattacaataatcttaagctgaaacaaacagggcctagttactgattttaccgatgtgaacataagacggtgccatacttttcaagactataaaaaatgactcattggctagaattaaactccgatgaaacgttgtataaaacatatcggctttcaagaattaaacatatctagccgatagatcggtcctaaatgtgtcagggttacgggttaggtataccctttaccctttgacgtacgtcgcataccgatgtagtatacccacacgtagacggatactctccgcgtatattaaggaaacccctcacggagtttacaaatggaaagagtcctactcggacaagactgggtcatcaatgtatcgggtaaggtttgatgtttccgagttctacttggaaaccgcctaacctgtgatataaaagggaccccccgggaggacctaaggcattgaatctcagagccaacacaacccacacagcctacgaagtcggagcctgcaaggagccaaatcgccagggatcgtagtcgagccaactcgaccacgatctcgccggattcgtcaagttccactgttccctttgtaacctgtgttttccatcatataatcccacatcaactggattagggctattacctataaaggggcctgaaccagtataatctttgtcttttgtctgcttgatgtcgtattacgtagatccttgtaccaacgtaccccaataccctctatatccggtttacgggtatcacccgtcgacagtggcatgccaggtaggggcacttggtactcaaggttctactactatgtcatccagcctcgtcaacaacagcgtcaacaccaacctcagccaagtattccctgcttcaacgatgctagtgtggactcaagtcggcgaaatcgtcttcccggtttacaccacaatgccgatctcaacctgtccactaatgactggaaacgagaacgcagtggctacaaaccgagacgactccatgtcgaaagatactcccaccgaggcgaagaacggaatatcgacgacatccgagctcgagaaggattctaatgcggccaaaccttgtcgttccgacatgaaccgcgagccgacgaagatgacttccgaagcaacaaggtcctggtgtcctatccacaaaaccagcaaacacactttgcaaacctgctgggttttcctcaacgtccgcgctgaaattcgtatctgcaaagagcgtggaattcagcgtatttctccaactcgtgatgtctattgtcctattcacaagacaaagaatcacgacctctcaagctgcaaggtccttctcagcgccatgaaagcgccacctcctaaggtccaacagtcacacatccccatcagggataaagacaaggaacgaggagcgacgccaacttcagatcgatttgttggggtaatcgatatcgatcctcacgaaccatcagtcttgcaccttctcgaagactatggatcatcgacaacgagcgcactgcgggaggtattggctatcgatgatgtcggcacatcagcgcgcaccaatgcagaagcagagaatcaattggccaccccggcccagcacatcagagccgtcaacgctatactgagggaaaccccctacgatcctgttctgaacgacgatctcgctcgttggacagcacgactacgggaatcagtgactaacctcagcaacacgttcgaagaggccgccgccgcagcgcacccggagcagccaccaactggcgatgccaatggtgaagagcctgaatggagggaatcgcctcattgagccacccctccaccttgcggcactagcgatctccgagatcacgtcaacggccgccgagaggcacgacgcacacgagacaatgaaaatcgttcccggcgtcatgtctcttcacggcgccataatgacgaagatcgaggagaccgctcaaacgaagaccgaggccgtgataaccgccacaaccgccacgatcacaacgatcgcgaacggcgggtgccagacgatactggttgaggacgtcgccataacgacgacgatgatggagactggcgccgggacaacagcgggagacgacgacaggattctcgagatccaggccgacatcctcgtgatcgtacgccggaaccaagcgacccatcgtcatcgtcatcatcctcggcttcctcatcatcagacagacatccacgaaggacacacaatcgccggcaacccaccgccccagcgctgggtgtagggctttcagtcgttccctgcgtgatgtctgatggcctgagagattccgacccggagcaatagaaaagtacgatgggagcaccgactcagaagagttccttcaagtctacttcacagtactctacgctgccggagcagacgacaacgcattggcgaattatttgccaactgcgttaaaaggctctgcacgttcatggctgatgcatcttctgccctactcaatctcttcgtgggcagacctgtggcaacagttcgtcgccaacttccaaggaacctacaagcgccacgcgatcgaagacgacctacacgcgttgacacagaactcgggtgaatccttgagggaatatgttcggcgcttcaacgagtgcagaaatacaatccccgaaatcaccgacgcttctgtaattcacgccttcaaatccggtgtcagagattgctatactacctaggagttggcgacaagacgcatcacaaccactcgatgattgttcgagattgttgagcgatgcgcccacgcagatgatgcgctaagatgcaagaatgataagccgaagaccgggggagagaagaaaccagccacggacgcacctgagtcaagcaagaagaaaaatcgcaaaactgggaaaaggaaatctcaagcggaagtcctcgcagcagaatacgcgaaccctcccaagcgcccagacccacaaagtggtgacacaaagaaagcatggtgccccatacacaagacggacagacactgtctggaagattgccttgttttcaaaaaaatcgctcgagaagcacattgcatctgaaaaaggcaaacgagtatgcgtggtcgaaaaggatgcggaggcggctccccaggaatcggatttagcatatccagactctgacctccacgttttacacatcttcggaggttccacaacgtactcctctaagcgagagtacaagaaagtggaacgcgaagtctgtttgtcatgaccggaaataacccaacgggcgttccttatgtgcgtgtattattccttgtcccaggaggcaaggtacaccaaaagttgatatatttcaaagtttatcaagcggaagcgtaaatagttaatttattacatgggcggcgaaggcctagcacacaggaagacaaataaaaaacagcggaagactagggcgacgaccacaggcgcttgacagcaggcacgagctagacaccaaagccttcatcttctaggaactcctcttctgggtttggaaaaaattgagcaagactgagtacaaccaccgtactcaacaagacacacccacaagtgcagaataaatgcaagggagtacaagggagttataatataaggggttagggtttgcagtaaacagcattaaaagacacttagttgctcaaagctattttgtaaatacgatcctagagctatacaagattattaatcaaggccgtgaacccacacgaacctgccttaacccaaggcctacgatgatttagaccgaattggcaacctgaccctaggtcccagctcgtcccaagccaacccaggccaaccattccacattttagttgttaagcagattttaagaattaaaacactaacttgggtacattgctcggcttgctcaaaaccgagggcgcggctattcgaataggttatactctgatcagaggtgtacatctttacccacaagacacatcttcctcacgtgtaaccacatgccacataccaccacggtatatggacggaagacgtgacatagtttccaacccatcctagccatagacaagagtaccaacccaaccccacctacggccggaacctctgggacaggtaggcaggactgagcccctagcagcaggacaccagccctgtgccatgacatctcgactaccgagccgcagctcgtgtagccttcatttgccctagagatgtccatcgacccccgacttcgtccatctccatctgtgtacttttgtttataaccagactgagcctcaaactaagccttacccactagacatgtggaagtacggtagtgctttgcaatagaggcccgaagaccggtccttatgtggccgaggtgctactatcaaaaccatgcaccccgagcccagcctaaaaccattttgaggattttgaatagagggggaggtgtgaatccaattccaccataatccaaccattccatagtgtccaggtgatatgaatattcccaaagtctagagttgtaaaaccacctaatgttgcctaattaaccaacgaagcatctacctaaattcatactagtggtgccatgaatagagtatacactagttggggttttatttattctagggtgaacaaggtaataataacaatagcaataataaggtcataacaaaggtaaataggcatggctaaataaaacagtgataacgcgggaatttaaataaagcgataatgcattaatttaaatcaaaataattttataaactgggattcaatatattcaaggatgatgtgacttgccttgctggctttcccaaacgtcggcttcaacctccacgtagagcggatctttcgaagctgcagcgtctacacgaccaacggaaaagaaaagggcttttacgctaataaactccacataacaagcaggaataaagcacaaaaatgggttcttgatttcttaaggaaaaattagagacttgaatggtccaattccgagttcaaatggtcaagttatggccatttgaagtttaaatgctctttaaatgaatatttacgaatttcttcatttaaattttaatttaaaagggatttattgcgtcagccgagggggaggggcgcgcggaccgggtccacgggagtggggcccacgcggcagcctcacggtccacggtggaccgggcgcacccgggctcacaccggccggcgccgtgggccccacgcgtcagccgcacctgagggcgcggtcggtgagaggtggcgcacccgcgcccctatggtcgccgatggtggccatggcacggcggagaggcggccgagagaggggaagggaagggggaaacgaggcggcggtccgcggctcaccccgaggcaacggcggctacggaggaggcggccggagcggagggaggcggtggcgcggctcgggtcgacggggacggcggcgctccggcggtcggcgaccgaaacggagaggtggacgaggtcggcaaggatgcggcgaagccgaaggaggcggcgccgaggtgggaggcggtccggggcgacgacggcggagagagagagcgacgtcgcgagctcgaatccagcgaggaggaagggtggcgagaggcggaaacggacggtagaagcgcggggagggtttaaatagggccggggcgagagagggcggccggaggggaaggaaaccagcgcggcgttctcgggctccatcaatggcgccggcaggattaggggaggggttttcaaacttatccaagggagagagggagggaaaattggggggaaagggagagggaatcgggggaaacatttccccccactttaatgcacgcagggacggcgggatgcggcggatttggcggcggtggcggcgcttggcgcgggcggggcggcgggagcggcgggaggacggggatgacgggtgggccccacccgtcagcgagggtggtgggcgggcccgcacgtcagcggcgcgcgcgcggggagactctggatgggccgcggggagagaagggagagagggagggaaatgggccgaaccggcccaagagagggaggggactttttttagggtttttctttttataaaacctttttaactttgtttatttcttaacaattattatttgtgctctgaaaattccactaaaatttatttacacattttagccttttaggaaatatacaaaaatcctctaagccttatttggtcttttactttgcacatttttatttttggaggctttcacacggattttaattattctaggcataatttaaaggatatattttagggtctttttgggacgcgacaaacctacccccttaaacggaatctcgaccccgagattcagaagaactggcgaagagatcgggatgggctgccttcagctcgtcttcacgctcccaagtagcttcttcctcggcgtggttgctccattggaccttgtaaaaacggattacccgattcctggtcctgcgctccatggtgtccaggattttcacaggtctctctacgtaggtcaagtcttcgcgaacttcaatctgctctgagtcggcctgctcggacggcactcgaagacatttcttgagttgcgacaaatggaacacatcatgcacgttgcccaaggaggcgggcagctccaactggtaagcaacttctccgcgtcgagcaatgatgcggaaaggacccacgaaccgaggtgcaagcttccctttcgtctggaacctgtgtacacctcgcaatggcgtgacccgaaggtacacaaaattgtccactgcgaattctaggttgcggcgtcggttgtctgcataacttttctgccgagactgtgccacctttagattctcctgaatggttctgactttaacttcagcttctctcaggatatcggtcccgaacacttggctttccccaacttggtcccacaatagcggtgtctggcatttgcggccatacaacgcttcatagggtgccatttgtatgctggcttggtagctgttattgtaggagaactcggcataggggagactcttatcccaggtcttcccaaaatttaggacacatgcgcgaagtatatcttcgaggatctggttcagacgctcggtctgcccatctgtctgtgggtgatacgcggtgctgaaatttaatcgggtacccaactcttcttggagtttcttccagaaatgagaggtgaactggcttccccgatcagatacaatttacttaggaacgccatggagactcacgatcctagcgaagtaaagttcggctagtttgttccctccataggtggtcttcacaggaataaaccgagctaccttggttagtcggtccacgactacccatatagaatcatatccgccttgggtttttggaagtccggtgatgaaatccatcccaatttcatcccatttccattctggtacttggagaggttggagaagtctggccggtcgttggtgctctgccttgacatgctggcacacatcacaaagggccacgaactctgcaatttcccgcttcatactaatccaccaatatttctctttcaagtccaagtatatcttcgtgctgccaggatggatggaataggagctttcgtgagcttcctgaagtatcaactgtttaagttcccagtcgtctggaacgcataccctatttccgttccatagggttccgtgttcatcctctgtgaaaccagcggctttaccctgtttcatattcttgaggagtccatacatatccggatcattcttctgagcctcgcggatttgatcgagcaaggtaggcttggcttccagcgtagccaagaatccacgaccaactatgcttaggttcagggcttccatctgttgattaagttccggtggaatgccacggacgccaagagtgttgcaatggctttttcgacttagagggtcggcgaccacgttggccttgccaggatgatagtgaattctcacatcataatccttgatgagttctaaccatcttctctgccgaagattcagatccgactgagtgaagatgtatttcaaactcttatgatcggtatatatttcacagcgattcccaatgagatagtgccgccagatctttagagcatgaaccacagcggctaactccaaatcatgggtaggttagttgccttcatggggccgtagctagcgtgaggcataggctaccacatgaccttcctgcatgagcacgcgccccaatccttggcgcgaagcgtcacagtacaccaggaagtccttgcgagtatccggtaagattaaaactggcgaggaaaccagcttctctttgagagtttggaacgccttctcgcattgcgggctccacacaaatttttcttctttcttcaacaactgtgtcatgggttgagcgattttggagaagttctcgatgaacctccggtagtatcctgccaaacccaaaaagctgcgaacctgagtaactgtcttgggttgcttccaatcagtgacggcggtcactgttttgggatccacagcaactcctttagcagatatcacgtgccctaagaatttgacttcagacaaacagaactcacactttctaagcttggcatacaattgatgttcccgcagctttcccaacactagacggagatgctgctgatggtcttcctctgattgtgagtacaccagaatgtcgtcgatgaagaccacaacaaacttatccaagtattccatgaacactttgttcattaagttcatgaagaaggcaggagcattggtcagaccgaacgacatcaccgtgaattcatacagtccataacgcgtggtgaatgcggtcttcgggatatcttcttcacggatacgcaattggtgatatccggagcgaagatcgattttagaaaagacagtggcacctttaagctgatcgaacagatcatcgatccggggaagagggtacttgtttttgatagtgacttcattgagggctctgtagtcaacacacatcctctttgtcttgtccttcttttccacaaaaatcacgggagcaccctggggggaagtgctcggccgtatgtaccccttttccttcagctcttccaactgcttcttgacttcggccagttcattcgcggccatatggtagggccgcttttacataggagttgttcctggagcaaaatctatccggaactcgatctcccgcttgggcggcataccgggtagttcttccggaaatacgtcaccgaattcactgacgatggggatttttgacagtcctatctgatgaagttctgaactgccgacagaggttgggggtgcaaagaaaacagagcagatcacctttgatgtcgctgaattcgatacagcttacaacgccatcatcgggagaactgcacttgcgaagtttatggccgcatctcactacgcgtatcaagtgctcaagatgtcgggaccgaagggaacaatcactattcaagggaacacaaagctggcggtgcaatgcgacaaacggagcctcgacatggtcgagcaaacgcccagcccacccgacacgactgagccacccaagaaagtgagcaagacaaacaagacgctgaaaccggacggcgcaatcaagatcgttccgctctacagtgccaaccacgacaagaccgttaagatcggggcgatactaagcgagaaattggaactcgcgctcatcaccttccttcgcgataatgctgacgtgttcgcttggcagccgtccgacatgccaggggtccctagggaggtgattgagtaaaaactgatggtgcgacccgatgccaagccagtaaagcaaagactacggagatttgcaccagaccgaaaacaagccatacgagaagagcttgacaaacttctcaaagctagcttcatcagagaagtacttcatccagagtggctagccaatccagtcatggtgcggaaggccaacggaaaatggagaatgttcgtcgacttcaccgacctcaaacaaggcgtgccccaaggatcacttccctcttgctcgaatagatcaactagtggactcaacagccggctgtgagctgttgagctttctcgatgcttactctggctaccaccaaatcagcatggcaaaagaggacgaagagaagacaacatttatcacgccgtttggggtattttgctatgttaagatgccgttcgaactgataaccgcagggaataccttccagcgcacggtccagggcgcacttagcgatcagctcggcaacaatgtcgaggcatacgtcgacgacatcgttgtcaaaatcaagacatgcgactcattgattgacgatctgcgggaaacgttcgacaacctccgacgatatcaccttatgctcaatcgagagaagtgcacgttcgaagtaccgtcgggcaagctgctcggtttccttgtctctggcagaggaatagaagcaaatcccgagaagatcaaggcaatcgagaacatgaagtcacccacaagactcaaggaagtacagaagctaatcggatgcatggcagcattgagcagattcgtcgctaggatgggagaacgagggcaacctttcttagctctgctaaagaagcaagacaaatttgtatggacacaggaagccgaagaggcattcgttgcactcaagcgctacctatcaaacccccctgtacttgttgccccccaacctaatgaagaattattcctctatattgccgccacgccatattccgttagcaccatcatcgttgtcgagagagagaaagtacaacgaccagtctattacgtcagcgaagctctccatgacgcaaagacaagatatccacaaatccaaaagctgctttacgcggtcatcatgacatcaaggaagctacgccactactttcaagcccacagagtcacagttgtctcctccttccctctcggtgaagtcgtgagaaacaaagacgttgtcggccgcattgcgaaatggatagtcgagctgagccagtttgatgtccactttgcgccacgaacagccatcaaatcccaggtactcgccgacttcgtagctgattggactatgcctgataacaaatcagacaaccaactcgacaacgaaacgtggacaatggcgttcgatggtgcactcaacagctaaggagcaggggcaggatttatcttgacgtctccctccagagatcaattcaagcacgtaatccacctcaacttcagggtgaccaataacacagccgaatacgagggactactcgccaggataagagctgcagccacacttggggtcaagcgactaatcgtgaaaggggcctccgagctagtcgcgaaccaagtgcacaaagattataaatgctctaaccccgagttatccaagtatctcgtagaagtcaggaagctagagaaaaggttcgatgggatagaagtccgacacgtctaccgcaaagacaacatcgagctagatgacctagcacgacgtgcgtccagacaagaaccgctcgagcccggcacttttctggacatcctgacgaagccatcagtaaaagaggttagtggcgaagttagtccggtcaccctcgatattagctcgaaggccacaaaggcagaacgcgccgttgccgacatcgagaccacagacgactggcgcttcccactgatcaaattcatcaacagcgaggagttgcccgaggacgatacagaggccgagaaaataacccgtaaagcaaagatctactgtatggtcggcaacaatctatacaagaaagcgccaaacagggtacttctcaaaagcatctcgtccgacaacggcagacacctcctccttgatatacatgaaggcatttatgggtcacacgccgccggttggacattggtcgggaaagcttttcgacaagggtttttttggccaaccacccttaaatatgcatgcgacatggtccagcgatgtgaagcctgtcaattccacagtaaacacacaaggctatccgcgcaagcgctccagactatccctcttacttggccgttctcgtgctgggggctagatatactcgggccattcccacgaggacagggcggctataggttccaattcgtggcgatcgacaaattcactaaatggatcgaagcagtacccatgggggaaatcaaggctgtcaacgccatcaaattcatcaaggggatattttgcagatacggactacctcaccgcatcataaccgacaacggctcccagttcatcagcgctgatttccaggattactgcatcgggctgggagtcaagatatgcttcgcctcggtctctcaccctcaaagtaacggacaagtcgagagggcaaacggcatagtactacaagggatcaaaacccgcgtctacgacaggctcatgtcacatgacaaaaaatgggtcgaggaactcccatcagtactatgggccgtacgcaccacaccgacaacgtgtaacaaggaaacaaccttcttcctcgtgtacggctccgaggccatgctccccagcgagctatgacatcagagtacacgagtacagaagcactccgacgaggaccaggaggagcagcgaaacgtcgatgtaaatctactcgaggaacatcgcgaacgagttgtcgttcgagcagccagctatcaacaggccctccgccgttaccacgagaagcgcatccgagtatgcatacattcgatcggcgactacgtcctccgacgggttcaaagccaagcagcgcgaaacaaactctcacccaaataggaaggaccttacacgatcacacaagtcttgcggccaggcgcattcaaaattgcagacggcgatggtcacgagttagcaaattcctggaacattaaccaactacgtaaattctatgtatgactcaataccatccgtacctgtaagacaccttacagtatcagtaaagcctattcttaggcccatattacaatcaaagtgttcccgcccgatgatcccttaccctgatgacacctagcgttgaaacctatcctcatgtccctttacgctgtcttgacaaggcctccgaggaacctaaaggatcttcggctggggacgcccagagccgataaggccttgtcagatcctgtagagacgaaagaccatgtaagatctggtcgtgtaagagttctcgccgtgcgtattaaccaagccgtgaaatcggaaattaactttccaacttcatggctgggggctaggatcagagcttattcaaccaaggcaggtcaaaggtccaagagccttatcctccgagaaaattcctccgacgacaaggctgggggctagggagagtgtacgactcaaacgactgactaaagtcgtgaactaagaacacactcttacacacgacatctggagtaagaaagatttgttttgttaaagatagatttcttttctatttcacaaaatatttcttacagtttttacacaaatccaaagctatattacacatttttcctgagatatctaccacagggtacgaagactaccaagaaggccaacgccagtccatagactggaagatcttctccgcgaacggcgccatcgacctcgccaggtggtctatctccgccggagtcctccgagaacgagcaaagccctcacggagatctcgtaggcaagccaacacgtgccctccggcatatcggctcgatcgatgacactcctgcttcaaggcctcgtcgatacgcttgccgacgccatcaagttgagcacaggctccgttcagccatgagatgtatccagctgctgactcctcgggatctccatggggtactcgaagttctctacaaaccctggccatggatgtgcagcaactcttcaagtacgagttgaaccacacctcaccacctcggagcgtttccacagcctgctctttcttcactgcaagcatggttctctcaagatccgctacttcaaattttgtcttccaatattggatacgacgatcttggccaccaagagcactctcgagatctgctcagtgtgggaacaactaagtcaagctacacgcctctttcaagaacagagctgatctagtcggaggagcagaaagggatgaatggactactaacctaaggaagtcgtcaccatctctggccccgtagcaagggtctggtctacattgtcgggcgacgcatgtggttcaaactcgggctgcccgcgttgctggacatcctcgtcatcaacatctctacaagggacaaaagttttcaagatcaacatacaagagtgaactagttttcaagatcaacatacaagagtgaactagcataacagctgcacacacaaaggcggttaaaatccaggtttacacagcatgtctagggattacaagaggtcctactcttcaaaaagggggagaacagattcccccagatcaccgacttcttccatcacggccaatgccgcgagcactagcctcgaggaggcgccccatttcgacctggagatcctcccaggtgaggacggcagccagtggaccacgaccagctgcgggatcgctgactgggccgcttggtgtcacctcgcggctcccaggcgcaagcacgacatccgtcgaggctgcagcgggagacgcgccggaagtccctccggactcgtcttgcaccgccttcgcccgcgccgccctgtgagacagctatggttcagacaacactcgaacaaaatcacgaagacttaagttcatctacttacttctcgccaactgtcacaagacgttgtcgccgtggaggcaggggagacgcgtccgaggcctgaaaaacggttgatgcgaagtaaggcgaaattcttctagctgcatgatctgacgacaggatagcttatcgagggggttgatgccttgcgacgatgtccgcttacagagaacttcctcccctttctcagaacattgccaccacttgtggtagcagcggcagcatcagacgcctccttggcgaccttctctttcagtgacgccgccacctgatggtccgcgagcggcccgatgatgttagtcagaggaagagcctacgcttaatcaagtcataaagtgatctcaaaaggaaaacgcaggatgcctatcgagaacacttacattgatggcagcatcacgttcagccgcccgcttttcacaaaggggaacggggatgttactcgctgttgtcgggctgctgatcatcacctggccgacacgacgtcccacggtttcgctgttcagacctgtgaatcgagaaccaaattttgataaatcaggaggaacgtggacatgagcatgtcaggataaatgcgagaaagataccctgaggagaaacccgggtcgcgtcctccggtccggaatagtcaaaggctggatggactcgagcctggagcggctggatccgtcttctaacgaagtctgcagtgacttcatacctcgacaagcctcgtactcggagatcatcgacaatgtcgatgaacgattggagagaaggagtcaaagggggctttgcagtccaagacgggattttgtccggttgttccgtaggaacaatgaagacagggtccgaatctttgatctgaaggtagaaccacctcgtccgccatttgctgcgagaagaagggcactggaaggggatataacgcgacttcaggccatcccgaagtcggaacccgacgcatccagacaccctgttgggctccatccaacgcagctcatagtaaaagcgaaagagatcaagaaagggctctaccccaatgtaggcctcacagagatgagaaaagatgctaagaaaggcgatggaattggggttcaggtggagcagagaaagaccgtagaagttcagaaccaagagaagaaattcggaaggcggagggataaaatcacagagaatgtagtcttcgatcacaaccatgcgacctaagacaggctggggattagtacctcctgcttccctttccatggtcccacgaccgggaagggcgccatcttcctaaagcttcttcagcgacgcgctggtggaggatgatttgccaagatccatcgtcgatcggagatcaccggagaaggggctaaggccgacgaactagggtttcttgtgggagtggagaagacgaagagcgcttgcaggctggatgttttctacacgatgggcggactttggatcctcaaaattcctttaaatagacacactaccgacggtgcgaattccaaggaaaggagagagatgctcgccggaaatttctgggtcctttacgcgcggcagttttttggacttcagtttaaattcgctcatgaccgttgggcttcaaacggtgttctcgactacgtcctgtctctacggtcctcgcatcgggaacgacaacagtctcgacacaagaagccgtgaatggttacacgagcttatttaagcagaagtcgggggctactgttagggttacgggttaggtataccctttaccctttgacgtacgtcgcatacctatgtagtatacccacacgtatacggatactctccgcgtaaattaaggaaacccctcacggagtttacaaatgaaaagagtcctactcggacaagactgggtcgtcaatgtatcgtgtaaggtttgatgtttccgagttctacttggaaaccgcctgacctgtgatataaaagggaccccccggggaggacctaaggcatcgaatctcagagccaacacaacccacacagcctacgaagtcggagcctgcaatgagccaaatcgccagggatcgtagtcgagccaactcgaccacgatctcgccggattcgtcaagttccactattccctttgtaacctgtgttttccatcatataatcccacatcaactggattagggctattacatatcaaggggtctgaaccagtataatctttgtcttttgtctgcttgatgtcgtattacgtagatccttgtaccaacgtaccccaataccctctatatccggtctacgggtatcacccgtcgacaaaatgagatagtataggattgaagacaataagaaaaactatctagtcgatagatctatacaatcgtgatggataactcatcagctaaaactccgatagaactttgaacagagcctatcaagcctgaataagtctatctaacgaataaaagactagcagatcggacttaaccaagacaatataagtttgatgaaaggcttgatagatctatattaaatcaaactagcaaagcaatcaaataaagagccaatatatcagatatattgaatcaaattaagaaagcaaagaaatcaaagaaagagtcgatatatcagataaggaacggtagtaaaatgtgattagaatatcggacttaatcgagaaattactaattaggccgatataagcgaagttgatggagcttactttctcgttggagatcgaaaccggtgcagtctaaactcgatacttagaactcatcaaaattaactttgttagaaaaggaaactaacaaacttgccttaatacgaaaactaaaaacaaaatacttctaagattggttaaatatatctgatacactttccaaccatccttgctagaatcacaacttcaaccatctctttgacttgctttgcctaacggcatgcaccaaattttgccgttaacatatatattttattagtatgtctattctatgttagaaatgttgctacgttttaatagaatcttcataaaatctaaagaaatttaatgaagtcatcttataatatgaaatggagggagtaattactactgatcaatcactttgttgtagtactgatcttttttagtttcaactctaattaatacctataaaaactcaaattaaaaagtaacagatatgtaatttaatttgtttttcttttttattaccctgagtgttattcttcgagaaagaaaataaaatttgtatagctacctatacaaccatgttacggctgacaagtattttatcgtaacagcgagggtgttttctttgctgtcaaagaagtgtacttagatgatcaagggaaatacgacgatgcacaacagtgtatttttcagcttcagcaggttggtttcgctagatgcttctcttgttgataatatatggagtatatatatttctgttggtaatggtgtattttcagatcataaagcatctactaatttctaataatctgttcaggaaattgcactcctgagtcgtctgcaacacaataacattgtacagtactatggtacagacaaagtaagctcctgatcgatcttgtgatctttgcctttaggggatcttgtggttgttcatctatttgttgaagtaatatgtgttattgtgttgtatataaattcataggttttcttatacatatttcttttaaggttaatatgatcatccattgtgtgacgactgcaggaggactcaaaactttacgtcttcctagaactaatgtcacaaggctctcttgcatccttgtaccagaaatatcgcctgcgaaattctcatgtttcgcgatatacaaaacaaatccttaatgggttgacttacctccacaacagaaacattgttcatcggtaatattcatacgtctgtttgcaccataggcaatttcaacctgtaattttgtagcataaatgggatttcttaattataaattgctcactagatttctcaatttgtcttgcaaaggaataaaatattaattatatactcatgtacttcaatgttcaaaattcttgtagggatgtgaagtgtggcaatatactggtgcataggaatggatctgtgaaacttgccgactttggtcttgctaagcaggtctctgctttctgctgggcagaatctgtatttatgtttgtgttagatctttcagttctttgttactgactttgttctactcttgatttattagttatctctttcagataaacaaattcagcatgcttaaatcatgtgaaggaagtgtttattggatggcacccgaggtataccaccatgcatgatcgatgagttttttctataaaaaataaagaaataacaaaatggacatgctaagattttttgtcaccatagctttctccccctccttcgatgttttgtccagaataaaaagtactgaaatattatcctaaaaatgagcggcacatatacattgtggacttgggtgaaagtgaaagtcagctggcacaatgtggccatggatatatccaacaatttaatgttaataaacgctaagaactggctagctagtattatatcaaatagtaaaaactgtctatgatggcaaaggtagagttttgttctcatgtactgaaatttaccagcagtacgccgcttaattcagcttaaatctatacactgaacattcaggttgtcaatcccaagaggacatatggaacggcagctgatatatggagtctcggttgcacagtcctggagatgttgacacgtcaactgccttacccaaatttagaatgggtgagttattcttcatcaggaaaattgttttccactgtagaattaaattatgtgtcaaaattcgataaattaaatgtgtccactatgatccaattcccttgaattattccttcaattcttgttcaattaaatgtgtccaactatttcttcaattgttgttttacaggcacaagctttatttaagatcggaaggggtgaaccaccagcaatcccaaaatacctttcaaaggaggctcgtgatttcataagccagtgtttgagaccatatccggatgatagaccttctgcatccaaattattggaccatcctttcgtgaataggtcagtaaggtctataatgtctgtaatgacatcttgaagctaagactcctcaataaggtgcgatgaggacatctcttcgctctcaatgtgtgtggttacagatgtggactagtgtagtataacaggcatctgtcgaggaatatgccacaatactattggtgactacacttgcaccaaatgcccttctaaaaggctgaggcaataagtcggagcacgtataaatcttctcatataatctcgtgtgggaatcactcggagtacgtaggaatgccaaccactacataagccacgaatggcgaggcgagcagcaaggagctgggagaggctttttaactacaagaacgttggggtgggacgctagtacttaaactagggtttcttcttatcgctaatcttgtagttttaagcagtaagttgtaacatgccttccctcgttctctcgtatcgggaagatttaacagtattttcttatgatgatgtgatcaagagcatatgaaacatcggtttaaaagattgagtgcgattattgtagtcaagggtgaaccaagtgcttgtacgaagaagcgaatcaatcagaatggagacaaggaaacgaggagaggcgaaactgaactaaaaggaaaagggaactcgagcgactatcatgaatgaagtgaggtttttccttctgattggatttcttaggagagcaacagaaggtataaatataattagagtgcgatgagaaaatgaagcagtgtacaacttctaaaaaaaaaaaggaaaaccaatcttctactaggtgagttatgtattctattgattttcataatgaaaagtataaaacaacaaaaaaaaagttcagtcaactcaaattgtatattacttactgcaaactagcaccagaaataaaatgcaaatttagcataaattgatttcatcttcttgactttgtaaaatgttttaaattctagattaactcaatttaatacgctaatgcagattatattatttgttgtacattggcatggttcacaccaacacataatttttttaaagctagaactttctttctctaaccctaaccaaaaagttaagtgttgtttcctaggttccgattgaactattcaaaaaagttctacatatataagaaaaaactcatatctccaaaaaataatgttgataagccctaagctccgatcgatacacacactgctatgattggccggttctttcgatgagttgagataaatacgatttgggagagaagttgtcggcgcaattacaattgtttgaggcgttgttgtgttgtgccttaccatgggttgttgatcttaccggtgcagatcagccatattcctgtaagtaaatcaaagaaacaagcaagaacaagataaaaacaatctaaattgtaaataggaattaaagatcacgataaggtggggctccgaagacaagtaattagacggtctagccgacacgcgcaaatacaaggttagtagtaatggctaaattttaatctaacaaaaccaaagaaattcggaaggggaacctatttatttaaggaggtggggcgacgactaaggggttcctagggtcatgctccacaagtttggggcgcaccccaggccggggtcccaggtgatacagtacattgattttgcaattgtggccaacttagatggaatttggagatgcgactggatccattggaaagaggactccaagagctttccatcatgggcccaaaacaaagctcttatgcacaattggtgaccgtttgaagtcactgttgttcaacgtggccgaattgaattgtttttgcttgttctccatgccttcatgtttctatagtaggcatgaacacatcgtcctccccttcttcaaaggaaaccgttctcaatttttccatatgttgttgttcatgtagtgcatgatcttgcgcatagacgtgtgtacatgaacacgaacacaaaaaacttttgtcatgcaatatcatgaattctttcgcaaataatattaacgtctaatgaaacggttatacctggtaatgtggatgcacaacataggatttatatgctacattgaaactattccctttgcagcgtatatcgctctccttctttatgaacaaagtactcgaatggtgtagttgtaatggtgtatggaagcaatattgagcaatctagtagctccccttctttagaaccaacttattctttaaattgaaatgagataaacttgagataacatgattacaaataatgtatctccctacttactattttcttctatgaatatacgatgttacaaaactgaacatatgtaaactttatgcatcaaagatatgataaatagtattattttcaccaaagatatgataaatagtattcattcgacatgccaaattagacttagctaataaattctacttcaaattatcgagtacacaaaagtcatcaaacataatatagcccaaagtctttaaagaagatagcaattcacattcctcaacttcattcgcaattatgaacaacatgcttaaaatcagcacataaaagaacactaggaatagtatgttcattcattagttgtggcatgcatataagtgaagtattataacacaactcttctttaccacaaggaataacaaataaatcaacttgtcacaaagaaaccttagtaattggctcctctaatggttgctctacagtagcatgaaaagtggacatgtgtagcttagcttaacctgattcaacaaaagaaatatatttttggtgtagtccttagtagaaaaacctcatagatatcacttccaaaaccaacaccaatataatggagctaatgatggtacttacaggtgccacttatacaaataggtgtcggttttttcaacctacttacaccgtatgtggcatttatatgtgcgcgcttattataaaaataggcacctattacttgattaaactattaattagctctgtattatctaaaaaaattaattagctctgtattttaaatcatcccaaatgagtagtcataggtgaaggattttaatttgaacgagtcaatgaggcttagttggatgagaaatgggtcatatttgtgccggttttaagcgaacatacatgtataagaacgtcacgtatgtgacgtaatgtattagtgactcattaaattataaattagatagcaagaaaccaattagatctctctttcgaagtagtcttattgattagtactccctccgtcctaaaatatattttgggatggaggaagtagtatatagacatccatccaatgatttaataattcaatacagtgggattgtggcatagctccctccaatgaatcaccactcctgcgacctactcaagccactaccctatcaacctttgttcgggtaggtatagtgtttctatcttttaactaatcatgctgaaacttttgcatcgtttcgcctgaaaaaaggtctgcattaccacggaaaaaagatgtcaaaataagacaatatcgatctatagtcctgccggcgagcttgtcaatccgttatttcatcaaatcttgtcgggtcgcctatctactaatctcaagccgacagataaattaaaggtccacgtgttagcccatgacatcacagataaattctgaatttatataagaagaaaagtaaaaaaatctatagtacgtataactagaaaatcagcgcgttagttggcgcgctagaaatttatagcccatatacattatttatcgatcatcttgaatatggaaattttgtataatattacatggcttagttattttttgagtatatgggttatttcaaattatgcataaatcatatattcaaaagaatgttttactggattttaattatctatatgtttgtcgaaaattgagatggatcaaatagtaatttatgatttgtcagtaattatttgggtagattgtgttgtttaagttcatgagtataggtgcatgtgttaggaaaaataatagtaagtgtgttgtgttaaattgcagtgattttataaaacttgtaagttttacatattcattagaacctagtagaaaataaacatatagaaaaaatggctcataagaatgtaaaaacttgaaccaatattttacattatttgcgttattattttttctatatatattgttttcttctttccctaaaatatatgatatcaatgtagtcatagtactcgcatcaatttcaacttaattgtagtaccagggaccagggacgatgacgacgacgatggaggagggcgcgggattcgccccacgagatcccccgccacggtgcgcgacgcgacggatcaaaaagaaggcggcggaaaccagctccttcgacgatgacgggcagcagcaccctaggccgcagggcgaggtgggggcggcggatcccggcgattcagtgaaggaggagtcttcggagcgaagcggaccaagcggttgtgggggagcgaccgagagagggggctgcggcggcgtcgattgaggagttgaggaggagagagccgaggggagatacggagggagcgatcgagagaggggggcgacgcgtgcattgatgcggcggagtgcggagagcacgacgagtgatggatgcgcgatggcgccgcgtcgaggtatagaggcggcagcggcggggtgagggtgtgggggagatagagagggattgggggcgccgtttttttctcgccaactatggatttctgatgccatggttaaggtcatgtgtctatattggttcgcgtgtttacgttggctttaccttcaaccactatgcatttttttaaagtagtacagataatacagaaagcattcattttttatcaaaaatgatggtagattttggtgaaaatagaaatccatgttctgttttaaatgaggttttctttataaaacataaaagaatagaatggtataatcatttgtcccatcataaaaaataatgatgaatttgaattatccagaaaattattctggtatgatgggttattcttctcgagtaggcatattgtatccctattatataactctgcactagtgctacttgcaatttcagcagagattattcagccgcattgttcaataaacacatttgtattttgatcgttatactcaatagaactattttgatcattataatcaatagaacgtacacacctcttttggtattgggatccacgcctcttttggtattggtgagcaaaattccacatgtttcagtattggtaagaagaattccatatcttgtccgtgagatttgggatttgtgtttgagcaactggaattcatggatttggtaagaagaattccacgtcttgtccgtgagatttgggatcaagctgttgtgtttgagcaactcgaatttacggatgatttgagtattctcgcgatcatctcaatgttttccataccctgctaaggacactttgatatgcttggttctctcaaatatctcatttcacagccaaataataagaataataaaacttcaattctttttattatataaagctagagattgggtagcatataaagggagagaaccggagacacacgcaatgtgtttagctgcttgatttcctgggctgaatgtcatgtgtttcgttgaacacgctccatgtgacatgcatgaccgcaggcttgacatacatgagagatcaaacagcctcgatatgataaggaaaagctagctcgttagttagaatatttcatccaatttctttaactgagttaagacatgaagttacagtgtagtttacagaactaccttccataaggattactatacttacataaacagggaactacacgaagtaaacagggactcagggaggcacttttatgtgccatgggacattgtatgacagcaaatttaaattatacacatccggcccactatactatgatagaaagtcccaaatttaattttaggatatcacacttgggccacattcaattctttcttctctactggcccatactttccatccactcccttgatccaaccccctcgacatcttttcattctctcttacaggccggcccactttttccagaccagcccagctcgctttcctctctattggcccatttacaccgttgcgcagcctagtaggcccaacaggcccaaggcccagcatggccgaactcctggccctaaccaaaccatacatgctgctggctcactaaccgaggtgnnnnnnnnnnnnnnnnnnnnnnnnnnnnnnnnnnnnnnnnnnnnnnnnnnnnnnnnnnnnnnnnnnnnntgatgaactgcttgcagtcaaacggngatctcacctcacgt

SEQ ID NO: 3591 - DNA, 4111 bp, Oryza sativa
  unsure (1)..(4111): unsure at all n locations
cgcctcaccccttgaangtcgatggcgnntcccgcagaagnncatcattcctcacaaagctgtttcgattttgatccagtggagagggctgctgtcggagaagctgaaggtcgaagtggatggtctgaaggactcattgcttgccagtatttgggcgtcaggaccaaactagtgcgttaatttttgctgtgtggttctttgtgagttccttactggcttgttagcgctgtgccagcagcaccttaatagaagtgaagttgagttttcagcacatcatctcaagctggcttccccagcggttacccttgtatctgcactcttatgcttgatagtaagctgggcctttcggccttttctctaaaaaaaaaatcttggttctcaaaatgaactgggaaatgattacatgctatataaataatcatatagtatttgaaaggaaatgctaagagtatcctgaaactgaccggatatttgggttgtcaaagagtgcaaccaatttccgtttatctggttttattgtcttcgcatttcctccatacagataacgcctgtgccccatcagaaaatgaggaaagttgctttcttgagtcgtcacaaactcttcgctctgcagacagaccgtgtagtccagtgctgccagtctagatgagtgcccctgatagagcataggtaggtgtctgagttgaaggaagtcgcatggagataaaaatggtttctaatccaattgttgtctgatcctcgaattaaacaaggatttcagatgcttgatggacagtaaatgataagatacacaaatgactaatccaaacaatggagtaccttgaactgtgcaagttcctcaggtgaagcgagagtatcttttgtctgtaaaagtggaaacaactggagaagaggagtcatatacttttcagcgttgtatattttaccagaggcaacatagagggaggtagtattgccaaatcccatgccctgcagcatcattccaacctgcataaactaaaccagtaagaactagcaatttatactattccataaaccagactccagagcataaaatttttaatgctttaatgcttttggcaaatcagcttactaaaatacgtctgaaatttgtgttggcatttttaatctgaaaaacgttacatagatgacatctagcactgcatattgtgccagcgatggaattgcctgtgggatgttattttgcatgaatgcacacccctcactctcccctgggtgcaactgaaccgcccaacaaattatagcctgagaagcatgacatgaaaacactaaaagagagcaggctagcaacaagaacatactcaaaagcattgcggcaggggcaaacttcccaacctctaaaggagttaaagggcacttcccattcctcctatttgcctcaggatttatcactcgaccaggtcggtgaaacttccctctccaactcctttcacgagcattttccatttcaatactctccctccagccaccatcatatatgcagcacgaaaaggctagcatatcttgaacaaaggggcataaacatcataaaacttagtgagctgaaaaaagaaatgcttagtagctaaaagagctattgcggtagaacctcttcaaagcgaaggtgcacggaaatgtacttcccaccagttaaagaactcatcttgatcattcggtcaaccatatttgttccaagcattcttatgggttcagaaaatctcaacgcctcatagttagcaaaacacctcaacgcctggatattcggtggaaccgaatgggccaatctgtttgagaaaggagcaatacgcacagtcctggcacagaaagcgagtgaagctatggtactacagaacacccttagttgcaaggatatgatgcagcatcaagggaaggaagaagaggagcacggaccctagctccaacaattttggaagcaccttttgtaggtagtagctttcagatgagaaggctttggtcctcatatttggtatcatgctgatattgtgatcaaaattcacaaatgcatcttcaggaagttttttgacaacccttatgtattttttgagcgacccaataaagtgatcttcatcaaagatatcaccaaatttgctgaaagcaataaaacgacacaagaaagaattatcctccagaaactgatgcgtgaaaactagcatatttttctgtgagttttcttcgcattttcttggactgttatttccatgctgcatttatatcagttgaaactgggatcgatctcacaattaaattaatttaaatggcactttgcttaaaagttcaaacacatatcagtatattacatagcatgagggtaaaaaaaaaaaagaggggagaccaaatgctacagcaaaataacattttttactcaatcaaattttgtgagcttcgatagaaatggaactggcaaaaacagcatctttaattagcaaagattgaaaggacaaattggagctaacagaggtctatgattaacaataaacaaaaccagaaagctagaatacatttctgaagtggaagtacaagataaatggcaaacagaggatgattgacggcacaaaaggacagggcatgccaagaaatatacttatgttaatattgcgaagaaaagaaaaggaaactaaaactgttccacttcacagttccagctaaaaaagaatgactatgctgtaaatgacaaactagtaacagaagtgaattttgctagttctctgaaggagaacgaggggaacatatgccataattcagtttatgcagacacatctggtattctaccagtaaatggagatagttacctagaatcacgccacacgctgttcaaatgaaaagctggggtgacaagagttgcattgagtaagcttgccacagcaacagcatcgcagatctgtatcgagacatttattgagatgctagaaaaaaatttacagaactttaaagatcaagattagtggtacattaattcattttcaatagttatgagctcctcatgaattgtgtggaagatagggaaagacgtgtaacaaaatggtaaataacatgttacagaacaaaagttcaaaatgtgtatatatgggatatcatataagaatttcggtatccttcattccatcaatgcttcagactgctatgatatatgtaacagaaatcataaggtttcttatcatagagcattcagaataaatttcagtaatactgaagatttgtttagtaaaaataaggatgtctctgaacttgtagacacaagactaaatgagtaaatgtatctacttggacgatttatgctgagggtaaaaacaatccagcaacttacagaaatgcgttgttgattcagaccaccatttgcttcgattatgagaaaaccatttgaaggtggtaactctgaaaagtgtgatgaggactatcagtattttttttgacaggtatgtggactatcagtataaagtgcataaccgagttttctgtcactgtctatgaatctatgatgacataaaagttaaaatccccagcagctttcgacttgggcaactctggtgtataaacttgtaaagagcgtttcaagttcacacctgatcgtctcaacttcttggtgatacaaggagcccatcgttttccagattttttgttttgtggtgtcattagctgcacaatgacaagacaatttatgttatataatatatagagttaaaaattagatctaaactgtttcaaaaaaaatctaaatgaaaaacaggtaaacactaaaaacacattacatgaccaagaacaacaacaaaaaggagtaaacactaaacagtatgaacatttgtaggtagtttagccaaatcaaaggcattgcaaccactgagaggatataaattgcacaaaccaatcaaagaactgagaggaaggtgctattttcactcgaatactgagaggaagccaagaactacaccccaaatggaatgccggtaacagatcgggcattacagttccccacggaacgagccaagaaacgcgcgcgctgggtgttccagcagctatccagggtcccaggtcactcaccgggtgcgggcggnaggtgatgngtnntgcagtacgagacgtacctcatgacgcg

SEQ ID NO: 3592 - DNA, 1254 bp, Oryza sativa
  unsure (1)..(1254): unsure at all n locations
cgcgcacccttgaccattgangtggagtcgcgcctgactgcaagncgntcatcacggaacctgtcgcggtcgtgcatccacgaggtggcggtgcccaagggctacgccgcggccaaggacgaggcggtgcacgggacgctctcgagcccggccttccatggcgagatggccaaggcctacccgttccagctcgaccccttccagagcgtctccatcgcctgcctcgagcgcaacgagtcggtgctcgtctccgcccacacctcggcggggaagaccgccattgccgagtacgccatcgccatgtcgttccgggacaagcagagggtcatatacacctcccctctcaaggccctgagcaaccagaagtacagggagctcagccaggagttctccgatgtcggattgatgaccggcgatgtcacgctgcagccgaacgcgacttgcctcgtcatgaccacggagatcctcagggcaatgctctacagggggtccgaggtgatcaaggaggttgcctgggttatctttgatgagatccactacatgaaggatcgcgagcgcggggtcgtgtgggaggagagtataatcttcctgccacctgccatcaagatggtgttcctctctgccaccatgtcgaacgcgaccgagtttgccgagtggatatgcaatctgcacaagcaaccttgtcatgtggtgtatactgacttcaggccgacaccgttacagcactatgtgttcccgattggcggctccggtctctaccttgtagtagatgaggatggccaattcagagaggataattttttaagctgcaagacacgttcacaaagcaaagtaatcaagtggatggaagaaagggtggtggacctaaagccagtggtcgaatagcaaagggcgaaagtgcctctggaaattcggacatatacagaatcgtcaaggtaggcatccactgacatttgttaatgcctgatgtattatggccttaatgggctcctgaatttaccataattttagtgttttttcccctgaaatatgctttgctttatcctaatgcaaagttgactatgttaaagactaggcaatgtttgcatatcgcttgtagatattcactcttcagatattgatgtttgatttgacattaacattaaaattttagatccttacttaattggatgaattctatctgcagatgattatggaacggaagtttcaaccggtgntggngtncagtgcagtcgtntatccctngagggccaa

SEQ ID NO: 3593 - DNA, 1258 bp, Oryza sativa
  unsure (1)..(1258): unsure at all n locations
gggccctnatgatggctttcgtggccagagnnataaaccggtctaattttagctttagcagaagagaatgtgaacaccatgccatgtcaatgtcaaaacttgacttcaacactgatgaagaaaaagataacatcgaacaggttttcagcagtgctattctatgtttaagtgaggaagatagaggtttgcctgctatagagttgatgttgcctcttcttaaacgaggtattgcagttcaccattctggattgcttccattaattaaagagctggtggagttgctcttccaagaaggccttgtaaaagctctctttgctactgaaacagtatgcccttatacctgatcattgcacttagtgttaaacttgttttattcttcacacataatatagtatggaattactatcctttgatttttgtaagttgtaaactagggacagctagggaacttttgttttgcacttcctgcattgcatctttcatcattcaatcaacagatgatctttatgtttcctccctcagtttgccatgggactgaatatgcctgcaaaaaccgttgtgttcacgtctgtcaaaaaatgggatggtgatactaaccgctatattgcttctggagaatatatacaggtaaatcgacatacgaaagtgcaattcatgcatatacttgaaattagttgaggaaatgaactacaatcccttcttactatataataattttgtgtgcactgcatttgtagatgagtggaagagctggtcggcgtggcaaggatatacgtggaatttgtgttataatgatagatgaaaaagtaagagcctacagtttcctgttataattatctttatttttcttaaatacaatttaagtaccttcctagatattcatgccaggaggtttagtgcatatttgttgactcaaataattcatcatgctattcttgataaaatgaaacttttaaaagataccaagaaaatacatatttggcccaatgcatcgtgattctgcagctgtctttcttggttcagttagcacaataaaatatgtgaaactgataactgacatactgctttactttgtttcctaattcaagtaaatgctatgtcatttgtagtaatccttctgattgtttatcacttttcatcttcaattcttttgtttatttcaactgttgtcggcatgcaaataacattaattaactaaagccagcatgatccaagttatgttttttgaaataattggacattcacatccaaatatagt

SEQ ID NO: 3594 - DNA, 2029 bp, Oryza sativa
  unsure (1)..(2029): unsure at all n locations
ctggtcatgttgagtgattttcgntaccgcagncgnncaacatggaaaatgaagctaccttacttgattcttctggagaggtatgttatttttatttatattagtgcattacacattttattcttccattgatactgacagtactgacacttgcccctgtatagactgatcttgcagaatatcataaattggggcttgatatatcggaacttgaaaagaaaatcatgtcggagatgattagaccagagagggctttgttatacttggttcctggaaggctggtacgttacacttataacctcataggttctgttccttaagaatgatttggatatatcatcagctatcaccattgtatttgtcttatgagaaacagaagggataatatatctacttctattttcatcgtttcctctgtgtactgttcctttgtttccactaagcaatttgcttcattgcaggttaaagtgagagatggttcaacagactggggatggggtgtggttgtaaatgtggttaagaaacctccacaatctggtactctccctcttgcactaagtgcatctcgtggtaataactatatagtggataccctgcttcactgttcttctagttcgaacgagaatggatcccgttcaaagccattgccaccacgcccaggggagaagggagaaatgcatgtggtgagttgaatttcacagataaatattttattgtggtcaacaaacaaaactttgttctgtagtgataattaggtgatgatcgtttaaggaaggacccaaaatttttggaatttgataaatgtaaggtatttgcaggtgcctgtaccactacctttattatctggtctaagcagtgttagaatcaacattcctcctgatctacgaccacctgaagcaagacaaaatatactttttgcagtgcaagagctgggaaagcggtacccccaaggtcttccaaagctagatccaatcaaagtatggttaacatttttgttatctttccttcggaagtaccattttaggttagcagctgaaaattacagagaatttaatatctgaaaaatgttgcatgatggtttagctgtatatgtgcacaacactctcggtgattttttttctccttttggatgccttgatcagctaactccctccaacacatacgctagggttgttattactatttctttctgcaatacattgtcgatgcatgatgcataggcagagcatacactagttctgtaatacctgtagaatcttcagctgcatattctacgctgacatatccgcatagatgcagactattgatggcttgttttgccctacccttgcaattttgctgtcaattgagctggtctattttcatgtataaaaatatatgctctggcatcatcaaacaatttgaaatcctgttctattccgtattcactctggtattctgacataattgataggacatgggtcttcaagaacctgaactagtggagttggttcataagcttgatgatcttgagcagaaactgtgttctcatccacttcataaggtactccaagtcacttatcagtcaagaaatttcttgtcacttagagattttgactgattattttgtgttgatattgtctcttagtctgatcaaagtgagcagcaactgtcatggtatcaaagaaaagctgagctaaatcatgaaattcaaatgctaaagtcaaagatgcgggattcgcaggtaggttgaatctttgcatgcttggttatttttaaacgctaaatgtgttcttactttttcctccattcagctacaaaaatttagagatgagcttaggaatcggtcccgtgttctgaagatgcttggtcacattgatgctgatggtgtgctccagctgaaaggacgtgctgcctgtttaatagacacaggggatgagctgcttatcactgaacttatgtttaatggtaccagtctaatatgattatctttgttcagttttgatganctgcttgcagtcaagcgcgaatcaaanntcaaggggcgcgg

SEQ ID NO: 3595 - DNA, 4084 bp, Oryza sativa
  unsure (1)..(4084): unsure at all n locations
gctggtattaggatgactacactcaanccncctcagaaatgtcgaatcaacttgtaggccctacctgatggatgtcatatactgttggtcaaaggtttgtcagcactatacaatccctgatgttggaaatcttgtactccgtttattttattggaaatttgttgatcgtcctctgtcaattggttctttatcttattgaatctccctatcactgtattgatattctctaatttccttagttatgtttaattgcttaattttctccatacagggggccacttttggagaggtgatagaaatgactgacatttttgaaggaagtatcatacggctggctagaagactggatgaatttctgaatcaggtatagcatcctatttatgctgctgctgccatagtgtcatcctattttacctccttttttgctgttagtacctaattcacttagacaatctgaacatctacccatcgattatggcatcttatgttcaattgcatgcaaataagaagtgcaattctggtatggaatgcccacaaaagtgtcgtgtgacattatggcctactcattgaagtcccagttcgaatgtctaaattatttcacggcaccagaaaggctaaactaggttcatacttagtttttataccctagtttcatgaatttggttcagtacaagtagttgtagtcttgcagatgatgtgaggatgacatttgcttatgccttgaaagcatcattaatagacacagcagtgttgccatcgtgtatttttaagaaaaaaaatctcaacatacaacctcacgatttgcgtacactcttttctagtcatatcatagataatgtgctgttctgcagttctcttcctcacaagcatgcaactgattggaatttggatgaacggtgattgatcattaacaaatcaacaacctaaaaagcgcatcattttcccatctgaactctgagccaactaactctgaatatgttatgacagttgaaagctgctgctcaagctgttggtgaggttaaccttgagaacaagttcggagcggccagcgacagcttacgtcggggtatcatgttcgccaactcattgtatctgtgatgaaggtccagcagttgtaacgccgtatgttagcaaagcaaatgtagttattctttttgagaaggcatgaaatgtaacccatatatcagtagaaccctgtaggtttttaggaggtaagctctctgcattagcagcccgtaggtaacgcaatttcatcagcagatcagaggcaatctggtatgcaaaaaacattttgatatatcatgttacctgtaggttttgaggcctgatgattgatatatgatgatgtgcttatgagaatttgtatgcttgttaacatacgagccagagattttgcttattcatgatacccttttttggggatgtttcttatttgccagcgacaaatcagtactatcacttatttacccttctcttatttatccacatgttattgagaggacaggagatgtataagggaacacgccaattttcagaggcaaatacacattttgggcttgtttgactcatagacattcatagccttgccaatttgtttggcaatggcattcctttgctttgctaacaaagttgcatttgccgttcaattaagccaaataatttggctacaaaccaaacaaactctatacttttctcgagtcgtttattcaaatgcttcttccaaaagttactgcccaatggtaatttaatactagctaccagtaaactaatccagaagaatattcttccaaaagtcgctcacaggctgtagtaactgaatcaagcagcagcaataatcgaatatctgagcaactaacttcaaaacatgtagtccgggagagaagaaacagctacagagaaagtaagatgctgggagattacacagcaaactaaacagctctggactacttttaagagagttctaaagacaaaattgttcttgcactacagattacatgagaaaaatggatacagattattctttttttctataatgatacataagtgatggacaataagaggccttttcccatcacattttatctccaaagaatgctcctgagcaaaactaatggcccagaaatgccaacaattttcaaagttacaagtgtggtggtgtggcttggcaaaatcaaccgttgacatatgcgcccagtttcttcttcacaaatgtaccattttttccacaactctgtatagcttgatcaacaatttggtatgctgattcagatgggggttatttaccagccgatagcatcttttgaagctgaatcacctgctgttgttgctctactggcaacgaactaagctgctcaggtgtcagttgtaggacttgctgcagaagaaccgacttaacatcgggtgtgagcttgaacaagacaagaacaactttattttgtagcgcatgaaaattatcatagtgttcagagattcggggcaattcaatgcaattccacaaaaatgaaaacaaccgtttagaacttcacataagtcatgtctcttaagattgtcaacagttcctcatactgaacaatcaaattctaaaaggataaaataacaataaacaccgggagattaaattatagggagtacctgaggcacttcgttctctggctgctggaagctaacagcagcagaattatagctccctgatggtccaccagggagcattccttgggatggagcaggataaacagctggattgttgtttacaattccaggtgtggatgttccatcctccaattttcgcaactttggatgatgagcaaactccgtcgaacgatttgcttgctcaggaaacctcatttccttctgtgctatatcaggtatagcaggtacctgtaattgggccgtactgagttggcatgtgcgggtaattaaatgaaaagtgcatattgtctacagcttgtgcctcataacttggaataacaatttagttcatctatggcatcgacaatgcctagctaagtaacttgtgctgtttgagcataaaggttcccagaggctctgcattggttatctcaaatatttggtttatcataaattaacacaaagttgattgaattacaaaggttcctttataagtgaagatcaagtcatgggtagcatgtgcatcagccaatggtagttgctgcatacccgctggcatagtaggtgtcctagggtgatgtggaataaatgggggctgttcatgcgatatcaggcttcctgaggtagcgaggtctagaggagcaacactgtaacaggcaccaaggagttgagatacaattggaggatgtatgcccaccccagactgacttccatgtggaaatattgtgcccgcaggctgagatgaatgcggatactgaggaaaattatgcagctgtgcagaagggtcctgcaggacatttgggtttggcaagcttgcagaaggtcttggaacacttgatatcatagcatctggctgtggaaatggttcgcttatgtgagatgatgattgtgccaaggagctagagggctgttggctctttgccatctgcatctgtgatttgaataaaacatcggttatctgtatgttacagaatcaaagaatacattgggtaccacaagctcagaagaaaatcagactataccatctggggcgtcaccattccaagcattatttgtgactgcattataagaagggagaaaaatgaaaccattaggcttttaatctcttattccaattctagatttagaactgaacgatgtgcaaataatccagtcaataatctgaaaataaccaagactaagaagtattctaatgtataaaaatgaaccaattacaaaatcagctcataacaaacaataagcagttgattaagtacaaaatcaatattagcaaaagttaacctgaaatagggcctttgacagctgtggaattccttgcagcagattgttggcaacatccttattttgactagttaaggactgccataaaaaaaatacattaataaactgcaattggtgcttgggcatttctaatatttaagaaacaatagtgcttaagaattcaagataaccttca

SEQ ID NO: 3596 - DNA, 2333 bp, Oryza sativa
caatagaatctctagcaaacccaatccgatctcaaggaatcctataaatcaataatattcattgttaaaagcatgcactaactacattaccgtattgaagctagctaatatctaatacacaatgtttatagtagtatattgaaagttttctgcatatagtgatatcaaacaataccactgcattataatctccagataattagaacaaaaacccacactgacatgtacaacaatgtataaattgcgctatttttcaagtcacacatcagtcaactgtatccagctgcgaacttgtgatgcacattttcttagtgtgctcattgacatttggcaacagaagattggtccacttatatcagcattagtcactggtatgggatggattcaaaggctggtgttgatagcatctcagaagattaagaatatttttgtgccagtgcagtagaaaaccaaaagaaactgtaaacccttctgcacatacataaaggtctcatttggaatttcctggttcatgcggaaattgaattatttctttgtgaaattccctgcatatcaaatggttctaaaaattcaattgggtactgtttcagcactcaattctactagcagtttcatctttttgctcaagtatatcgcataaggtgaaactacagatgcatctttcctagtgactactattcttcttttgctatttattcagaacacttttggcgaagctcttccaatgaagatatatggttttgctaggcaacaaacagcctttggcagacggattccataaataaaaggagatgtgacaacagagatattcttttttataaatggagatgccaaagataatgcgccataccagaatgataatttcacgagataaattggcagatatagcacgtgtgtgtatgtacagccaggcagctgtacatacatacacatgcttgaaacaaaagtgaaacatacgacacatggtggttggagaaaacactactattatcattcatgggaaccaaagcaatacaagctcttatcttaacataggaattggaagttgagaaatgtgtttcttctacagtagaaactgaggatcttcgactttttctctgtttctgtcagcattcctcccattttcagcaaaatcaacacgtaactgacggccattaatttcataaccttaaaggttccggcgtgcacttagagcagtctcctcatccttgtactcacaaaacccataaccctttggcttccctgtttctttatcaataaccaatctgcaaagcaccaaatgtttaagagcttatgagtagtcgaaactatcttaccacgtgttaccagattaaaaaacacttgcagctgctaggaaacttggcacattcctatgttcagagttatcagcgatattagtagcaccatgtagttcagccattaaacttcaattagcgattatttttaaatgtgcacggtataatgttatttcatagaaaaaaaagtgtgccaagcattatgtccataccagataccactgacccctgaactccttattatgtaaggagaataaaaggcatgaagttatttttaaaaacagacactagcaaaactttagtatccaacacacgtctgtctgaatcaaatccaaatatttgcagaacctatttagcttaactctaaccatcctaaacaccaattccacacacacacaattttgagggtttgtgcagtacaattaaacctgaatgagaccacagggccgacttcctcgcaaatctgcacgagctgctcctccgtcgcatcgtaaggaatgttcccgactgcaaccaaaattcaacaaccaacaaacgcatccgtcaatcgaaagggcacgagcagtaaaccctagaccaaaccaaattggtcaaacactaaaccctccccaaatctagcaccgcaaccgagcaaaacgcgcttcattttcctcctcactctcatcgacccacacccaaacgaagaacgaacaatcccactacggatcgaggagagcgaggcggctaggctagaaatcagccgaggcccaaatcgacgggaaggagccgagccgcctttgctctctctctactccgcaccccacgcacaccgtgagctccctccccggagctcagctcaggatcgaaccatgccgaagacggcgagagggaagcggggggtagggggcccgtaccgaagacgcagcggttcttggcgccggcgggggccgcggcggccatgctcgttagcagaggtcgccggcggcagggccgcggaagcggggcggcagcatccgcggcgcggcgttcggggtggcgacgcgggagatcgatgtgggg

SEQ ID NO: 3597 - DNA, 1790 bp, Oryza sativa
  unsure (1)..(1790): unsure at all n locations
tttttggcaccgccgggagccttgatggccattcttttcatcataggtctccttcgtcaagtcgtcgaaatctgttcgcaatcatctacgagcacggcattcttgagtgtcaacgcgaaaaatcaaggtgtgtaccgatccacgccgacgccgcgaagttttctttttcatttacttttctttttttttttgctatttccgacgtcgttcaaatatgagtacagcttgcggggtgtggtggtcgtttatagtaagggaagaagaccttttccgtgtctgtgtctagagttttgattggtattttagacgaatttaatttggcggcatgtttggcccattaactttgtaaaatttggtcatcatcagtgttttttttttggtagaaaggtttgtttggattggaacaaaacgaatttggagttaaatttgtcaatttaagttagggcttgtttagatctcctggtaaaattttatacctatcacatcgaatgtatagacacatgtatgaagtatttaaatataaaaaatagctaattacccaaattgcgtataaattgtaaaacaaatttttaaacctaattgtgccatattttttaagccttagcttgtttgcttggtaccaaaatttcttgcctagggccgagtttagttccaaacttttttttcaaacttctaacttttccatcacatcaaaactttcctacacacaaacttctaacttttccatcacattgtttcaatttcaaccaaacttctaattttggtgtgaactaaacacaccctagattggcaccgttagtgctaaactaagccaagccaaaatatgaaaataatagtaataattgtttaagatatcattgtagtatccaatatacatgtttgtctttcttgttattttcaaataaaaattattgaatatagctacatgtacatgagagtagttttcactacaacacccatggcataaatgctggtcgcagaaccttgggtgtgacaagttgcggcaaccaaaccagatactcttggtttcatgtgggttcatgatgccagcatccacttcatgaatcaaattcaatgtgaatagtagtagtttataacaattgctcatcagtacgagcaaacgtgtaattctatgtacatatgaaagattgtgtcaaatactcaaatatgatatatgatatgatgattagagagtgaaaataattttattttgctttttgggttttcttataatctcgtgtatatacctaatattatgaaaataatctagtgtacttccttcaaaattaggatggaaaccacttgtccactacaacaactaacactaaagcaacggtaagtttaactttagggcttaattagattgatgccatttcaaaccatatcattttttggtagagttaacaaacatgtgcatctatttaattttttgccaaactgtactaaatacataagaaatcctgccaaaattttggcaatatgacatattttggtattgtcaaaatttagtaaagtttattttagttataatctgaacagccctcaacatccagttgaactcagaatttgtaactgattaagcgcacacaaaacgtaccaccaaaattctactagtacatttcacacctaacgggcaataatgcaaccagtgcctcctcgttgccaacccaaatctccctgacagaacacgccttgaactcacctaatgatgccttctaaagtcaaatttacaactcaatggaatccacagctgatgngtnntgcagtaggagaactcaccaaaggccacg

SEQ ID NO: 3598 - DNA, 7602 bp, Oryza sativa
  unsure (1)..(7602): unsure at all n locations
tggggnnntaagctccgatcacttgtcagnagcncatcaattaatttgtgctaatctttcgccatttcaaaccaaacaaaattcgtacgtattgcgcatgtttcttactccctccgttttaaaatatttgacaccgttgactttttagcacatgtttgaccgctcgtcttattcaaaattttttgtgaaatatgttaactatatgtgtacatgaaagtatatttaataataaatcaaatgatatgaaaagaataaataattatttaaattttttgaataagacaattggtcaaacacgtacttaaaaagtcaacggtgtcaaacattttgaaacggagggagtatatgtgccactgcgcaattataccaactaagaatctccaaaaactctgatctcaactggaacatcattacaacctctgtaccaccactgaacatcacaaataaactctttgctgaacaaaacgagatggagaaatgggtagagaaaagttatgctctttatcacagaggaatttgttcgatctgtttgcttaaattcgatcggatttggaacctgaaaatcgatcgagaacaaaagctttacaacgatggcaacatggtgggacaaaggtacgcgctggttacctgcaaaattaggtagggtcggccagtcaggggagtattatcttttacgcacaccaccgaacctctacagatgatcatggccagaaaaactactcccaagatcatcaattgtagagtacatagcttgacagacagatcagcactgaaagccttggttggtagtcatacaggtcaatcatgttttcatggctgcaggcaacttctttcctatggctttcaccttggcaaacgagtcactgttaagattagttcttttgagctttttgggctgaccagtgctttgttttctactagcatgcttttttaactgataaacaatatttttaaaagaaattgtttacaagtttctttaaagaattaaatagatatttttttaaaacacttaattaattatatgctaatagctttctcggctttttttttctcaatgagctctaaagaactcagcataatcggtggaaacttctgtcagggaactttcaccgtgccactgagtcactctcatgtctgaaaattctgaatctctctctctctccctgtcttgttcttagcttctcttccttgacacaggaaactaataattcaagtatatatgcatccctctcacacatacacacacactaatgtgccaatgacaaacaaacacatctgtcctctgagacagctctaaatataacttgtttggagtgactttatctgacctgttgtatttggactagtccttataattgcattctgattcttccaatgtgtaagaagagaggaattaattcctacgggtgaagttgataattctgacgcaactaacttactagtactgtgttaatgtatacgcaagcagagattaataatatgaaaaactccgtactgtgttaattacaactccttaattctgcgagtgtaaatttagctgcaagcaagagtccatcatgtgcactctctgaccgtgcatgagtaggtacaggaccgtgcatgagtaattggactaatttatttacgttttgcttaaatctgggagctttcgtaataacaaatctctgaaatagtaaggagagaaaaaaaattgatataattaactggttcaataaaaactctcattataaaaaaaaacaaaattaggaagaacgaatctgtgttggtgaagttggttatctgcaaaaggcagatcaattatttctctccttatcatattactgttgttatacccaccaaacctgaagatgataaaatataggaacacactagaagaaccaagatgcatatcgacaaacagtgactacagatctgcaatgcagtgatgacacgttgacaccacgaccttaattttaatttctcaattattaaaatcttcaggtggcatatctataacttggatgattaattcaatatatctataataatgaaaccagttgatcaaaatgtaattaagcaggccaatcaccactgcatattgttaactccttttctgaaatcctgcatgaataatgttctcttcagtgtcaccaccatccaaccacccccaatgtctgaagaatcttagctagtcgcagtcagtctgccttaacaccgactactcccagttttcaggtacaaacaattcacatgcttaacattcttccctgctactatcagcctgtcactaacaataattaatagttgcttactaaataaatattacagcactataaagtatagcttgcttaattagctaatgagatgtgcacgcgtaatgcaatttactaacctgacgagtccacgctaaaaaagggtaacttcttggtggtagtggcatgaattgtactactgacactactagtgtactattaaggactaatcacctcattagtctatacacattctccgttttctaatgtgtgacgttaattatcgatttctgaacatagaattttactatttatcttgctaaaagaactatataagcattatttcttttgttgcgacttgttttataccacatccatcccaaaatattaggatttttagggttgaacacaattattaacaaaacagatagaattaaatagggaagattgtgattggatgcaagtgaagataagtgaggaaattgatttgtggagtgttgtaattagttgggaagagaacatggataaagatgttgttatatttttaaataaactttgaagactaaacgttactattttaggacgaatgaaatacacggctcaagtatatatgacttatattttctatatatttgtacttattttattttaaataagatgaatgatgaattgttaggtgttgacaatgtctcattaaaaacgaagggagtatttataatagaaaaaaagacagaataattaaacagagaaatgctaactataggctaattaaggagatgctaaatataggttaaatcaaggagatggctacttcacataccaaccccattagaaaagggaaaaagctctaccacgtgcatgctgcttcatcacttcatctcctacaccaaccactcccatcgcattatatccattgcttccctttcatcttaaatacttcatctgtcccacgaaaactcaacctaagaaaaaatatgatctcttttaatataacaaatttggataactaagatgtgccacatctccttctaagttaagttttttttaggacggaaggagtacagcagtagtagctacattaattatatattagcagcactcatcctctcactagctcctccttcagcttgctcgatcagctcaagctccagctgcagccatggcgaaggcggctctccagctgcttctgttactgtgcgtggcggcggtggcgtgggcgatggacgacggcggcggcggcggcgccgggatgacaaagatcaaggtgtactggcacgacgtggtggcggggccgaacccgacggcgatccgggtggcgcaggcggcgtcgacgaacgcgtcgtcgacctacttcggcgcggtggtggccatcgacgacccgctgacgagctctccggcggcggcggcggcgggggaggtggtggggcgcgcgcaggggacgtacacgttcgccgaccagagggtgatcggcctcctgatgaacatgaatttggtgttcaccgcgggcgaccacaacggcaccagcttggcgatcatggggcggaacgaggtaatgtcgccggtgaggaagatgagcgtcgtcggcggctccggcaagttccgcatggcgagggggtacgccgaggcccgcaccgtcgactccggcttcaagtccggcgagaccatcgtcgagtacaccctcttcgtcaaggcgtagctagaagatgatgagcgacatacataagcacatttatgtttgttaaacatcgtttgttgttgtaacatgcttgatttatcgattgtttatcaagcttacaataagataagcagctccgacttgctacgacggatcttaacctaaacagttgacttcactgaccaagaaagccccaaaggatcacataggagacagcttaatcggaagctttaagaggaaaagaggtccagccactacagtagtccagatcaacagtgacaggcccaaaacatcacctctgacggatttaacctttgtcaaagatgagtggtcagtgttgtctcctctcgcctctaacgggtggaggcatcctttagtgatgactatcatatgtgacgggtcgtaaaatttcactcatcacatgtgacagatcgtaaaatttcacccgtcacaggtgatattgttctctaacggactacatattatcacccatcaatgagctgcttaatagggaaaaaaatcagttcacatgttagcacccgtcacttatatgcactaatgtgaaaaagcaaaaaataaaaagttaatccttgttcatcgttgtcgtatcaacacagtgtcaaaaaactacaaacagaaaggaatcaatcatttggatctctcactgcaaactaaatgcaataaaatctcttgcggaaaaaaacatggaagatctcgatcatcacaatcacataatctcacatctcacatgaggaaccataagaaatttctgtggaaacaatactcttcggaaggggctcataaggtagacaagacctaggatggccgataggggctcgcatggctagatctggcagcttgccgacaaggattgcaactagccgccaggacctcctcctccaccgctaccaccatccgtcgtggtcttttgcaagttgaacaacaagcttggagggggcaggtggagcttggggtggaagaggcggtagccagagctcgaggatggacaggcgtccactggctcttgggggcaaaggagacgatgatcgtggcagccagagcttgaggtagaggcgtagggacgggggtgctcgtgggtgggagagatcacatgaccaataccggatccagccactacggtgttgggggcggtcaaatccagtgtccccccgacctcctgacctcaaggaggctggatatggcacccctgtggctcgatgaagaaggtggtggtgtcggtgccaaaccgagcttgtaggtgaagaggttaccgccggcgcttgggggcggccgaagctcaaggtgaaggtggtggcgatgctcgtgagtggagagaaaactcaaccaacgccgaatcgacccaccacgaggttggggccgatcagatctggcgtccccccacctggggacgccggatctggcatccctagggctcgaggatggtgtcgatagtgacaacgatggtggctgcacatactaaaaatttcttacaaatttcttagtaacaaaaatcccatacaaacttctttctaacaaaaaatcttaaccatttgatttagtcaactgaaaattgtaaaaaataataatcaagatttaaccgtaatgtgatacctcaatgtctgtaaaaagttcaaaagtgtactacctccattttagattataagactttctagcattgtccatattcatgtctagattaattaatgcatatataaatgtgggcaatactagaaagtcttataatctgaaaatatctagattcattaacacctatataaatgtgggcaatatttgaaagtcttataatctaaaatgaaagaagtagtacacatatcgttgcccgtctaattcatagacagttaatctaagttgcctcaagagcaacagctcccaatctgcaggtacaaactacacatctgcttccctgtacaaagtagcttatactactacaattagtatagtacaagaaagtaggttaattagttagctgacgagttgggcacgcatgagctcattaactaacctcatgacagcccacgctacaaaaggtcacttcttggtggtagtagctggccttcactatacggaactcccagtactaatatactaggactaatcacctcattagtctggacattaattaggtatattagttaattattaataaattaattaagcagaaaacttaattgccaaatttatactccctccgtactaaatgtttgacgccgttaacctttttaaacatgtttgaccgttcatcttattaaaaaaaatttaagtaattattaattatttttcctattatttgatttattgttaaatatacttttatgcatatatatagttttacatatttcacaaaaattttggaataagacgaacgataaatatattttaaaaagtcaacggtgataaatatttagcaatgaagtgagtactataattaagtactgcttggccaccacttctcacctcacctaccgaccccattagaaaaggcaacctgcatatgcttgctctgccacatccactctatctcactgaatttcatcatctcctacaccaaccactctccaatctccatttcttgcttcataagtactcgatctctcactagctctagctacctcctccctcctcctcatcttgctcagctccggccatggcggcgtcaccggctttcctcgttcttgccgtgcttctgtgcgcggtcgctgtggtggcgctggcggcggacgagggtgccgcggggatgaccaagttcaaggtgtactttcacgacgtggtgggcgggacgaaaccgacggcgatcagggtggcgcatgcggcgttgacgaacggctcctccacctttttttgcgccgtggtggccatcgacgacccgctgacgaccgacgcggcgtcgtcctcgtcggaggtggggcgcgcccaggggagctacacgttcgccgaccagaagacgttcggcctcctcatgaacatgaacttcgcgttcaccgccggcgaccacaaggggagcaccctcgccatcgtcggccggaacgaggtgctctcggcggtgagggagatgagcatcgtcggcggctcccgcaagttccgcatggcgaggggctacgtcgaggcccgcaccgtctactccggcgccaacttcggcgagaccatcggcgagtacaccgtcttcgtcaaggcgttgagaagagagatctacctgcaaattaaaacgctactggcaattattgagcgccgtgtttgtacgtgcttaattaattgattaggcttttcattccgagtgcattaaatattgtttatcatcatctttggttgattttccgattgggtttcagttgatctaattggagggcgaatcgattttggttgaataaattgaataggtcgatttataagtgtttggtagagtacggaattaactaattaattagctagtcaatggaagaacaattcaaggtgggagtaggaatactaataaacttattaagagtaatagaattattgaagaatacttcaatggagtaggattcgattcgttgggttgtccgtgtccagattcttttgtgggggggggggggggggggttcacttttttaatccccaatttttcggatcctcggtatatagcctggctctgttatctggggccctttgttcattcgtcacttccatcctctccttccc

SEQ ID NO: 3599 - DNA, 3588 bp, Oryza sativa
  unsure (1)..(3588): unsure at all n locations
aagacgaaatttccactgccaaacacatggtttgtttatggcaaaaccgtgtctttaatctccgcgactcaaatttattagggattggagtcaaacatttttttaaggctcaccgtattaactactccctccgtactggtaaaggaagtcgttttggacagcgatatggtctccaaaacataactttgacttcttgtttctataaataaatatttaaaaatgatatatgtatacttatgaaagtatttttcaagagaaatctattcatataatttttacattttcaaactcaacaacttgaaagttattcatgatttatattctcaaggattgacttaaatattatcctaaacgactttttttacgagtacggagggagtatattaccgtacattctttttttctacggtgccatacattcttttttagaaaaaagatacaaatgttcataaagacgcgcacactcacttctacgaatccacacatgtacaccttacccatatgaacacctctggaagattagatcagtatatcttgtgatcagggtttttaattttgaaatttgttttttttgccgcaggagggggggcggaccaaaatttcgaaaactttgaaattttgaatgaatttgaataaaatttgatcaaattgacaaaaaactgtaaaaacccaaaaatttcggacgagatatgagcttgccgaaggggacgaaattaccaaaaattcgaaaatttcgaaacaaaatttcaaaccctgcttgtgattgacaaagtcaccacgagtatctccctatcgatggatatatcacctatcaccgaaagcgtaattagtcgtaaatacaaacatcaattctatgacttaaatctgattggactggttttaacccaaggaacctaagtaacaaattaagctaccctcacttcgcattgtcatacggatttaatcctacgcgccatcttatttgtgaccatagacacgtactgcaatgctctaaaacttgggctacatgggccattttttgggccactctcacacacgaaaggaaattattgcacagaaaagtccacttgaaatccctcaacaattggtcgagtttaattgcgtccgtcaaacagaaattaaaaccggatataaaaggtccccaacttttaattactagtatatgggtacgttgactaggtccatcgatctgtattgacgtagagcgctcacatgtcacatggcagctcccctgaacctgaagagatatgtgggacccaggtgtcagcatcctcaccaccttttcctaatttcttcacaccggcgtgcgacgagctcgatctagagctcacccggccggcggtggcggtggcgatggtggacggacgtcgagccccagcagcaagttgtcggtgagagcagctggaagctaggcgagttgaagccagtgacggacgcagcagcgcggagaggagcacgccggccgctcgatccgtgcgtacgtacgtgcgatgccgtcgagtcgtctaagaccatggcgacgccgctgtgcaggtttggcaggggcgatcttctgttctatcgggattagggaagacgtacgcgcgcccgtccgtcgccatgccatgccatcaatttcagtccgaaatttctcccagagggaaagctgtcgtgaccgacgtcctgcatgctcatcctggggggtgcgccgccgccgacggtctgcatgcctctccgtgaccgacacaacaactgccttcttcttcgtccccgttgtcatacgcacgttggtgaaggtcgttgggaacgaccagctcctccaatgccatcaccacgcatcttccgatgtcgttcctgcttttgcactctgggattacatcggttaaggatcaggagagagatacggggagaaaacagggtagacatgtttttttttatagtgatatgttgtcacgtactccctccgtccaaaaaaaacaaaccctgggtttccgtatctaacgtttgaccgttcgtcttatttaaaaaaaattaaaaagacaagtcacgcataaagcattaatcatgttttatcatctaacaacaatgaaaatactaattatacaaaaatttcatataagatggacaatcaaacgttggacacggaaacctagctagggtttgtctttttttttttggacggaggaagtaggtgcatagagcctaagtcaacatatcatattggacgaaaccactgagagatccgatttactctggtttaatagatgggggatactctctatccggttttgtggttgggaggctctgcactcagataaaagccgatcgatagtttttgaagacaaaataattgaacttcgtccaaaactcatgttcctcatctgcatgcatggatcacgttgacacgtaaatctgagcttttttggaattttttttcatttttaaatttttattttttaatatttacagaaatattataccggcgaaaagttgtacagaagtagatcctgccgccctacctgagggcggtagggtgacgcgaggaacggacaagatgaaaataaaaactagaaaaatacattttttggcagggtaaaaattgcatttgcccacttgcaacctttgcagagggcagcaaaggacctcaatgcaaaatacgcataccttgtcaccctccacttgggtggcaggggccatttctgtaaatattttggatgatataatatttctgtaaatattaaaaaatacaaattttaaaatgaaaaaaaatcagcattttcatcgatcgcgctgggccaaaaaggatttaagcccatccggcgaggtgaattattgagaaacgggtaattaacctgttggactgggctgatatattctcgaatgcgcctttattttgtgaaataagtccattttacctccctcatctcttgcgcttgtgtgaataacatctctcaaccggaaaaccgggtataacgcctcctccatctccgaaaaccagaacaaatcacctccctcggttgttttgctggtggtttcgtctgacgtggcgttgttgacccggctgacaagctgactcagcgtggtgggacccacatgtcagtgtgtagctatctctctctcccctggcctttctcttcaccccggtgcggctcgtcgacgtgagtcgggcgcaaggcggccgggcggtgtgttgcgacgcagagaggtagccgtgtggcggcggtgatgcgggagagcgcacggcggcgagcggcgcgtacggtgtgctggtcggctacgggcggcggggcacgcggcgacctggcacgggtaaggcagatggcagcagatggcgaggccgggcacggcacgtggcgacctggcacggcctgatgacggcggcacgacgcggttggccggcggggctcagcaacgggcggcgggggaggggtgcagccggcgacgggcgaagatgttaaatgacatgataagggttcggttgattcagctgaagataggccttgcgccacatgtgatattgatccggtagttagaatagatagggtttgttttgattgttatcacatgcaggntggtttctagatttgaaggatctgttttcttgtagcg

SEQ ID NO: 3600 - DNA, 2317 bp, Oryza sativa
  unsure (1)..(2317): unsure at all n locations
cctttccccatggtatcagagctctgatccgttccttgcgatcagtctccaatggcgttgtcgtctagctcgacgaactccatatcactttcaggcccccttgatcacaaagaagctcgggaagccaaatcatgccctttggaaggtacaaatcagtgctgccgtcagaggagcacggcttcaaggccatctgactggtgcgacgaagaagccaccggcgaagatcagcgtcacggtagatggcgccacaaacaagacggcgaacccggtgtacgacgactgggaagccactgatcaacaagttctgggcttccttctctcgtccttgacgagggatgtgctcatgcaggtttcaacctgtgaaactgcagccgaggcttggagcgccattgaggggatgtattccactcatactcgcgccaggtgcatcaacacgcgcttcgctctcaccaacacgaagaaaggtaacatgacaactcctgagtatttcgctaaaatgaaatctctaggagatgagatggcaattgctggaggccgccccatcgatgaggaagaattgatccagtatatcatcactggactcggagaaggctacagtgaggtcatctcagctatctgcgcaagggtagagcccatctctgtaagtgatctgtattcataggttctcaacttcgaagcacgacaagccatttatagtggaacgcaagaggtcaatcttgcgaaccgcggcaacttcagccaaggtgggcacagcgacaacagcagccgtggccgcggcaatccgggaggtggtcgtggtcgcggcaacccaggaggaggacgaggtcgcggtcgcacgtctggaggaggcgttgacaagaggcccatctgtcaattgtgcttcaaacgaggacacacaactaccgactgctggtgtaggtatgatgaagattttgtccctaacaataagcatgttgcaacagcggctaccagctcctatggtgtagacacaaattggtacatcgacatgggtgccactgatcatattactggggagctggacaagcttactgtcaaggaaaaatacaacggaggagaacaaattcacaccgcaagcggagcaggtatggatataagccacattggtcatactgttgttcattcccctagtagaaatattcatctaaagaatattttatatgttccacaaaccaagaaaagtctcatttctgtacaccgcttagtagatgataactcagctttccttgaattacatcgtgattatttctttcttaaggatcgaatcaccaggagaacgcttcttagtgggaggtcttggcgccgactctatcccttgccgcaatcatccttgaaggaagcctacaatgtcgtgaaaccctcactagagcggtggcatagtcgtttgggtcatccatctatccctattgttaaacaagtcgtcaataaatttagccttccttgtttagatgcttcaaatgagtcagtttgtaatgcttgtcaacaagcaaagagtcatcaattaccttttcctgtgtcaacaagtgtctctcagcatcctttagaacttgttttttttatgtatggggccctgctccagaatctgttgggagaaagaaatattatgttagttttattgatgacttcagtaaatttacttggatctatcttttacagtacaaatctcaagtgcttgaaaagtttcaagaatttcaggccatggtagaacgtacatttgatagaaaaatcttggctatgcaaactgactggggaggtgaatatcagtctctcaattctttctttactaaaatcgggatagttcatcatgtatcatgtcctcatacacatcaacagaacgggtctgctgaacgcaaacaccgtcatatagttgaagtagctctctctcttttgtctcatgcgactatgcctttaaaattttgggatgaagctgtgcaggctgccacctatctcatcaacagagttcctagcagagttatccaaaatatgagtcctcttgaaaaattgcatcatcagaaacctgattacacctccttgagagtgcttggttgtgcctgctggccaaatctccgtccctacaataaccataaactccaatttcgatctaagcggtgtgtcttccttgggtttagtaatatgcacaaagggttcaagtgcttagaggtgtccactggccgtgtctatatttctcgtaatgttgtttttgatgaaacaatatttcctttttctgagcttcatgccaatgccggcgctcgtcttaggtctgntgnngnngtgtcccgatgttcgtacttnntacccc

SEQ ID NO: 3601 - DNA, 1835 bp, Oryza sativa
  unsure (1)..(1835): unsure at all n locations
acgcccatgagtggattccccnnctactgcaagnagntcatcagtgcctcaggaccacgttagacctcgcatcaggttgcaaagtggggttcgcaaagaaaaggtatacactgatggcactattaaatacaaaaactcctggtttactgagtctggtgaacctactactgatatagaagcattaaaggataaaaattggaaactagcaatggatgctgaatatgaagctctagtaaagaataaaacctgacacctagttccacctcagagagggaagaatgtcataggttgtaagtgggtttataaaattaagaggaaagctgatggtactctagacagatataaagctagactagtagcaaaaggttttaagcaaagatatggcattgactatgaggatacctttagtctagttgttaaagctgctaccattagaattattttgtctttagctgtgtctagaggatggagtcttagacagctagatgtacaaaatgctttccttcatggttatcttgaagaagaagtgtatatgcaacaaccacctggatttgaggatccaactaaaccacagtttgtctataaacttgacaaggccctatatggactaaaacaggctcctcgagcatggtttgcaaggttaagtaaaaagttgactgatcttggttttagtggttccaaggctgataccttgttgttctttctgaatagaggtggtgtcactatatttgttctagtatatgttgatgacattattgtagccagttcttcagagagggcaactgcagctctgcttcaagacctgaaaggggagtttgccctaaaagatctaggtgagttgcattattttcttggtatagaagtgagcaaggttgagaatggtattgtcttgacacaagacaaatatgccaatgatctattgaaaagggttggtatgtcagattgcaaacattcaaacactcctatgacagtaagtgataaactctctctgcatgaaggatctcttttgggagatagtgatgctacccagtataggagtatcgttggtgctcttcaatatttaacccttactagacctgacatagccttttctgttaacaaagtctgtcaattattgcatgcacctacaactgtacattgggtagcagttaaaaggatacttaggtatctcaaacaatgtacatgtttaggacttaagatccataagtcaggttctactctagttagtggtttctctgatgcggattgggctggtagtttggatgacaggagatccacaggtgggtttgctgtgtttctggggtcaaatctagtatcttggagtgctagaaaacaagccacggtatctagatccagcacaaaatctgagtacaaggcaattgcaaatgcaacagcagaaattatgtgggtacaaactcttcttgcagaattggggattaaaagtcctcaagcagcaatgatctggtgcgataatcttggagcaaaatatttatcagcaaatccggtgtttcatgctagaactaaacatattgaagtagactatcacttcgtcagagaaagggtaagtcataaacttttagagattgattttgtttcctctggtgatcaagttgcagatggttttacatatccgttgtcagaatggttcctggncnggtggtgnngtncaaaggagntagtcaatncaccgacatggggggggggagagttagtgtatatcccgagacatataggaaaacagaccgtttatatataaccgcgtcactntttattataaacgtgtcatttgtagatcacacaccactgtttatgtaacggaccacttattaacatag

SEQ ID NO: 3602 - DNA, 5905 bp, Oryza sativa
  unsure (1)..(5905): unsure at all n locations
cctgggtttganttncgagtggattcccgtccttctgcaagnagntcatcacatggatgtttcctagctttgagggatctgtttccttgaagcgatatatgtaaaagccacgatgggggctattcccatctgatcaacacgcatccagcgcacaggactcgtgctgctgtttctcccagaaactttccacaggatagaaccagaggtgggcaacccccggcggtggccctcgttggcggcagcggcgctcgctagcgacaaacggggaagtagactggcggagaggagctgggcattggcggcggggagacgggaagggggtggcggccggcggggagaggcgccagcgacgaatgccgcgtcagcggcagcgaccgctttcacgccgatatcgtatatcctcgctgcgctcgacgcggacatccacgatggcgtacgcgtcctctccatcttctccggccacgacgccggaaaccacctcgccagaatccaagcattaaaccgtcgccacgcaattctaccaagccacctacatgctgctcgtgatgacagccaccacattggaagccatcattgcggcggaaccatgcgcactcgccggtgacgaatacacgcagcttctccaagccgccttcgcctgggccctgccgatggacggccggagccacggccggccgcccgcccgccgctgccacatgacctcatgataccatcttcgtccgccaccacacgacatcctcggcgcgtcgacctcatgatacgttgccaaagaaggggcctgtgtgacaagcagcgccggcgacaaactgcagcagcacacatgcatctacatatacaagactcagcatgcaacaggagcaacaagaaacaaagaagagaagaagtgaaaaaaagaaaagggggatgatccggccagccgtcacacctccctagccacatcgccgtccacgccgcgcccgcatcgccggccgttggccttgccggcggccgccgcgcaccacgccgcaaaggcctccgtgacctgcgtcgcgtccgcgaaatggctgtgccaggccaccatcgaccacgcctcgccgccgcacggccgagccccgccggccaaccgcgtcgtgccaccgccgtgcgctctcccgcatcactgccgccgcacggctacctctctccgtcgcaacgcgccgcccggccaccttgcgcctgacccacgtcgacgagccgcactgtgtgaagagaaaggccggggaagagagagataagggagagagagcgcgctacacactgacatgtgagtcccaccacgctgagtcagcttgtcagccaggtcaacaatgccacgtcggacgaaaccgccagcaaaaccaccgagggaggtgatttgctctggttttcagagatgaaggaggcgttatacacggttttccggttgagggatgttattcacacaagcgcaagagatgagggaggcaaaatggacttattccttaattcgctcttcttttaaattgggccttccagttccaggcatgggcttatacaatctatgtataaatcagcctccctgaatttggttgcttcactgcacgagtgagttttatgaacaaagccacttttcattttctttatattgtactgtagacacatacacacatcgctacacacgtagcactacactttacatacattcgccaatgcgcctctaacacatattttaagaaacagatcactagcgacatattatatccccaatctcactaaaatcctgttaaaacctagctcacttgcatgtgcgtacgtaatggtggatagagtcatacacccaaaactccaccaccacacctgtttttccaacacctttttatttctgaccatcttacccacatatatgtgccataattattcatattttcgatctattttatactcacgtccacacatcgtttcaatacatgttttattttaggatggagcgagcatatcttaacaacgcgtgttatgccatcaagccacgtgcatattggatgcgtaggtagtactaggtacatatgtacagttgcttttgttgaattattaggtagaattaatcaatcaatcaagtattgcagtgtggccacacgaacgagtttttgacaaatcaccaatggatttccttttcctcacgagagtgcatatgtaggtcttgtctcatgtgtatatataacgacacgctagcttggagtctccattgatttctccatatatggatatatgcgtcagtcaaattatacatgcggccgtacgtgcagatgtcgtcgttttccataggtttcttatactttgactttaattaatttctctcgtttgaaacgtggaaaattgtatcaatgtctatatgcaattatattaaacgtggaggctacactcatatacgggattgtaatgtgtacactaattcacagtttgcatactcatttaaataaagaaaattaattagcttttatatatgattcttttaagatggaaagacgaagggtatatagcacatacatgcaagctaggataatgggtgctaattaaatttagttaagccaattacgaacggagaataaggttgacatggttcccgatgtttttttttagagctgggccatccctagttacataacatttgtgaattttgatgtgtgattacgtcgataatattttgataaataattttatacccattttaaatgaaataatttaatttttttaaacgctatgtaatttaacatacagattttaaatttaccgtggatctaacttctagatgcgttgtgtgctaacaaacgaatttgcctccctttttgactggtcgtaagtgggatatatatacaacagcgtgtgtaacaaaaatagaccacttaatttggctaatcttggtagtaagtaccaaatgatttgatccaacacgcatgtgcattcatgtgtagtttcttaattggtgcatctctgagtcagacatagaaactaactaactaataatgcattataatcagaaacttcccagctactcgcatgatgatcggactttaattagctggtccacacatgatgcaaataacaaatgggttagtgaaataatggtggaaatgatagccttgtcacaatcaaggctaagcatagagagatagaggggggaatgtggttacagtaacgtagaaaattgcagaatgtgccatgaagcatattgataagcaatatatattatcaatttgtttctactccctctatctctaaatgtttgacgccgttgatttttttaaatatgtttgaccgtttgtcttattaaaaaaaagttattattattttttttcctatcatttgatttattatatatatacttttatgtatacatatagttttacatatttcacaaaagtttttgaataagacgaacggtcaaacatatttagaaaagtcaacggcatcaaacatttagggaaggagagagtataattgattgcccgtgtgttcacttgtgatgtaaaaaacagcaaacgatgaatccatcagacctttctatgaggaatctgatgccgaataattaagagatagtagcatgttgaaggttgaacacacgaaatcttggggtccatggtttattaatttatttttaatgaaaacgaggttccaggaattaaaactttgtagtagtacaattcttttggttaatgtggaattattaatatatattgtcgagtataagaaagtttcactataagagtgatgcaatgttccaaagtatgcaagtgcataagataaaaagacaagctaatagagtagctcatactcttgttaaagtggctatgaattcgagatcttgtgaggagtggatgttgtgtgctccagcaagtatatatcctagatttgctaaatcaggaatgtaatctctattttccttggttaataaagctctctctttaacttaaaaaaataattaatgatgaccgatcattattttggcaaaagagcgtgtatttgaacagataattaatataccaagctaggctgggtcctagcttaagctagcagctatatctatggtttgtacgaacagatgaacacacggctaatggtgttcagccttactgatggaaaggctcatccactatatagatagcactatctgaactataatggcagcagcaatgagttctttcacgctatccatctcgatgatggagaggaggccggccggcctgccggcgccggtgcatgtcagccgctgcagcagacatgaaattgagtgcgggaaactattctaaactcttgaggggatatttcctcgttgtttgcatgtcacttaaatggttataatttttttaaaaaaaatcaagaagatgtattaatatgtgctatatcactctacaaattaacatacaagttaaaattcaatttctacatatcgcaatgaaaaaaaaacaaatttaactacagttagttattcaaagtcaaatttatttttttttcgttgtgacatgtagaagctaaattttaactgacatgtttaaaaaaaaatttttaaaaaaattatttataactatttgagtgacatgcaaataacgagcagatatccactctcattgagtgctcatcctcgttccttccagccttctgttgggtgggcatttttttttatggtggactgtgagacatgcactgatcaagctagaggcgcacgttcttgcactgataggtacgtacacccattaatttgatttctctttcacttgtctcatgtgtatgagtagcttgtacaatcacatgtagcttgtacaatgtactatagttattgttgaatgttgacgattatatttatacggaattttaggaactgcgtaccatatcaagaatagtgcgggtgtgcagtggcagaatggcaggagcattagctggcacgtgtctttaaaatatagatgggacggagctgctcgtatgataagataaaatataactgaatacaatacataccgcatttatattataatagtataaaagcatagtacaactaatatattaaagtataaaagaacttcaataattgtacgaccttttattttaaaatgaagcaattaataagctttgcatcatatagttcacagcaaaatgataaaatgcatggcagaagaaggcgaccgatcgacattgaggctagatgggcgtcatcatactgtgtgaacttttgaaaacgaactgtccaactccatcaatggcacgcatcgaaatttggaagatgagatgtcgatcggatattcattgtgactagcattgacaataggtttgttgctgttttctctcatactttccttcttaattattcccaatgtctcaaattataaaggcatgcacacattttaaaattcaaacttcattaatctcgaataacaataattagtcaaaacatatttataggtttagtgatataaataggtattgttagatttatatttggatttcatataatgttgatttcaattcagataatgctcatatataatatatactctgaccaagctccttatggtcgtctatgggtgggaatatatagctccctccattgaaaagcctcctaaatatttcttttaattataaccgagaccatggaatcttaactctgatataaccgagacagctagctctagccgatcgtatatacatttcgctatccttaattagcttatactagtaagttgtaacagtactttctccattctagaattaatgtattaaaaaaagtaggtgaaaagattaaagaagttataagaaacgaggtgaataaattaaatgaaaaataattatgtttgatttagaataagggaacgtggagaaatagctttattttaaaataagttaccgttagaaatgactacattttgaaatgatgtaatat

SEQ ID NO: 3603 - DNA, 3798 bp, Oryza sativa
  unsure (1)..(3798): unsure at all n locations
naacgagagaagagagaaacaacattaaatacacttagtgaggatgaactatataaatatataggatactcctacatttactatggctaattatgatgttgttgccactactagaaaaatcatttattgccacgaaagaaatcgtggcatcaatactaaaattgtggtaatagatacatgttgccacaattgtaaaatcgttgctagccgtggtaataaacaacgtggtaataggttattgcaacgatttttattttgtggtaataaatttagatgttgccacggaatggatgtggcaaaaagtcatattgcaacacttcacagcgttgtaataaaaattattgccaccactccatatgtggcattagttttacgtaccaaattaaaagtttaaatattaatctatcatcctatctatttgtatacttatttttttgattttgtgtcttggctaagattcaaacccaaacctatccttcacgcgtgctctcctttaccaactcatctacgtatcaattttgttggaaaatgcatatcgttccatttgagcctagctaaatgagatttgaatcatagatttgaatatctaaaagatttcaaatgaaaaagttatcacctataaaattgtagatctcgtcgagagctataatttccatataaaatttgtctcaatccgtgtccatatgaaaaaattaagttaaattatgagacgacaatctttttattgcaacgaatttgttgatcgtggcaacaaaaaatagtgaaaagtaccatgtactatataaattgccacaaaaattaaaattgtggcgatagaacatgttttttttgcaacagtacgattttttgtggcgatatcttattttctattgcaacaaaagtacgaaataaaacaacgattatagatcgttgcaataaaaaataattatttgccacagaaaaattatcattgcaatagtataatatattgctacgaattatttttttgttgcaataatttggtggcaatagctcaattatcttgtagtgtgcttcgtacgcatttgatccctaacagaaacaacgaaattatatgaagtactctatcagttctaaaataaataaaatatgatatattctctgtctatattcataatactataatgtgtcactttcataataaatttgtttattttaaaatgaaaaggttagtatatatagtacttaatatgcagccagccgtaggtagtgatggtatgtaagcctatcctgaaagatgtatatataaaagctaaaacaaaaccgcagctgaaaattcaacgctcactttagctacacacgctgggggagtaggctgtcaaattgcagcattatcattatcttttgggatctatcgatctatctatccatatatctatatatattttttgatctcctatatattaattactatggcaagcaaaaactcctccactacttctaacagcgacagatgctacacatatactccctccgttaatataagggattttgagtttttacttgtaacatttaaccactcgtcttattaaaaaattttgaaattattatttattattttattatctacagtactttaagcacaaattttcattttttatatttgcaaaaaaaatttgaataagacgagtaaaaaaatttaaataagacgagtggtcaaacgttgcaagcaaatactcaaaatctcttatattgtgggacggggggagtataaaactccacttcctttacatgcagatataaacatgtacgcatgcatatttagttcaagaaagaaaataaaatctatactatccagacacacaggatcaattggttagattccttgtgataaaaccatcctatccgaaataaagttataaacttaacacgggtggtcgcacacacacgtttacaactaattatttttttaagtggtagttaagtgacatatctgttgctaccgaagtatccgtttatgatgactttatcaatcttaaaatataccggtacagtattttggaggtgctcataaaacataaaaaacctatagctaagccaaaagaaaaaaaaagaagcaaatatatgtatacagttgatcgatcgtgttgcacggaaagttcgaaacttaattaaagacgcacccactaaattcggcagtatacatatacaaatcgtccacaatgtacatgcgtgtacactgggcctacctatacgacctgcactttgttagtattatatattgaagaaagttgtacgactagtgtacgtatgcgacaacgcagcggccaccacacagctggagtatatatacgaaatgtaggaattaacgtacgcctacgtcagcatccaattaaattcatccgagacgaagaagcggatgccggcgccggtggatcccgaaccgccacggcgccagctgtccacggcgggggcggcgggtggtctggtcagtgcggtgctttccgcgtgtcgtccccgccggcatttggagctgccggtgtggtcgcgcgttgcaccagtggtgccaggagagggaaatcattgattacatctgtttgttggttctggtaggtaactgaaacaaatgctatttgcaaggtctgtgaaggtcaagtataggctaacgacatggtgtgagatttaggtttagtgtagtgcaaaaaataaagttttgtgacgtgagcatttatattgatagttgttatagaggctaaaagctaatcacaacatatatgcagattgtggacagtcctaaatagcaaaatgtgtcacatgtttgatggcaggatagacaggacatagtagttttatagtggtagcattgaaacagttctgctagatgagcacataggagtataggactataaaactatattacacatggctaaattctactaatatggtttggatgccttcaccgaattcacacaggggcccttttgttgatgtgcaaatggaagtgcaatattttttgctatgatgaattgcttcccccgtgtacatagctgcctgagaagtgatgcaaaaatacaattttttttatcaatactggcagtcaataatcttatggcattgaactactcaacaatattagaacaattaagcatccttgtttcctagtaatgttctttttctgaatgtgaaaaaagcaagttaacatagttgttttttggtatatattcagattgtaagaatcaaagaagcaattgccgatgtcaagtaatctgtgaatgaattaactgaaggaccaccagcaggtacaaatttagcccaatgtgaggaaattaattaaacatctcaaatagcagggggggcacaaaaaggtaccaaccaaaagcaaagtaatgatttatccatactaaaaaaacaaacaggtaaacaatccaaactgttttcagtaattttctaataatcaggtatgtgaaccaaataatgcacacagcagcatatttattcagcaaagaaagttggaatggacggtattgtaggattgtaaaggtcaatatgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagttagtcaaataatacataacttagttaaaatgggattttaacctacagggcagcgctcatcgtcataaactgaagttttatcatcctaccccagtagttatatcatcaagagtcctgaaaagccacttctatggcaagagcaaat

SEQ ID NO: 3604 - DNA, 2728 bp, Oryza sativa
  unsure (1)..(2728): unsure at all n locations
agaaaagtgacccattcttcagctattacctgccaacagaattcttgttcacaaacaaccaaattatagaactaatatatgcctatttggtaaacagataatcaactaaattttcacttccgtaaagaacatgtcaaatataatttaaacggtgaactcaaggtaggcaacgaacaacgatcagccaaactggttgccagtggtgccatttctcctcgtggaggatggcaccaatgcaggcatcctttgttctgatctactatgttgtgtgcacctggagtcttggcgtgttaaggcaggcatcagcctatcatagcctagttttactactgaaaccattgcaccagctaaagcctacaagaataagagaagtggacagctatgccagtcctttgatcttgcaccaatccatcatgttttctttggttcttctaatattattcgcaaagcaataatgtaatccattgtaatgcagcagctgattggcgttgggaagattagatagcttagaatagaattgaagctatagatggattgtgcaacaaattgagataaattgattttctattgttaggcgccggccctaagtggcatagcgcgtagctgtgctcgacgggagggcgaggacgcacgcctcacctccccggagccgtggtggaaactaacaggaactgggattaacttctttcttgattaatcacttaaaccgaatggcctatataggcttacaatggaaaaccaaacagctactaaccaggaactaacaacttaatcttcctaacaaacttaatcactgaaactaatcctaacaacttgatccaacatcacggcgcctgctctggctgttggcgtcggttccggcgctgatactgaatgccccacataacatctatagtgcaaaaagagcagacacatagcgagctttagtaatcacatccaaaaataatacagagaaaattacagttcattaatttatttttggtgcaacagtaatatacagttctgatccagacctatataacctttatcaaatgcacttgtatatttttggtacaacagtaatatatagcagcagtagtagtgattagtgtgattagtgtatacgtttagtctcagattctgcatgtaaaagatcatctaatgtcaagttacaaacatgctcgttataaattaattttatagaagtcactaccttcaaggggcataattagtaatgaacaaactaaaaatgcaaagccacaatctattttgatgaagatgcatgactacatttggatggagcattatcaaattattatccacaaaaaatattgtacattgctatattttgctggaacaaatcagcatactcatacttcaacaaaagatatatcaatttcttatacttggaaacaaagaatcttatgcattaactcatttgtaatttaaagtcatcagcatgctacaatggatcgtagatgaaccccttaaagaaatgcacagccaaattgacagcaacactaccaaagcaaagctcgccgccatcaaagtggggtcatattcggtggagatgcaacctggttgtggtggcagatgaccttagatgctgtgccagaggaccagtagggcagcacggccgtgacgcaaggggatggaggtggcagcatcctctaggaaccccgcgccgatgcccttctctgctttgcgtaagctcaacaaagcttcactacaagctgcattcacacgctcacattcatagtgttacactgatttaaacttgcaaagaaaaattcaatacacatatcttcatcggtccaaattaatcacagtatcacactaagaccaccaacttgacaaagatataacatgcagtatgaaattccagaggaaacttttctctcctcacctccttccaaaaaggcagaagaagaggtaggatggagctgacgaggagccctccatgcggcagatccagcagcacccgccgtactggagaccgccgctgtccgaaacgggacaccaatgccacagatcatgcagctccctctccaaatcggttcaccgacctcctggatccagtgattccccgtctcctcgacgtcccacacgcacgtccgtggccgcctaatcgcaggcatccgctgatccggaaatgaacaggatggagagggagagggagagggagagaggggcagtgccgggcatagaggtagaagagtagaaggcggctcctagcttcccctcgctttagggctgccggatctgccggcgaggaggccggagtcaccggatccgacagtcccggcctcctcgttggcggatgcggcgcgggagcgagaggatggtgatggcaggacgacggcgcggcgacagcaacagctcgcagtagggagtgcgcgggggaggtcgccaactgcgggaagaagaggatgaggggacggcacgcggcggcggccgtcgcttgggcaggagagagagcggagcgagaggagaggaggcagaggaatggtggcggctagggtttggggaaaggggtgagggttgcaaaaacaacccctaaacttctagttttcagagcgcggttcaattttccgttttttcgcttcttcatatagaatattgttttcttaagaggtcctctaagtaagagcgcacaacgttagaactaaggaccagggatctataacaaattatcaagtaaatgtnntgggcgnctgtgtcnaagtcccttcaggtantcaagggccca

SEQ ID NO: 3605 - DNA, 1827 bp, Oryza sativa
  unsure (1)..(1827): unsure at all n locations
cgcagatgattctgtggcacacacctcatcagngtacagtgcttactggatttgtgagcatctttgctttatcccagcatgcatgcatgatgaaaatgaactgtacacatcacatatgtttaattttgccggccccaggaatatgtaagcagtgcagttttggaaataggaattttttccatctttctatgtatgatgcaccacaaaatttggttgcaagggataataagatgccagttgataatatattgaagtgacttggtaaaatcatgctaaatcttcattcatgcatgtatatatgcatatatgccatattcttcatctccttaattattgtaacgatcctagctactccctccgtcccataaaaactcaatctagaattatgatgatacataatctagtataacgaatctagacagactgcttacatctatatttgatgggctagattatgttacatctcaattctatgttggtttcttttttagacggaggggagtatatatactttaacaaggatccttctattcatgcagtgtaacagaacttcttttaaaaaacaaccaaatttttagatggcagcaaattaaaggcgcttaagctaacttgtctagatttctctaatttttattaaataaataagaaaatattagtttggattcgtttttcttgaaaaagagaatagacaaatagctgttcatattcaattaagaagaattagtagcatatatataaatggcttagccaattagcttaacaaaaagtgaaagcctccgtaacaattgaattttggcatattttcatatgagccaattaacttgattcctgcagacaaagcggctactcaaagacagaaagaccaaagatcactactatgaaacaagtttttgtaggatgccaaaacaagtttctgtaggatgccaaaacaagtttctgtaagtgactagacgactcacctatgaccaaaagcatgtgaaaatcgatgatcttcacatggcaggcttcacccgcctgagaaaacaggtaggttaagttgaccatccacagtgatttattttagctagaaaaaataaaaatacaattgaaaaaaaaacatatgcagttccataacaaacagagagaatacatcacaatttcatcatggatttctaaatcatcgatcatatcacaaattcacaatgtcttgacagcagagagaatacatcatagagaagtggaggttgtacatgcgtgggcctgctagaaccaatgctgtaggtaggggcgagagacgatgaccagcccatcaagccccatatattggtggtggcatgcaccgacccggccttcccgccggtggatttaggtcacaccactaacaacagccatcgtgttagcattgagctatatgaccttcggcagatctggtgcccgccaccaagctatagccctcgccaccctcttagacgccccgaagcggttgccatctccttcccgagctccagctggatgagattgcctctcccctttgactcgaccgccgctcctcccctttgcactcgccgcagttgttgagccctctccaccgaatctagtggccttgatcgggccagcgcggtcgtcagggtcctcgtcatggctgccccattctccccttacccagtttccaacaccgccaccttggacctgatcgtcgagagagggattgagccacacccctttgccgctattgttgccccttcatgccctttggagtcaccggatttgacactcacgaatgtcgtgttaccgccacactagatccggcttcttaaacaaaaaccctttccttccttttaccacccc

SEQ ID NO: 3606 - DNA, 2010 bp, Oryza sativa
  unsure (1)..(2010): unsure at all n locations
tttctgtgcagtcggaatcggtttttacatgcggatcttccacccgtctggaatgaggtgtctacgaaaatcgcgattttcgcatgtgggtgacgcacccgcgcgcaaaaatcgcgattttcacgtgcaggcactttagtcgtctgcatgggaaaataaaaaatcaaaacaaaaaaaaaaatcaaaaacgccgtcaccgccatcgtcgccgtcaccactatcgttgccatcaccaccgtcgtcatcgccgccttgcccgaggcccgccgtcgtcgtcccggtggttgccagtgacggatccggcctccctgcggtggccagcgacggatctagcctccccgcggtcgccggcgacggatccgctccgccgcccccaccatggctgatgccgcactcgcctccgccgctgcctccgctgctccaacccgatgccgccacctccgccgccctagccgaggccgccaccgctgccgttgccgggagatgggaggaggagggtgaaagggagagggaggaggtgggtgtggcacgtagaaggatatgggaggagtgggtgtgggacgaagagggcgatgggatctgagaggaagatggaaggagtgggtgtgggccggcgacgccgggattaaaaggtgggtggctatttttgtgtgcaagtcacttgatatgtccacacgcgaaaataagcctatttttgcgtgtagacctgttaagtggcccgcctgcgaaaattgatttttccgtgcggtcattttaaacagccgcaagcgaaaatagaacacgatttttacagacgcgaccacttacggttcatctgcaatctaaaatgactcctgtacgaaaaatcattcctgtagtagtgagcgcctataaaaatatagttatttttgcagacaactctcctagcctaaccacctataaagatcgacttctacatgtgtgtatttttttatgccgtctgcaaaaataaaaaggggtgttgtgaaaattggttttttttaagtggtggatacatttttgcaaatgctacacaataaatgaaattaatataaataaagtaacaagttgccaacaagaagaagtaatgccaattttcaattttcacaattgctgttgccagaccttcactcatgagagctgaacacatccaaaatggtgttccccgatctacagcttgctgcaataaaccactttgcataaataagaaaaaggaatccatgcaagatccaaataaaccagaagtgtagaaacaaaattaattaattaagtttctctttctagcctttctgtttagaggtaactacatctttcaccattacgactatcttgtgcgctgctttaaattaattaacttgcatttaattatccacgtcaccaagcgcacgagctcgaccccactgtgaaaacatatttctatggtgccttcgtcgtggtagttatattaattaagtgcaatactgtaggtaaagtgcgagcagtcaatctcagatgaacagttaattaattagatatagcatgtcatcagcctatgacaatgtgtgtggtcaagccatcaaggacacaaaaagattaacaaatgggcgagagagaggtgaaagtgatatgtcgtcaaactctgcaactaatattatgtgcagctggtggttatatacatgataacctatatcttcctagctactatatcatatatgcccaaattatagctttgacatctccaatgggacaaaggcttggtggtaaaattaataattactactccacttaattcctggttatttgattaaactaatcacccattggttgtggtcaagcacacaggagattcaagggcataatctctggaaaatactaaagagaaaaagagcatgactttgcctttaattgagcttttgtcccccatatatatattgaatattatttgttgtgtatgtgataacaaaatcgattttgatccccaccatggaatcttgatganctncttgcagtaggacgcgaatcaccaagtaccgg

SEQ ID NO: 3607 - DNA, 3627 bp, Oryza sativa
  unsure (1)..(3627): unsure at all n locations
ggggtnnnaattcggtcgactggcacagnagnncatcatattgatttggtatatcctaattttcacaatggagagaaagagagagtgagaggaagagggtcctccaccatgggaattaatctactctttttactaaagttttgcatgattttagctttttctttcacaccttttctctgcttgtgatatgatgccgaaacgtcaggcccggtcccagcacgattgaaatatataaatgtacaccgtcactagttgtgcatatattttatatgcttgtgtaaacaagtaactataaatttaaacgactccgtttggagtgtacggattttttttctctgattaatagaagaactatttcagtaaaagcaagccccttatctatcaatcttttttgcaaccattatgtaggtcatcgatatctaactaaatccaaggcatgctatatgtcacttgttttctttcgggagtgaaacaaatgatgtgttcacaactttgacattttaaaaattgtatttaattttgtgttgatccttgtcaatatataaaatatagtaattcgatttttttcgtcaacatctacataactacataagggtgcacaacaaagttgaagtaaatctgtactcgtctactggatcgagttaattttactcattgtgtagctttaatatagagaaacacacaggttttccagctagctccataattaaggtgatgggctaaccggcctgacttcgaagcctcaccccttctatttatttgatattaggtcattcactattattcgtgttttttagctttaatttaataaaaattaatttaaaaaaagcaaaaatcgccttaactattaatcaacatatacgctaacagtccaaggattattatactaactccgtttttaactatatgacattatcgacttttgtacatgagtttttactattcatcttcttgaaaaataaatagttaactattgtttagtttgttataacttgctatatcattaaacatagggcctgtttggtacagctccaactcctaaatataactccaggagttgagtctggagtggagttatggagctgccaaaacccagttccacaactctaatatattttgtgagagagctccacccaacttcactcctagttttgatgagctgaaactgtttggctgagctccagctccaagaggggtggagctagagctggagctgtgccaaacaggctcataatgtttgaaagtaaataacgtcacacgtatttataaacgggggctgtatataactttaatttatacatatgcattttccgcgcaacaatcagacggtgagaatgaacatggagatcgatagtccactaggctggaaacgtgcacgcatcctgaccgtctatggatgctttgatcggttcttcccaccgagaattgtccggcaactaggtggggcagggcttcgccggccggccttccacgtgcaaagctacggccacagaaaagttggcaccaaggatcggaggccaggtgcagcgacgcaagctagtatgccgctgaaaagcagcagaaaaaaaaaggcagatttttttttttgctggattgttgctggttggctacctgcatcgatcatgcgtgcagcatgttatggagcacctgatctatgatcgatccggtgttggcttccaacatctagcattctagctagctagcagatgcaagatatttccttcttttttttccaaaagaagagaaaatgtggcctgataattatgtttcgatcggttgattattattcggtgcttgatttatgtttagataatattatttcaataatataataattatactgaagtagtactcaatactgccaatataagggagttgtcggcaatttgattctgacatgcctatatggggcagctagtgcacgggcaacgcaaccgacctatccgtatttcatttgtgacgggtttcttgtggcaaatggtttgcaaacatgtgtcttctctcattggcgaaatcggacacaatctttgcaattttttttattaaattagtactatttgaaaaaaaaatctcagttaattctatattactgagaatttggagtatgaccgtttgctttttgtcaactttgcaattttgagcacaaaccttattagtgaaaagtacatacactttaacttatgagaaatatgtagacatctgacctccaatattttggcagccaacctgttgtccatccaaattaagatcgatcatcactgactacaatatcttgcagctatgctagcatgtgcatagtgcagaaattaagacagatagagatgaaagggaggagagggaaaaaaaagctgctttttggaggatggctacatgtcattcaccttcaaaagaaagacaaactcaacaaacttgagagtgatcaacgcatgcatatatgtgcatgtaacgtgtaagctagctagccaggtagcatctacacattagaaacacatataaatatttgcattgcatcgaccaatgattaagaccaacgaacgcttggtagagagagcacttagcgtctaagcgtgacaagctctcgatcgattcctgatatgaagagtatatatataattcttgacacatactatatgctgtgctcagatatgatatatatgtgattgattgatcagtactacaacacctgcagagagagagaccctagctaggcatatactctgattaatttgtttcttaattatcatatgcactgatcgatgcattgcatgatatatgtgagataatattctctctcttcctgtttagttttcgtcagcatgagataagagttagcacagtactgtatgcggtttgttttattcttgttctactggtggcgatcgatcgatcgatcatgtcctgaattatattctctggattgagtccaattccatctcaacatctgtgtcatgcatgctaggtgccatctagctattggataacgtttgcagaatgatgctgtcgatgcatgactgatctcttgtgcattatatattactatgtgagtataattgcaactggaggttgtcattaattgttaccgtgtgggagcaacatataagcagatatgctacatacatatacaatgggaacaaatatgttgtgtagtattaatttttcatgtttcccttattttgtttatcatttcatatatagtattgtacaacatctaagttggcttttcatgagcgttcattgtcataagttcttataagtgaaattaatttatttttacaaaggtccgagatcgatgcgaaatataattaatactttctagtagttaaatccataagtaaaaagactgaagtaaatttactactttgtgaaattctaattaacgtacgtatggttgaatgtctgtgttagatacattacttctacatctaattaaagtacaaaatattttcttctccatgcaagaaaagtgggagtgagaagaatatttcttatagtatagttctgtcttttttgtttttctggaaaagccaaatatacggcatgcaataatgcacattttggaaagatccctttacagctagagcagctggactggatttttcacaatttgggccttttaaaaaacttatn

SEQ ID NO: 3608 - DNA, 5018 bp, Oryza sativa
  unsure (1)..(5018): unsure at all n locations
acatctctatcctatgcactagttcggagagaggagaggaaacgaaaaattctacatgtcacatattacgtccatttgagttcaatttttctatggttggttcttgtgtgtccctaagcgtgaaaaaaatatcaaacaaataaaacaaaaataaaaaatttccgagggggggcgccaaccactctggcgcactccccctagccacctcagcatcgccccgccacgtcggcagggggacggcgccaaagaggctggcgccgtactgttgaacgacggcgccaggcactctggcgccccaaaaaggaccatttttgggataagtttttctaggggtctacttacaaaataagtttttcaaaaggaccaaaatgtgaaaaatccaggcagctggatgggaattttatttccctcttcgactgcaaaagataaatatcccctaccaacacatcgacctttattctacattatctatgaaatactgagtacagaattatccgggccttttcttgtgccattgaaattgtggcacttgtaatttagctagcaactattttggacggtccaaatgtgcaaatgcctttggcctaaccttactctaatgattccatgatctagcctgaattgaagaggaagactacaacacttttgacacaactactcattgtggatcaagtgattggctcgtgcaagtcttgacaagtagatgcataatgcatgcatttagctagcttaagaatgtcgtagagtatcttaagtgtgttgaatgatctggtgaagaccatcgattgtgaccaatcatattgtggtccctgttccgcaattattgaatgatcttggttaaatttaattaattactagcatgtaaaggactatgtttgttctagaatctcaagatgatacctaattagaatgcagcttcactatcaaatggtctacgtaactgagataattcacataactttacagctagctaccgcattgaccttagctagcatttttccaaattaattaattattctctccttttcataaataattattgtctagaacaagatttatttaaccttttcaaatatagcaatcaatgtatagtagaatatataagtttatgaaatctaataaatttatgatatcctgacaatatttttaaaggcaaatctaaataccattttctttaaagtaactgataagtatttgagaatattgattgtcatgactttaaaattttgactatacatatcttgtgctaaacattaaatatttttaaccaaaggaagtatatacgtactgctgaatataaaactgcgatttgaataatgttgactaattaataaattcccgatgcgtagtagtgttggtgcttcttttgattcaacaattaaataaatcttccttgacactaactggactagctagctagctatagttaagttatgcgtacctttcattaattttagtggcttgcatctgagattgacacatgtgtaccattccctagctcatatcatgctgtagaaaacatatataaataaataaatacataagagcactgacaagtgtctcttagatccacttagaaattaaacgccaatagcaatgtgtatgctagctatagctagttgtatttaaccacgctaagatttacgcgtatctaaatcaaatttatgtcgtgttgcattgcatgcatttaattaatatccgttccaaaatgtaaacacttttgaacttcgatacatacggtcctcgagatgctattttaacaatgatatctataaaagtatgatgttttcaataaaagagttgcatattgtgatagtttgtttaatgataaatccagtaacattaaatttataagattaatcctttttatttttttattaatagtcaaagttacaaatatttaacttgacactatattaaaaatatttatatcttgagacggagggagtatcaacttttgcagtaatcatcagctgataacagcggctcccattttatttttctccgttcttttcaactattttttgctactcgcactacgtgcaacgtgaaaagataagttgcaggctccttgtttgggccagcagactacctagaaacggttgatacggtcaataacatgtttacatttgcatgtgctttgcatagtgtccggtttggccaaccgtgtgtacccggtttcaacttacacacatgccacgcgcagcctggttattttgaaaaaaaaaaactcctcatgcatatatagaattttaaacagacccttccactacctgacagcctgtggtgttttatctggaatggccctcgtttttttttacaaaatataatgcaaggaagacaaaattctgtttctagggatgacgttgtaaacatgataagtataagggtgcttatgcaaaatagccttatctaaccctcatctctctagccagtttctggtagaaataaggggcattcggttgactaggattgatatggggaacaagctaattaaaattgaggtttggctcggtttgttgacatgcttgatcgagccagctcgcgacccttggacggtagcgacgcagatggcatagggagggaagcctagagttttaatctgtgtcaccgaagagtggccgggaggaggactagagccaaggaggagagcaatgaaccggtgacttgagttgagactgatgaggtgccaaattaaccgccgggcactgcccacacgacgcgtagtggctctttagagtccgagtaagaaatagggtggctcggggagtttatggaggtgggatgagccacgaatcggtgtcgtcggcgaccggtgtccccgtcccacgtcaagtgcgtgaaagcagctgggaattgaagggatgagggggaccaagtgggagggatcagggagggagggaaggacgatatggtttagggagttaaatagggttttctttaaactggttgactactcggtgaagtactgtttattgtactacctcatattatgtatatatatatatatggacctttatttaacactgattagtaaaatccttagcttataccaaccaagtttcacctcatattctactaggcatatattcatatatatatgccagcagaaaattaaagattcggccagagatacgatcctttgagctgtcgccacagctttggtacgtctttagctttacctaaagaaagaaacagcgatgcaaaaagaaatggatgggacttgtgctagctatctagctgctgctccctgctttagcgaaaaaccaaaaaaaaaaaattcaaagtcaattatatatactgcaaaatggtggtacaatctatgcgaaatgtttggatgtattcaaagtcaattatatatgctgcaaaatgggtacaatctatgcaatccataggccctgtttagataccctgacaaaaatttttacccggtgactttcaaatatttggatacatgtatggagtattaaatataaacgaaaaaataactaattacacagattgtgtgtaaattgcaaaacagatctttaattttaagcctaattgctccatgatctgataatgtggtgttatagtaaatatttactaatgacggattaattaggcttaataaattcgtctcgcggtttacagacggattctgtaatttattttgttattagtctacgtttaatattttaaatatgtgtccgtatatccgaagtgacacatcaaaactttacacccctaactctaaacacagtcatatactgttatgtttgacttgtgtctttggaacttgtttcataggatatctagcatctacagtagagtacactacagttctgcagagagctggctagctagatcttgctgattgcaataatgttccaattagcctttggaactcgggatagtgtaaaccgtaagataagggctagctgtgctgtattaattaattaattaaggaaatatcaagatcatgttcatggtgttcactgtgtcctttttcaccttaagacgatcttgtaaaactaaacatttacttattagctgattgcataatccgtgacattttgattccgccccaatgtttggaaagaaaaacatggataagcatcgctcatactaaataatatttttgctgagggaattcttcttgattcctaaaataattaaactaatcccacaaaattcctgcaataatggaacactggcttagagctccttaattctttctgagggtaaacctgaatttggagcataaaaaatgtaaatatataattttcccaagaaataaatacacaaacatctaaaagatctagcaggaaaccttcgagtgcaagttagttatgaacaaaagttagaccatatgcatatcttagttctagaaaatgttgggacatgttggtctacttacacggtagtactacctgtttgaaggaaatgaataacaagattttagttgcttgaaatattcttatctgggaccaacttaatttggcacgtgtaccttaacatgtgggctccattatcagcctctatcatcgttccgattggttcatatctcgaatatgcaagttttcttttttgtcgataatagaattcaatcaaaatatatacgcgagcgtctggatgtgtgcttgtcttacttaggcttaatagcaacgatctttctctgtataagctaagtcatcgtttttgtgtttctttgtaattcgcatgcattgtcatgttttgtccattttatcgggcatttggatctttggctgatgtgtaaaagtgtccaattaccaatctttcacgcagaaaattctacaataggctaaactaccccttcgtttatcgtaatcacgtttcccaaactaaacagtatgatttttatataaaagtgttcttaaaaatcaaacaaacttattttttaaatttgaaatgattaatactcaattaataatgtgctaatgactggtctccttttacgtgtcattgtaatgatgaactncttgcagtaaanngagangacactcaatgggcgcgcg

SEQ ID NO: 3609 - DNA, 12363 bp, Oryza sativa
  unsure (1)..(12363): unsure at all n locations
tcctcatgtccctgtagttaatagatttcacgtagttgcggctacgcattgcaatgcccaaccttcttcattaaagtaatttgatagaaaggtgtgaagatgtgtagactagcggcctatttaggagagaccagtggcggagcgaggataaaattatagtggtggcttctcaatcttttgggccttataacaatctcaaacaaagtctattttagcccccttacaatagatatatggatttaaattttagggggggtcttaatggggctctaatggtttattaggggtagggggtctaaagatccccagcccccacgctgccttcgtcactgggagatacgagaattctaagaagttttgggcaagaatctagataagcctgattttttagtttttggctacgaatttttttctagattctgtagctacatttgagaatctgaactatatatttgatgagaaaagtcgaagatactaataccctagctagaatctcatatcaatatattgtgggctcttagacattgtcccttcacgatgtagacaaaggagcgaaggaggaactgggaaccggtggtcatccttccccacacgagctggccacatcatctttcatgtgtatatgtcgattctccatatggtcggcaagcaaatcgcttgcacttacatcatataggttgttgcctcgtacagtcacactccctccgtcccataaaaattcaacctaagacgagatattcgttgtactggaaaacgtcgttactcgttttagattgaatttttataggagggacggagagaatatatttctattaatgcttgttcattgtcattaagtacggatcgatctaacgtagtgtggtaattaaaatttgtacgcgtgactaaaagggcattcgcgcaggcgtatttgcaactgcctgtaaccgaaatgactgaaaatgttctattttcaatggtggaaaacaaaacttgtatgcaaattaaaataaacttctagaggcgacttcttaaggtaatcacaaagcagcagttgtttttcgtcttgacttcttgcgtgctaaagtattttgacatggatatctatcgtgttctgtcgattcgttccagttcattgtttcagctaaggtgtcagcgtagttgcagtgacattgttatgctttcttccctgcatggagtacatgtacatcacttcctttttcatttctgaactttgtccctctctttctctgtgcttgggttggaaggtgatcagattcagtctccttaatctttgcattttcatggcaccattaaaaaaaaggaggaacactaaatcaagctagatcgatctgtcggcatgtagctatgtagctcattcatgcatgaacttgggtactactaattgggaatttgttgttgcgtgcatatcatcagtgcatgcattttcgatcgatcgagatctagataaagatcatcgaacacaaaagctagctgcgcatcttttaatttttgcgtgcatttagctagctagtactagtatcgataaagatcatcgagacataaaagataattggtgtaacttttttttaagataatgggaaagggtttctagcatttacttcatcagaaattatagccaaattatttcaaagttagcaaaactttcgtctacatcactaaaaaaattaagtccagcataattcgaataattcgaatgacaagacattattaaaataaataatattgccaaatcttcattcgtaaaatgtttcgtgaccattgtttcaaagaccacttttattttcttaataatgaaaatggattatatcgtctccaacttctataatacacagccataaaggacaacgacttgcatgcgtgttgtatctgtactcttcacacttctacaacagggcttagaatcaaatctaatatgttcccctgtagagagtaatatatatgatttattaatagaagatcgagttaccataaacatttcattctgacttaaccaaataattaactggtgtaataatgaactaattaaagctatttagctgatggatatgcatgacagcttgttcagatgatccatcgagatcaggcgagatcaaaattaaagctactactgtagtaagcagcagtacgttgagcatgggctatgtgtcccagcttctcccctctttagcaagattggacgcgtccatggccggcagccatacatctgtacatttgttctagcccagcagcttcctgatgatcagatcatagatgatcgatcacttgttgacagttgacacgtgtacaatacaatattgaacaaaaaaagaacctacacgttgcacagtagtccgatcaaatcgatcaggcgtgtgcatgcatatgattgatgccgattgagatgaaatgaatttgacatttggaatgttgatttgctgatgatgatcagtctgcttttgatttggattctggtatatcctgatcatccatctagaaaagaaattaaagatgtttgtacatatgggcgggcctaaagacacttgtaaaaaaaacatcaataatccaaaccggtctatcactgtcggttcatataaatcgccatcaggttaaattgttggctttagattgaattaaccagctgaatgaatatatggtgatcgattttgaagcatcagtactgctggttcaagccagttatgagctgaagaattctacaacccaatgccatgggcaaacaatatctatcatttgtacgaagtgagcgtagctcaactagtttgcatggttttccttgtggtgcaactagcaccaagactcaagttctatatttaacacgggtgctcgtatttaaggttaactatatttcagtggtagacaacatactcgtcaacagcgagacgcctatgatgatttcgtcaatctcaagatataccggcatagtcttctcgagatgctcacagagataggatgtgcgtgtgtgatgacttcgtcaattttaaaatatgccggcacagttttgtggaggtgctcataggggcaaggtgtgcgtgtgtatttatagggacgagcgtacgcatattatgaatgtctgcgtttgtattgtgtttttaaaataacctatcattgttactataatcagaattaataaatatttgccctaatatataggacagagctaatggtttggaactggtatgattaaatcctggatgcattaattaacgttatctgcaatgatagaacagaatgaattggaacaatttctggtggtattaaagacattttacagtttttaagaggtaagacatctgatacctgaggtactgatgatagatatcatttttttaaaaaaaaagtacctccttctaaagaagtatacaatcacgtgctggtggatacttcctccattccaaaatatccaaaatataaagcataaccacttctaacccaaagactaagaaaataattaatatcatcttgtagtttggatcatcctaacagatacaatgcatgcatccaatagaattagagaacatgagaatggaggatttaaaaagtaataatttaatggataagaggtaatagttaatggcctacatgcatgcataccttatattatgaaacatgtaaaaaagtggttgtgtcttatattacagaatggagagagtaatttcttactatggatgaagttctcgtcatcgtgtgtgtgtgtgtaaaatgaagcatcgcccaccgtttcaccgataatcatatatgtatatatatggtcactgagagcacaaatgaacataacttaatttaatttgctactttccttgtgatatctttttttggcgatatagtgcttctgaaatacagcacctggatggatggaaaatgttgatgcatataaattaaaatttttcttttacaacgagagtacacacaaatattttgttcctgtgccgggcccatatatatacatatatatacatatacatatatatatatatatacatatatatatacatatacatatatatacatatacatatatatatatatacatatatatatatatatatatatatatatatacatgtatatttcatatatatcacaagtctagcttcatttgggcatagacataattcagcagtgggcgtctacgcataagaatattagatcattggtcccatccaaagaggatgcactatcaaggagaggccagcagcaaccaagttttttttgtggacaaaagttgcaaacgtatatttgggatggatggccatgcatgcatatatgacagcaaagtgtcctaataggcagatcatcttcgatctgtccttccaactcgttatggaatcatgttcttgcttgaccattaatccaaacatatatatgcctaggttgtagctagctaatgctctgtgtaattatatatttcttggtgatcatcattttcaaaatgatcatgagcatcatataggcacaaaatatatagtaccaatgcatgcatgtttcctttgtttatatatgcccatggctttgtcctgtgctagcttcagttactttttctaatggcatgctttaattaaggccctatttagatcttccctcaaaatttttcaccatgttacatcgaacgtttgaacacctacataaattattaaatatatactaaaaaataactaattacacagattgcgactaatttgcaagatgaatcttttaagcctaattgctctatgatttgacaatgtggtgctacagtaaacatttactagtgacagattaattaggcttaataaattcgtctcgcggtttactgacggattctataattagttttttattagtgcccgaacacccatgcgacaccctatataataccttatgtgacacgccaaaactttacgcccctggagctaaacaccccctaatatgtgttgcatgtgtgttaatttctagttgtctttagtacatcatcattgatggtggtgtgtttaattagtttctagtaagaagcttccatctttggggaataaagtggcatatatatgaaagctaagaaggcattgatcttcaaaaaaagaggctaagatagagaaagacaccgtccgattgttctactccatgcatatataggagatcatataagttctattcctctagggttctgaagaatcaactaggttagcttaattatacgtacatatgccctggtccctctgtttgctaagcatatacattaaaaaggcacatctgactttggtctcctccattgaacatttgtactggccattaatataatttgaaggtatctaggtgtagttgggttttttttcttattggtattggatacacaatttgatccattagatccaaaatccaaataatctgaccaatcatcccctcaacacatataaagctccctggaaattaccttaatttcaattactaaatatatcttactaataagaaatcaatactatgtatttcagtgtctactaagcaaatggttcttcaaactgattactgaacaggttgtttggcaagagaagaaaatatttgaaaaaacactcaattactcaagtagggtcaaaacaaggagattctcattttttttgtcgggtcttgtgaaagctaaagataaatccttacttctggaaattgggtagtaaataggggcgaataagtaagatcttgggggatgtttgggttgggaatttccaactctatatatcatttttcgtaagagaaatgtctcgatcgcaactgttatgaattttgttccgcttaatgtttcttttaggagaacgttggttggtcagaactgaattaactggtataatttaattgtcttgattttgtatactagtttgaatggatctaatgattctttcaaatggaatcttcatcagaatagaattttctgttagatcaatatatttatctttgattaataatggttttattgagaggaacaagtttatatggaaattaaaggttccaattaagattaataacttttgtggtttttgttcaaaaagttgtgatctaaccaaggataatttagcgagaagaaattggaatgggagtcaaagatatttttgtttgtataatgagactattcaacattttttttaatgtcatattgcaaaaatttctttggagaatagtttatatttcctttggactgaaaccccctgatagtatatctaatatggttggaaattggcttagtggtgttgagtcaaaaactaagaatctcatatttgttggagcttctgctttatgttgggctctatggttaagtagaaattaatgatgtttttgataaatctccaactaaatcttatatgcaagtgttctgcagggcaactttctggctccggttctaggcacaacttcaaaagtgtgaagagaacaaggagctcctattttctacatgtcgaaacttagaagttacagtcatgcatattttcgccgactacggatggagattcacaaatagatttcaataattgtttactccttatgtttggctttattatctaagttattttgttgcctgaatgtttgctctttttgagagaatataattggttgtagtttctttgaagcaatggccagatttaatcctattattttaaagaaaagtattcaagaatactagaaagatatgagttaattaaatcttttacctttaacggcaatataatactaaaagaaatagcagaaatgtataggaagaccggccattatctttagtcccgagtgaaataactgggattaaaaattcatctttactcccggttggactgaagatggacaggggccacgtcttttttcttttatttattggttttttgctgcatgtatctattcccccatccaaatcaacacaaatcatccacaacaaaattatccacaaatcatgcacaacaaaatcatccacaatacatacacatccacaatataccaatcaatcacaaatcatccccaaatcaaaaaaaaatctcctgcaaaatatacaaatcattccctacaaataattcacaaaaaaaaatccatagtcgccctttgcgcccgccgccgccggggcggccctccgcacgcgatggccaccgctgcacggctgcatcccctcccagatccggcggaggggaggccgctgcccttcacgcctgccgccatggggggtagcccaccacaccggccgccgcttggcgcggccccgcacgccacagccgccgtcaggcgcagccccatcggctcttcgtgacttagaggcagagaggggaggagcaggaggaggaggagggagaggggtagaggaggagtggaggagggaggaggaggagatgagataaggaggggagagaggggcgctgcgcgtgaggagataagggagagagagaacgcgcgtcgtgtgggccgagagagatatttagtcccggtttgtattatcaaccaggattaaagttctatatttagtcccggctggtagcaccaactaggattaaagttcattgggggccttccaactattaattcgggactagaaatgatcgatttttagtcctggttggttaagatcaaaaagtagcgctcggctttttaaccaggactaaaaaatatttttttagtcccggttttttaagcaaccaggataattatggaatttggtcgaccgacaaaatatggtttctctagtagtgtagtgataagatcagcttgagatagcttatggtgtatcaaagacaagacaataaattaaaaagctcacatggtggttggatgcattattgttttttttatattggaaatggtaactggatgcgttattgttaatagacattcatgcttttctgatagaacatgcctactcacagtatcccaacaactaatcaaggcacttaatcccaagccatacaagctaacgtctactcctccgtcccaaaataatctaatctagtacttgctaggtcaattttttttagaacggagaaagtatatatcgtctcacaaatttcaatctctgaaagcatttaaagcatccattagaaccatttggcatctctgagctagcgttcatagaacttggcttggttagactaagtacatatcgtatcatgtgagatatgcatgcatcgatcggtgggcttatttatatacatgtcattaatatttatgagagttcttgcaactaacattttgggtgaatttactatcatattaattactctctcagtttctaaatacatgagagtttgtcctaaacgtcacatataaaaacgaagagactaatttgatgttagggtttgtaatttacaaaacataaagttccacgcatggcaatcatagaagaattcgatgtgtcaacgatttcgcgctctataaaatagggagaaaatcaggaagaaaataaaggtggcatggtgactcccgaacgatcatgattgtgcacgtcatatttaatttcctcctccaatttgttggatgtagagtttttaattactgtattttcatgcaaccagattaatttgcactctctcctgtcctgaatatttgactttaagaaaaacattttatcaacattttaaaacattaaaatcaatagcttctgaaatgcttcgttaaaataaaaggaaaaatcgtatacatggatttgccttgaaaagtagtactatgtattaaacttattagatttattctaatgtagaattgatggtcagagttcgaatggtttgatggaatcatgtttgcaactgtcaaatagtattaattatcagagggactataacacccccactatatattttatatatccatccaaacatatgcttttgttggtgtgtacttaagttattacaccctaaaaggtagagattccaaagaaatcaaatgcttgcatgtcattggcaccggccacttggtcaatgttttcatgttctcttatggttcactcaaaaaatcagcactaatagttccggacaaccttctctacttgtcattaaaagctgccagaaagttctgggcctcttgccaagaagttccgggctctatatttaactgctaaaattttaagtaattttcagaaacatatattcaacccttaggtgatatctccgggtttcagaaacaaggggacatcatatccccttgagagaaaaaaaaacatctacccacactggggtggatctatccgggtctagggtagttagagttcaagccataggcctagaacccaaactctatgcaaattccatttaaatatcagaaaatcttaggaatttgtagagagtttggataagatcaatagaactgagcctatgtacccacatgcctgcatgtatgtaagcaaggacttatttttttttctttttgtcttcagtcgttggctacctaattaaacttattggaggatcacatcgcaaaacctaatcgatcagctgtttataacgaatttgttcgtcaatattccacacttccacaggatagctagctaggacgaaaaaccaggagctattaggcatcaaaccagaatttgttgtacatgctttcttccctcctggacgtattcttgagatcctaattaaagacatatattctaagctacattattgtggatgaatcggcaacgtgcagtttatatttttgaccagatggtattcatgtccattgtacatctccaactttagaaagatcacgctgactgaagtagctgaaccaatatgcaaatattgtaggaaagcgatagagagtgtaaaaaaatcgtataataaatctggtcgtcggctacattattcaaacatgcatacaaattaatgtatgcatgtcaactccagccaatagtttgtcagccatatatatatataccgttaaagaaaacggcttgctcatcatcatcatcaatcgtagactttgtcatatactctctccatccctaaatatttgacaccattaactttttttaaatatgattgaccgttcgtcttattgaaaaaatttaagtaattattaattattttcctatcatttgattcattttaaatatacttttatgtatacatatagttttacatatttcataaaagtttttaaataagacgaacggtcaaacatgtttaaaaaaatcaatggcgtcaaatattttacatatagttttacatatttcataaaagtttttaaataagacgaacggtcaaacatgtttaaaaaaatcaatggcgtcaaatatttagggacggagggagtatatgttgcaagtagtattcgtttaatatatataataatccccctttaggtcacacaaaaaacattatagatttaagatcagagaatgctggccaccgttaattaattgatatatatctgcatatgccgttctacatttcatatttaatttgaatatagttatatatgctctcaagttgatctggacccatgcggcatatatacaatgttccaacacactctcagtcatcaacatgtactaaaagaatattcaagacttaccctaatcacatgcatgcatgtctctctctaatttgatactaatctgatcaccttttgcgctatctaacacgctacacattcttaacatatagctaaacaggtgcatgcacacatgaaattcaactatataagtatatatctttggccacttgaattggaagaattggaagcattgtcaccttgtggctgtacgtttatatatacacgtgttcgatcatatattccatacacggatacactgtacatgtgtgctgcacccacattcatatatataggtagatattacatatgcattgatcacacaacacacatgtatctcttgtagctttcattttcgtactaggtgcaaatcctcatctgtaaagaaaggtagcatttttaaaaagggatcgaattaaattaaaaaggttggagatcgatggagatggaatttcgtcccatgaggggatgtcgtccctcgcttcttcaagtcatggcatgttctccaaatagtaccaaatagagttcaatgtgttgtttgtgttacaactcatataaatcggatttgaacttgtattcatataaatcggatttgaacttgtatcgttcttgagtgatatattacatataaaccgatttacatacctgattaactttttaaaattaaattataaccgtttagattatatgcaagaaactatatatatgacatctcttaaggagcaaaattattttcccatcgatggatatgaaagcactcagtttgtcggtataaatagctatcagcgtcaaactatccgttaggaaagacatttgccgacacgcagtctaccaccagcatctacgagggatctacagcagtcgggaaaagtttttaccggcagaatgatccaaatatatatcactgatctgcatcatatcgtacctgatactgttcgaaaaggccggcatctatctatctatctaactgcagctgaatgatccgatgcagctgcagctggtatatatcgagcacctaaacccacttcgatctgcaacttgcagggaggcaccatattcgattataaatttcgttttattcgatcgatcgatcaagagagagcattagcacatgcaggcacgcgtaaacgtttcagatggcgacgatcgaagacgacgacgacgacgatgatgatcgatcagttgctctgctgctaatgctgatcagttgatcgatcgatctttcctatcactttcgcatgcagagaattaataaagtttagttgagatcgatcgaatcgttttatgttgttgttgttttcttcggtttggaattgattaaagtagtatcagtactaatcgatcgcctgatgtattgctggagatttttgttgttttggcgttcatcctctgtgggagaaatttataaaggactgatcgatcacaaaagtgaaagtcggtcgtcaattaattaattaattaatccttgttgatctcacatgcagtttgagattaagcttgcatgtgtgtgctagctattaaaaataaaacaaaagacttacttgcatcagggtttcccttactaccggttatcgtgatacgggcttaccgtcagaataagatcacggaaaatgcccgataattaacccagctaattaagttcaaagagaaattgcccccggttttcctcttttagtggnntttgtctgnttttntgaatgttttctcccttcccttgttnctgntctgtnntgnngtgcntagncagtnnatncatncaatcccaggggggtgcggcgtgnaatgaatacacagagaaataatatttatccatctccaacgctatatcataactaataacagaatagataacacgtacattcacgaaaaaacaacattaacgcctactanattataaca

SEQ ID NO: 3610 - DNA, 4591 bp, Oryza sativa
  unsure (1)..(4591): unsure at all n locations
tttgaatatttagggatgaagggagtgctttaaatgtttctaccagaagagagtaattaatactcctgccattctataatataaggcacaaccacttttctaaaggttcccataatataaggcatacatgcaagcatgtatttaactatgacatctttntcctttaaacttatactttttttaaatcattcactctcatgctatctaatcttattggatgcatgcattatatttattagaatgatccaaactccaagatgataataattttttcttggtttttgggttaatggtggttgtgccttatattttggaatggaggaagtatatttaataaaatagtttggcgtaatcaaatgacatatcaaatgtcatgactaacgttgagaaaaagaatgggacatatatcatcaatatcaaaccatctaggaattaatattttatccatgaataagtttaggtaaattgatcaaagaccacgccatactcggccggactcacatgtaaaccccataacttagtggaacattatcctccctatcatgcacgaggttttccttatggttttggtgagggttattggcttatcgctattcagtggtaaccgcatggttatcgtgaaaaccatgaggttattgttagaagccatgagaggttttaaataccttggtaatcgtgataatcgtgagattctgcagtcatagtaatgtatatttattgcatgtattgacctttcatacaagagttttgttggtacaatgttatatcctatattattcactatggttaatcgctatgctacactcagagtataatataaagtaaatgtaaggatttagtcaatgatacggtggatgttctccaatactttatcattttatttgcacttaagaaatgtttagattcgtcactgagcatgtcaacgacacacaaagagatgttatagataaaaagttaaaaaaaaccgtgagccatatataacccatattaggatcaccagatccaacaattaattattagataaaaatattccacattaaaatctcaagtaccatccaacccttcggcaagtaaaaagctaatccactttatctaccatcttaaacttattagtcgacgagctacaatatatttcaccgaccgacaaacttataaagaaaaaacggtggatggcgcgcgcgcacgagtcgagcacgagcaccactatgcacccttcgtcacagaagatccggtgcccccaatggtagtagtagcagctgctgctgctgctgctgctgctgcttgctgatgccaccacgctaaacacacccccaaaaaataaaaagaaaaaagaaaataaaaaggaaaaaaaaaggaaacgaagcagagcattcacggtgtgcactgcagagtgcagagcatcgcaccgctctcccgccaaaaaaaaaaaagctggtgggcccacccctccactcgccctcctcttcccgccacgtgccccctctccaccctttccacccagtgacgtggccctcataaccttcgcccataaatacccctcccccttgccttgctcctcctcggcctccactccaccaccacctgctccgccattctcgccgatcagttcatccgatccactgctttgcttgcttgcttctgctaggtttgattgcttcgtgtttgattgcgcggtgagatgcctccgaatggccaggacttgcatggcggcggccgccgcggtgtagtcgtgctacctcctcctccttcgtctccggcgacgccgcactcgccctcgccgtcgccgccgccgtccaagatggactgcttcttgtcctccgtctgcacgccgctcaatctccaggtacatatcgatcgatggtacggatagatgctgctctgtgtggttgaggtgattgattgatctttggttggatggatgcttgatgatgtgctcagttcatcgacgtggcgtaccgggtcaaggtgtcgaccacggcggcggcggcgaagggggcgccgccggggaggatatcgcacgccgggggaacaggtggtggcggtggcgcgcaggaggagaggacgatactgaaggggatcaccggcgaggcgaggccgggggaggtgctggcggtgctgggcccatcggggagcggcaagtggacgctgctctccatcctcggcgaccgcctcgccggtcgccacgccgggacggtgctggcgggcgggcgctcgccgtgccgcgccgtgcagcggcgcacggggttcgtggcgcaggacgacgtgcttcatccccacctcatcgtacgcgagacgctcctcttatgcgccatgcttcgtcttccggacttcttactcgtagtcgtcaaggccgccgccgccgaggccgtgatcgccgagctggggctcgcgccgtgcgccgacaccatcgtcggcaacgcgttcgtccgcggcgtgtcggggggcgagcggaagcgcgtcagcatcgggcacgagctgcttgtgaacccgagcctcctcgtcctcgacgagcccacctccggcctcgacttcaccgccgccgcgcgcctngtcgncacgctctcgtcgctggcgcgcaggggccccaccgtcgtcatgtccgtccaccagccgtccacccgcgtctaccgcatgttcgactccgtcctcctccttgccgaggggacctgcctctacttgggcgccggccgcgacgccatggactacttcgccgccgtcggcttctcgccggccttccacgtcaacccccccgacttcatgctcgaccttgccaacggtaattaacccaaaacactaattatactctattattattactttcttactttattcaacaaaagcagggaaaaaatcaggaaacataaatttcactaaatttgctcaatttgaatgaggatcaaattaggcaagttataaatcaagggattatcttttaattgggtgtagtagatatgaatggtgaggattagaccaatgatcacaaaggagacaagtaaacacacctggagagtaagtgtggagtgcacccaagaaaaagttcatgcaagagaggagataaaagttttttgaagggagaaaaaaaaagaaagagtggatggaggtgagtgccctagccttctcaccttcataccttttgtgcaaagcactttatggttgaaagatcacacacccaactcaactggacacctgtcatggatggaggagagtggaattagggcactatctaccttaccttaccagcatcagtggggctggaccgctgctggacatcactcatatcgggcccgaacccgctaccggtaaacccgctagcccggtcaccgaacggcggccgggctagcgggtaatgtcatattggatatccattctgtttccaccaatcttgttggttgtggtggctgcagaagatgatgagatccgacactagtggcagctttcagttggatctggttcctttgctagcttaattagtagttagcttgggcagcttttttttaagtatgagaattagcagcttctcttttaccttgggatcaagcaaaatcaatggagcatatgggcatgatatgcagtgtggatatggttccaagtgcctgtctcactagactaagaaaattatgctcccccctggctcatggtgatggcactttagacagaaggaatcatttttttggtaccaatacttctccttttggaagggtagagagctaagctatccccctttttggcccctcctttggcacctggccacttaagtaagtgccttgtagccagtctagcatatcaaagcaatggggcagagagagagagagagagagagagggtgtctccatgatccgattatatcgaggtcaaccgcgtcgtggcacgattgggtctaccgatccctaggtggagggggagcggcgttcatggcccgatcaaggtcccgtttggcagaactcctactcgtttggaagccatatcgtgcactatcagcttgggagttgggaatacacataaactgcaaaatgcgcagaaaaacaatttaaagaaaataaaaaacaaaaaacaaaaaggaaaataatgaatggatggaattttcaggagtgattattttccattgtgcctacctttatttgatctttttctgattgttactacattgttaagaaattatgatcaatcatcctacttatgatctttgacactgaacatttctgctctgttttttttctatgcaggattcgctcaaacagagtatgataattgcaacgcagccgatggcggcaacgtgaagcagtcgctgatctcgtcgtacaaccgagtgctcgcgccgcgggtgaaggcgtccatcaacgccggcgacgtccacggcggcgagcagcagccaccgccgccggcggcggagagctgcagcgggtgcacgagctggtcgaaccagttcgcgatcctgctgcggcggagcctcaaggagcggcggcacgaggcgttcacgtcgctgcggctgttccagatcatcgcgccggcgctggtggcgggggccatgtggtggcggtcgtcgccggcggcggtgggcgaccggatggggcctcctttctttcgtctccat

SEQ ID NO: 3611 - DNA, 21345 bp, Oryza sativa
cgtgctaacggtgattcgtgattactccatgtcgttcatcagttttaatttttttttctttcttttttctgtttttctcctgatccattgatggatcgaggtgtcaagtgtattattactgccaaattaattaaattaaactaaaaaaatgatccggtgtaagtaaccatcttcagttggagtgaaaaaatttgagcgccattgtcttctccgacaccgatctccctcttcttcgcctccattcttcccaaatttaactaaaaaatcaccgagttcaactttgcgattgagcgtatgaaaatttccaccttatttcgacaaatcttggttgaatttactgtttcgaatttaaattctcaaaaaccattgaaaatttcactcagtatatgctttcatcccttgtcaaaacctcgaaatttcacgattttctaccggtttttgtcgaaagcgttagccttgaatcacccctttcaacttgaagtaagtagttcatcgtaaatttttgtgaggtttcagctaggatttcccttagaattttgtttggaatgtctagaatcacacgattgaagaaggctgattctacagtgaagtcacactcggcccatcatttcctgggtaaaattatgtgggctcacatagaagacaaaatttggcccaaaactaaaattcatcttagtgcactctgcactctccacatgggcctcaacttcatctcgcttaattctctctacttactgggccacctaaaaatagcccattaattgttcatatcgattcattccacaagaagaatcaaaattaaacaatttatctgccggcaaattaattattggcacgacaggaaaaattcaaatcactagtccttagtttaatctaatttatagtgtagatgcgtggttgatccaaaaataaaggttaggtttccgtacttacatgggacggaacgtatagtatatctgtatatgtatgtatatgcgtacgtgtacagggtacacgtgtatagtatggaacaatctatacagtgtgtggtacaatagtgtaccaaaagtcggttggtttggcctcccccaggagtagagtgcaatgtaagcatatttatttatatttcttttcgtaaattaattatgcgcataaacaaatttggtgcataatttagattattaacaagacggtgttgtgtaatgatgggatggtccatgcaatgcgtacgtactagcatgctaatcattgaagttatgttaagttgggagaaagggtgcataactattacgaaaagttaattaatatttctttgatggatcagatcagatgctattttttatataaaaaaaggaaatttcaaaagcgatggcgccgatctaactcagatatgaatagacgacgatgcaaagaacgtacactatcatatcgatccaaaggcactatacggatcaaaacacaaatcataatggcattgattatatatgtgcagtacgtattttactctacttgtagtgtgtagtatcaaatttcaatgttcagatcgatctaccagactactactatatatgggttgagaactacgaaaataagttgctaccaacttgcatcgattacattattgatatcctctagaaattctacatagtgtaccaacaaaataattatgcctggtgggtcagaaaatattattcagggagtatttgctaaataggttggaccgttatatatacaaggacttattctttcatgtacagatgtactcccatttctcagattgatcagcatcgctcatatcctcttgaagaactgagaactaattaatgcctcctttgaaacaaagaaattaatttcacgagaatttaacaggattatttaggaattaaactaatttgtataaaattcctgcattgcggagaagcatacagaagagaattcgggctgttaaattaacgcaggaactctaagagttagccaactgctcgccattaattattggttcactgcccagcagtcaaattgccagcttggacaattaaacaacaatttgattgacctttatatttttgtcctagaacatcctttataggttttgacaaccttagtgaatactagtagttagtacaggttagttacaatgactcatgcaaactatattgaccgtacgtagaaagttctttttcttagtgaaccagtgacatttcgtccagttttgatacctatatctctgcttgtggttttcatgttaagcaaatggtttctcattttcattgaacaaaatggtttttattgttaagcaaatgactcatccccattcaatgttaagcaaatggttttcattttgttcatttattatagctatctgcttggggttttcattaattgaacggggatgagtcatgattgaatccgggcaggggcggatccagcgtggatgctggggggactagagtcccccctaccccgctgaatcattattgttagaaggggatatgaaaggggaagaataggtagaaaatgaaaagtaaagggtctgcaaaaggaagaaggatatgagtcccccctaaaatcttgttctagatccacccctgaatcccggcctaatatcatttgaaaattaaactgaatttgctactacagtctgaacttctcattttactatcacatatatgttgatttggccctttatttggatttgatcatgtttaatttgaacaaaatctgtgtttttatgcagaactcgatcaggtcgagtcaagactcaagagctggcctttatgttggtggtcccatggtaaaactgtgtctaagcacgtgattaatcatcagtaaacgcatagtactgacgacaataacagtactgcaggttaattaaggatgggatctcttcgaatctacagtatctgctaccgtggaacggcatacactcataaattaacttgtacgagcaattttcagagtaataactagtagcagagaaaatagagtgaatcttagtctaggcctttatcaaagtttcatcatgaaatcacctttaatccatatatattttcattttgattcatttttcttatcttttatttcgagcaatctacgattgaattttggtaagaagagatccaggatctaaaactgatgacatttagtcctaaataatgtaccaaactctagcttctcagatctgaagtactgatggtgattctcttttctgcagctgcctggatgttagatcaaattaagtactgtgtgctttgttgtaagaattacttcttaattactgagttccttaagataaatacatcacgatttcccgacaattaaactaatttcgatctgtacgcaagtgacaattacagtatgagaacaagaattgaccggcatgcaagtgacaattacagtatgcatgggcagcagagataaactaaagcatcgatccatcaaaatgaattatgtaattgcaaaagtcaattatgcccggtaattagtgcagtaaactagtgcaagtaatcagccatgtgctcagctcgatcgaactagcaacctgacatatgtcacatatatatccatccatgcatctactttttctgaatggcagcttccagctggatatcatgatcatatcttgatcttaattcgcctacactatactgtgcttgcaatcgcttggctgcgttgagatctcgatgaggtttattgctaaattattagggttgtctgcccactctcaccagcattggcataaaaatatgcacacacaactacttcacaagcatgtactatacatttgtccccacaatattaaaaagaaaacattcggatcgatcggctgaagttgaatgcagtggagaaaggttttttttagttaattgtaggacaagtttggtataaataaattagggtaatatttgcttgaaccaaaaagtattcgagaaacctgtattccatgcttattttttggacttaggatgcggtttttatagaccgtggatgatgacgaagaaaagctgattttatggccattatttaagggcacaaacgaataaattaaacatcagaaatatgataattaagttgattaaaaggtattttctaaaatattgatggggaattattttacaaaaacatactatttaggaacttacttaaatataagaatttttacatgtttcttaaatgcttatattttgaagcagatgaagtactttatatgtaggaacttgagaagcatactgtgataatccataaggtagtgagaacatagcacacgggttagagttattatttgtgtgactatattttatatgttgtatatgggccctatggtgaagtttggagctgtttttcctccactgcgaggacgaattatggaaaatattattgagaatggtcgcattcgagaatatcttttttaatggagtgctaccttaaattttttgtatcatgaacttcatcgatctgagctgtatgtatgcatgattaacccatattttctagcctttttttttcttttataacattattgaaggccatttctcatatgtatggctaattttgaaaaaaaaaaaggttgtctatgtgttatttatgtgcataatcaatttctccactatatatactaaaccgtgtgaatccaaaccttattatcaaaatgtaaaactaacaatggggaggttttttttttaaaaaaaagatgttttatacatatatacaacaacaagaaccactatgaacatgcttaattttttatatatagatcgccataccacaaggtgagatgtactatctccatttcaaatcaccatcagaacacaggcgaaattcgaagaaaatttaaaaaaagaagaataaaaaagagagaaaggtaggaaatctcttttcctttagatcccaaataggagtaataacactttgagagtttttgagttcacacacggattatttatgtacctaaccgagagcccatcgatctcgcccgatgcgtgcacgttaccgcccggcccgggcccggccctggcccgcagctcgtttgggcccagacggacgcgccgccgccaccggtcgtcgcacgacgaacgcgccctccgccacggccatggcgctcttgcagccgtacaggtcgaggagagagccgaagacgccgccgccgcccccggcggcggcggagagtgaccagcggcgctaggaggatggcggcggcggtggcgccggcggcgcgggaaaaaggtcgtcgatggcggtggtggagcgctccctggtgcactcggcgagcgcggcggcgaaggggtcggagtgtggcgcgtctatggcgccgccgcgctggtggtggtggcgccgtcggtggtggtggcgggacgacgggtgtgccggcgcgcggcggagcggcgccggggggagagggagcggcggcgtgggcggggagttggacgggtggagggaggtcttggggatgccggggtggtgctcccacgagaacgggacgacggaggtggccgtcggcgtggcggctgtcgcggcggcggcgctggtgttggtggtccggccgcgaggggacggggagggagaggaggcggtggaggagaaggaggcggtggagagggagcaggaggaagaggaggaagcacggtggcggcggtgagacaacggcagaggtgccggcgccggcggcaatggtggttgcggcgccggtggcgcgtgagtggtggccatggccggcgaggagacgagggaaggcggggacagacaagagtgacagaagcgggataaatacggtggccacatttgcacttcagcccttcaatttctccaaaacttttatgcttctttagctcttttctataccattaatgagttaacatcctctaccataataatactaccattatgtatatgttactataataatagtgcatttacataataatagtgtcattatgatataagatcatcacccaataatagtatatatatagtacggagtagtatttaagtgaaaaggaattttacggccactgataaaagtatctcgaggtatataaattttacgctaaaattttcttatcttacttagtatctaaatgtatcaaattttataccagagaatatagtacctccatgtcccttttcaagaatggaaatattattcttaagatgaagctactaagtgaattaaaagtaataaaaaagaaaactgattttacacaactgaaattgcactcattttgctttgtgcctttaagttaggtaaattaaatgtttttcccccaccatgacccagtagtattttttttacatactataaggacatgttaacttgacttacaaacatgtttagctgaagaacgtgtctcggtccaaggatgaaaaagaaaccgtggcatgtcataattgtggcaacaaaagaaacaaccatattttattttctagagttttatttagggacgaatggtcaaatgttagttaaaaagtcaatgacgtcatatattaaaatatggagagagtataaaatgtgctctttattatgcttttctcatgtttcagtttctttgggcggaaataattagtttgcactggtacagaatgctctatctgtccaaacaaattttatatacagttaactgtttatagaccaaaggtaatgtcataaactcatgtggagatgtactaatttcaactgtagacaatttagttttatcgaaaactgtagaccatttagaagacatgacacaattaaacaagaatataagatcctctcatacgcaacactgaaaatagtacaaatcacatgttttcattatattggggcagaggccacagagagctgacgctgtagcagttagccagcgcatttttcaattagctgtttggtttgattcaaactgtttgaaattgatgctggttttacttcgaacagttgttttataccaaaaaggacataaaacgtactcgagtactgctcaacattaggacttaattagtagtagtagttcataatgtgccatatatggagattgtggtgtaatttaaaccagagcttaggtcagagtgagcacaatttcttcctaagaaaagatatccatacaaatttcaggtatattttatggttgttgcacttactaactacaaccaaacaaagatactacactcttattttgatattttatctcttagttcatactgaatttgtacacctctttgctggtagcaaggcgttttcagttatgtgatagatcaagagaagccctgacttgatttttgctcttgtttaattctcatgtacaacctgacagttacacttgtaggtagagctcctacttatatagtagatggctcaactctggtttttatttcagatataaagtgcaggtgatatatgccacgtgtgctcctgtaaggatttatctttaattgcactgcactgaaccgtttgcattactgtacactaataaatatgtacgatggaaagtacatatacgtacataaatacgcaaaaaatgaggacatttgagctgtattcttatccgtagaagggaggacgagtgagaccaaagggagggtttgcttctgctgcctctgtttcagtttcatcagactttcagtattggataatatgggaagtgtgcagtgcaatgcaggtagttcagcttatttttcatgcttatttttcaagagcagagtttcttgcttatttttcatgccagtagttcagctgaatttaccatcttgtaggtcatgttggttcttgatttcttgtgcatttgtaagtagaattcgtgctaacaatcccatcatttcacatataactgattataagctctagtgcttattagcgatcaaaatataatttggaaataaaacttttatatatatgttcatggtgacttaaaagccaatataaaaaattaactacgatgacaaaaataccaaaaccaactctgaacttaagttttaaaatcaaagttttggctgcggatgatatgctattatgatttaagtagtagattgaagtatagggagtgagatgatgagcagcagtactagctagtacagtactactatagttttcagacaatggaagtgtattaatttcgttatctgaactaaattaaacaagacgttactctcctttgaccacattttgagtaggagcagagtgcaatgaatgggagctagctggctctgcagaatctttagtgaagtgcctgaataagctaagaccaccacagagatcactgcagtaacgcctcatcctccacatgatcacttgcgtgcctctggaagacgtgttcttgaggctcggcgacgatgctggaacaggatgggcgcagctgacctctgaaatttttgagccgttcttcaggaagtagctaagcccttacggtgcaagaaacacagcactgtagtgttgcatttctgaacttgcgttggatgggcaaatggcacacccttctctttatgcaaatggcataccttcaacgatccccatactttacgaatatcgtctgcgaatatagcccgtcgacaagatttactagattttcaaagaaacttttagatagaaaattattgtaaaaaaatacaccttttagtagtccggaaaaccaacttaatggaaacgagagggctaatttcagctcatagcagtgtaattctaagggtaaaatggtttttttttgggtaaaaatggtattttgagacactaaagggaggtctttggatacaaaccaaacagtatggcaaaaaagagaaataaacgattgcatgagtttttcaatgcaaaaatgtaccagttctcttatcagtgataaatttacgctattacattatttagctatgcacctaatatctggaaaataacttgccagcaagttggatgatcatgcatctagtgcagtgtggtggtgagccgtctgaagcacatgatttgggacctctcacctctggtcctctctctgatttgctaaatttctactaattaatgaccatcctgttaaaatgcacatgtgtatacaaaggacaggggcactttatgtatggcctctgcatgctttctttccatcttttcctaggttgatatgatcatatgatgttgttaatgtaagtttttacattagtgcctatcacggtatcaatcaatcaatcactcatacacctacatgcctttctgtttctcttcttcatttcttgcttttaatttgtcgtgtttcctgacctactcgtgcgtcggcgttggtgcgtgtcctgcttttttgcgccaatcatcaggctctccaactctttgctctgtcgatttgtgtgaacactatttataattatgtagcggtcgaaataattattccttcatctattaagataggagtttgatgatgaacaatccctacatctgtactagcagctagcggatcagagatatctgaccatttgcatctgcactacatttgtttgatttgatcctttaacctaatcaagtcaacactaatcagaagcagtagggtagggtgttaatacaacacattgatagacaattttctgaaccaaacaagggcctgattggcatagttgtccggccaaacagttttaactccagctaaaatgaaagtagagcgaggtgaagcgctcttacaaaattaactaaagatgtggagttgagtttaaactgctccataactctagaccaaacccaactctttaagctaaatttaggagttggagctctatcaaacatgccctaattattaagcaaattactataggagattatctacttgattgcagggacaaaataaatatcttaaaaaatgaacttaacaaaataacttaaaataagccgtctgaataatgcagtggaataaagtttttttttttacaaaacgtatttttcacattgtagtgcaaataatccatttcaataatgtggtcagtaatgtcagatacagcaatatctccagtgtatctccctttctttccccaaatcttcagtgaaattctgtgcccttcacattcatctgatttgtacatttcaaccttcggagcactgatattcccagtggtcagtcaactagtagttttgcagcctaccacgcactgcacattacaattaagtagtgaaacctacaaattaacaatgctaatctttgcttagtgttgcacttagcatatcataatcaaattcaacaaaacgtttggttgcctcctacttgcagcctctccccatctgtttcttgacgcagcggtcattttttgcgtgtaattttcagtcacaggcatgaacaactggacaagtcatcatcatcatctcgtcagctacaagttcggtagcagattcgttgctgcgtttttttcacaaagatcagccaaagcagtgatgacaaaattcagtactatgaattgttcttagctctgaactatctggtactgttaggtgaacaaccctgccgtttgattgcaatttttcaggagtcaggacacatttgatgctactaatcgatcggcagctagctgaatatagcaactcctacctgcaattacatggattaatgctctactccaacctgtgattacatgaattaatgctgattggattaacttgattcagaagtatcaggcatggtgaccctgactgacatcactctctggcttctttactataatggctgcgtgagattggcatgatcttgatctgttaataattttcatttgcattatttttttctgatattgacttccattatgagcctgaatgttttactcgagtgaatgaaactgcaattttggtgtgctttcgttttctgatccacagtctcatgtttgactgcgacattaaattatgtcagaactgaattcactaatccgtcgtttgcaccctttttatggacgaatgcatgattcaggcagatggtgagctgacagacaaagcacatcttcactgaattttgttgaaacagctactgattttgacatacaaactgaaatgaccaagtttcagtcatagtttacatcattcgttctgaaaaatatttttgcacgtacgaaaactgaacactgttccagataaaaacaactcaggttcatttcaaacagaagcaggtaggtcgttcgattcgacgaattcaatacaaccaaccctgtaaaatggcgagtatcaggaagcagaatcactcgtacattcaagtactaattaagaaattaaggatgatgacgttcgataacactgtcgcactcacatcagtttgaacaaatcttctctcccctagcatcgttagtactgcaggttcatcattactgctgctgttgctagtagtagtattcgcgtggcagtgaagaaaaaacccatttttatcttgaaaattgggggtgttagcttctctgccaccttcagagaaattcagagatgcagttattagtgattggagctgctagctgattgatcatgaagaagcagaagcaaagttgattagctgatgaatgaatcactgaaaagtcatagcggtgaggttattggattagtacggtgagatgagatgacaccaagatggagttggagagctgagaagtgactttcagggtatattgtaggatcgaatcacaagaactaagctaaccagagggagtgaatggttggtataccaaaaaaaccgaaaaacttttagtggaaataaaagttaccctcgaattcgacggatcgcggtctgaccgaagtgtatgcgccggtctgaccgcctgatgaatgtcggtctgaccgatgtagatcgatcggtcgaaccgccgagaatcctgctgcgcctgtcgccgccgccggtcggaccgcccgaatgctaccagtctgaccgccgcttgccgccggtctgaccgccggtagatcgccggttagaccgccgaaacccggtaaacacaaatcgaagaattcttaaagtggatgacgactttattgattctctttgtgtttacaaagtgcaccaacagcactccttacaaaaatttcgactaaactcgaaaccctaactcaaaactcaactcaattgctctcaaaagcgataatgggaagcctcacgctccccctctatttatacccgaggtaggcagcctaaagccacgaaccaaactcatactaagagtcctaaacaccttaggaaaccctctagtataagaaagaaactttacataaccaatcgtaccaaatttggactccttccaaattcgactccgcatcccatacgcacacaatacctccatcatatgccatatggaatctccatcaaccacatgcatcaactctagcttaagtatcccgcatgatctctgaccaccacggatgttgtcttatccccaagccgactcctggtccatcaccgcaaatactctcccgagacatcaagtcacctacatatgaaataaacaaagaaaccatattccgagaccaagctatctccaacttgactcattagtagcaaacaacagtattacatacgtatagtatccatctagaagccataatcaacagtattacatacgtatagtatccatctagaagccataatcatgaaataatcacggatatccaaacaaacaacccgaaaccgaaaccgacacagcgtcggccggtcagaccgtgggctggccggtccgaccgctcgatcaccgccggtcttaccggcatacaccgcctggtctgaccggtcacataaaatgatagaatcctgcgatcacctgtgaaatccaatcatctccaaaatcacttcgtgaataaattccaaataacaaaaccaataatctccaatacccaattgctcatcacagaataataatcaaaaacacctttgattttacatatacaatacagtgtcgtcagagggtttgatcagttgatgatctagtactccctccgtcctaaaatataagcatttttagtatagtgacaagtcaaacattttcaactttgactataaataacaaaaaaataaaaaagatcaatcatgcaaaattgatgttactagatataccattaaacaaactatcataatatgtaactctttttatttaaatatttttcttttatagatattattggtcaaagtagcatttcagagaccgtgtcagagtccaaaaatacttatattttggaacatggagtacgtaaatacttatattttggaacatggagtacgtttataggattatgaatttcttgacttttgtcgtcttaactaggattggatggcatgacatggtagaatgactatatcaactgttataaaggtactacttccgtgttggtgcaggtgccgtagtatagtgatctgtgtttgacatgtaagtgaattgtctaccttttctaatcagctttaagcatagaactagttgatttatgtaactcaatatagtagtataggagagagtgtcttgacttcgaatatttgtttgctcgcaattaaataaaaaaatgtaacatgcttttgttcgatacatgaggatttgggttaagttgattggtgcatgtaactcaataaactgattgagtcctcgggtttaaccattgacctttcacaaaaaaaggtatttttatgtaaaaaaatatattcaattttcattaccaaaagattaatgatcagaagtaactaataaccttttgcaataaaccgtaaagaaaatattccacatgaaaatatatagaatttcacatgcatatattctcataaagttagtaggcactcgtctagaacttgggggatgtattaccgacacatcaatccattttcttgtccataggtcaggtcagcttctttccatgatcagtcacaataacagagaaaatcctataggagcaagtaatattctgtaccaaactaggacttgtgcaggcaagatgtgatttccaaatacatttgtctacagtttgtagccatagtagggctggaattggatgttctaatagctaggtggccaaggtaatgaaattcttgcggtaggatgcaatagagtggcgtgataggctgattatggccaaagactatgggacaaaattatgcagggtttcattaatggttttccaatgtcgacttctctcctcggtcatgataaaatggcatacacaatgtaggtgcttattaatatttaatgttcaagataagatcctatcaaacttttaaaacttttgccatataatgacttttaggttttttaaaaaaaatgctatgggtatatttgcccaggttttggtttgaaatttccaaaaattttggaccccagcgtgaaactatttcgctcggaaaaaaaatagaaaaaacaattttgatcaaagtttactcaaatgcggtcaaaatattttgaactttcctaaaatccggaaatttccggcactcccggtagatttatgcctaaggaaattgtgtgccctatatttgtcttgaaaaaataattaaattaaattttgttctaatcgttaaatatttatgaccagtttctctacatacgcttgaaatattatcgaaggcttgaaatacatctccatatttctagggtctggtacacatccaacatgtgagggtgtatttttaaagataggtagagtacatcatcaatttaggatttaagtttggtgggccgcaccagttatccatctggtcgcatgtgggtctctaagtaaacatggtgtttatgtatttccttcatcccaaaatatacaactatgtaattccttcattccaaaatatacaacgtcgatgactttttacgtaacatttgatcattcatctcattaaaaaaatataaaaatattatttattttgttgtgacttgttttattatcaaataaactataatcttaacttatacttttatatatttatactaatttttaaaataagatgaatactcaaaacgttacgtgaaaagttatcggcgtcatatttttgagacgggtgtagttctatattggagaaatatgaaacaatcgaagcactgatctacacaatacatgcattccaaaagacgagtcttattatgctttgaatttatttttcacttcaaacacgagcctacctgttacatgtaaaatagtatgattccacttatacaaattacttggaatcccaaattcacctaaatagcagtttgtttatttaatattcttttacaaaatgacacccccttcatccataaatataaatgattataggttatttggcagagatcaaggttaaataaaataacaactttgatgcccacaaaactttagttgattgggaaagatcatgcgtagcgatcgatgcgccgatgcaattagtagtgagcaatactggttggattgagaaagtggtacttcaaatttctttatatttacagataaattttaaatttaacctcacatattttgtatctgtggacggagggagtcccgagggagtagttacaaaatctccacggtgttcgcttaattagattttgcatttgtttaagaaaaacaagattggtcctttacgagtagtgtggggcatggaccaaaataggcacggaaaaggtcttaagggaaaaacatgatcatggcgactttgacatttggtgaagaatctctggagttggcaataggtcagacagcgtgacaggcgtatgttgttcaccatttttctgaagaaagattttttttttaaggaagttgttcaccattttgagccgacggaaagtttagaatggatagtttagtggtatagtaaaaatagtatggatagttagtatggccccattatcaccttaaattaatagtccagatccaccctcctttcaccacgaaaatataggtaaaatatgctatatttcattttaaaacaaagaaagcacatatttagctggattatgccacaaggctatatgagttatggatggacagcccttcgatgtcgcctgagctagtgaactcataatagtaggacactgttagcaagaaaaaaaaacaaaacatcaccgcataattaaagagtattggtctccagatctcaattattaatttgcgagctctactattaataaaaaaataatctactactaatcgttagacggtactacctccgttttaaagtataacaactctcaactacgaatttagacatatgcttgtttaaattcgtagaaaaaaatagtttaatttagaataaagggagtagtataaatagatataaatgataaaaaaatataaacagatatgatccattgaaaaaatatggaaagtctgaaatatatttcaggtgagtgaatactttgaaatctcagccgtttcttctgccgttggatgcataataaagggtggatgctaaaaacccgcaaaaccaactgggtgtattaatggatctgtttgcaggctcgttaagcatgtgacaaggccagaatatacaagaaaaaagattgggctttttgtattgcccttgtctatgggctaggctttgtgtgcattgtcgggtttatgggctttgtgagctgggctttgatctttgggctttttatgtgctaaaagtgtgcttttgtgggctttgcccgtgtagctacatttattgggctttcatggctacaatcagaaatcctaaaatataacaaattataactataaatttggacagacaagtatttgttcagattgatagctaataaaaagcttactatattttagaacgaagagataattattactataggataaaaaaggcctttcagatatgcaaaggattattatcttcaatcatgctccgatgctcgccctcttgttataatgatattatcagttcccttttcgggcatgttttttgcaatttttccgattcaacattctcccaattccacagataaaaattcatatgaaattctcaatctgcatgaacatatcctatcccctttttatgtttgaaatatcagccccggtgctttgtttttcgctagttttggatgagagaaattaacttgtagtacctgatttgctaggttcaaattacattatccctccaccataaaataaaataaaaagttatatattcgaaactggacgtaggttatgttcacattcatactaccaccgtaccaaaaaacttgttcttttgagttttcgtttgtaatatttgaccattcatcttattcaaaagattataaaactattatttattttgtttgggacttgctttattatcgtaagtactctaagtatgacttttttttatatttaaactattttttagtgagacaaatgatcaaacgttaaaaaaaaaatcaaaacgatacctaatttgggggagtatctataaaagttgactaatttagggagggagctactaaattaaaattcagattaaatgcttgctactatcaaaattacactttacatgacaccgaaaacgttgcattaaaaaaacatttaccccggggcttgtgctgtgtcaggtgtggggcccacttgtctgtcgttgctcgctgagtccgacgtggactcgacgcggccacccttatccctgcgctttttccagcctacgtggcatggatggtcccacacgcaccatttgcactgcacttgccaatagtccatttatctctttttttttgtttgttttctcttgccagagaggaccaataatttgtggccacgaatccatcgagcgtcaataggttgggttaaaactaacagaaatcaaatctcacaagcgtcaattttgtagagaaattaaaaggagatctttttaccaagcactcaatcccattggcatcatatccatgaatttataatggtacaatcgcattaagctagtgcccaaatttattggactggaaacgaaattaccaactgaactgaaaaaatatattttttcagcatggttgaattattttgcaaaacgtatatgttttattttttatgggacatgtattttccgactcaattcaggtcccgtcgctgtctccggtttggaaatttctttgattgtctgttatacgtattttcacgaattgtgattatcctaatcgttcaagggaacatgtggttgattttgtaaacttaatcgaagttggtcaaaatcaacttttagtttgctttgcacgagaggttatttattggtcaacagtatgtaaaacggtttattaaaactttggtcaggtcatgagaacatgccttttttgacattgatgaataaagtcataaagatgctacttatcactaatttacatcacaaaagaattaccggccccaacaaaataataatctaagaaaaatactttttcagaaaaaagaatatagatatgattttcatcgacccaatcgaaatatattaaaataaagcttcacctgaaacattctaaaataacatgttttcgtaccaagagagcgagtatatatatatatatatatatatatttattaaagcatgtcccatggtacaataatctcgaattagtggttcaagaattttgtcaaccaatgatgacacctaatcggaacaaaaataaaaacatgatactactactactctctccgtcccacaatataagggattttgagtttttaattgcaacgtttgatcactcgtcttattcaaattttttttgcaaatataaaaaacgaaaagttgtgattaagttactgtagataataaagtaagtcacaaataaaataaataataattttaaaaaaatttgaataagacgaatggtcaaacgttgtaagtaaaaacttaaaatcccttgtattatgggacggtgagagtacttaacaacccacagaaaaataaaataaaactataaaagcaaggaaaatatctggagtaaggaaataaaaacaagaggcaggagaagctttacacacaagcacaatagactatataaaaacaaaaaagaaacaaccaaataatataataataataataataataaattccctttcccttcaaaagaagaagcagagcgacctgcttttcaagaagccatggccgcctcctcctgaaatcgccgccggtttccctctccggctctcccccacctaaatgcatgtcgcccgccggtggcggtcggcggccgtggcgatctgcctgctgccggtcgtcctgccgctggcgctcctctgcctcccgctgctctgcttcgccgtgaccgtcgtccggttcccccgccggcgtcggctaagtatgtccgcgaggaaggggaaggcgcccggctgctgcttcgtcaacggggaggagcgaacgtctccgtaaaagaaggagggcggcgggatccgcgcggcgctgctgctccagtatctggaggaccagatggagctcgtcggcgtcggcaacgccggctaggcggaggagggcaaaaaagcatcggccccaattggagacgagcatcacgagcttagctaagcttggagatcaagattaatttgacgattttttttttgttgttgttgtttgattgatgatatcctctgcttcttggagaacccaccttcgttacatgcccaaaaaaaattaagaaaatatttccttttctttgctcgagtttttttttttgttgctgcagtagtagatatatattattaggagaggtgtcgttgagagcatgtgatctaggagtatttgattagatgattcatgcaggtgatgcctgacagcttcatctgttagacaattggattgggagttgattgttcctctgccctgtttatcctctgctttttttttgctcatctgtcttcttgtttcagttattaagcctaagtatatcatctgatcctatagttgcagtttttttttttgcaagttagttgcagttgttgagagctactcttgattagttgtaacatcccggcctagggcttaataggattaatagaatactcataccaataagttacaacttcttttccggaagccaatctccaaagaactctagggttaagcgtgcttggcctggagcaatttgggatgggtgaccgacctggaaattctttccgggtgcacacgagtgaggacaaagtgtgtagaaaagacatgtgaggcatggtgcgcatggcacatgcgctggcactggacacatggacgtggccaagagagtgagggcagtctatgacctatgaaagctatcagatgtaagtgggcccggacgttacaaagtggtatcagagccgactctcgcggtttcacgggcgcgtgtgtcgcagttgcgcaggcatggtgcgcatggctggtgttacaaagtggtatcagagccgactctcgcggtttcacgggcgcgtgtgtcgcagttgcgcaggcatggtgcgcatggctggtgtagaccgggagtggttacacagcatggcacatgcgctggcactggacacatggacgtggccaaaagaggacgttcctggcctatggttgatcgacgggggcgtcgatctctcttaagggggtgagggtgtaacatcccggcctagggcttaataggattaatagaatactcataccaataagttgcaacttcctttgcaacttcttttacggaagccaatctccaaagaactccagggttaagcgtaagacatgtgttggtctgtgagggcagtctataacctatgaaagctatcagatgtaagtgggcccggcctgggggaggcgggacgttacattagtacttccttcatatttgaatgtaccacaccggtgacttttcgactaatgtttgaccattcgttttatttaaatttttatgttaatatgaaaatatttatgtcatgcttaaagaatatttgatgacaaatcaagtcacaataaaataaatgataattgcatagattttttgaataaaacgaatggtcaaacggtggacaaaaagtccacggtgtcatacattaaaatatggatgtagtactagattaattgtgctagagacgcttgatagcttcatctattagccaattagactggaagggttttgctcctctggtgagtcatcctctgaacttttgccgcctcagatcacaacagatcctagatataactcttgactgagcttcaagagaaagggttagatttttgagtgtcaggatggaaatacatctattgtatttatggcgtgtgacacatagctgtgaagaggggatcaccagtttatcatctgccttttgctacccgacttataatcgtagagagtgaggatttaacagccgtgcttctgcatacaagataacgatgtgtacccgttatattcttgttggatccacccagaagcgtcatacttctactgatggatcttgactaatagggcgaccttttctttttagttctcacatagctccacacgacacatacttttgatttacagctagaagatgtttcatgtggctatcagatgccctcacgctttcttatacccaatagacgg

SEQ ID NO: 3612 - DNA, 739 bp, Oryza sativa
  unsure (1)..(739): unsure at all n locations
ggttagctttataagcatcttgttgagctttgtctacgttttcttgtgtttctctaacgtcatcgtttagtttatacgtatctgtatagtcacgtagacgtaaaccatttagccaagatttttcacctgttgtatcacggttcaacaagaatccaagttgaataaaacctgtttctactgggataatcgttgtattagcaaactcagaagagccactaatcaaatggctgtacttggtgtacgtagtaggtacttgtatatttacgtgaccattcaaatacaaatatgtggagccgtcagaagttgggctaagtgtatgccctactgggaaaatcccatctgaactatttgggtttgcaactgcccatggcttgtttaacgtaatcttgttagctgtggtgtcaactgcaccaatatcatatgtcctcatctgcattagctgactatacgttccatcgggataagtatagccgaacgagtttttataaccccacatgataatactacgttggtagtcttgcggtgcctgtccgttccatagactaacatcttctacaaaaacctctgtatccccgactttaagtggttttgctagttttgtaaatttaacaggggtagtagagttgtagtttcgtcccccaagagaagggtacgtaatacggttaccatctacgtcatatggggcaatcatagcataacttctaccgactcctaataagagctgntcactcnnccatca

SEQ ID NO: 3613 - DNA, 24417 bp, Oryza sativa
  unsure (1)..(24417): unsure at all n locations
cctgtncttgagggttgagcatccctctgcaagnaccncancaagaaaagcgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccaatcaaatatattccactttggcataagttcacattggcttcctcaaatatatatagntttaatctaattcttatctctcaatcgctcctctaattattaaaatcgatgcaaaatgacccccttgatggttttgagagcggtttttttgctaatgtagctcattgacttagtttgaccggctgattcagtgtgagacccatatgtcagtgcatcctcctcttctttctatttttctctctctcctccctcctcttctcttcttggtcttcttggaggcaggggacgatattgtacatgcatgggtggcagccgagcttagcgcctacggcgaggccgtgtgggtcctcgacgccaagcaagaggtgttgagcctgttggcaccggtgacaccatgtgcgtggtgcgatgtcatcggaagtgaggagccaaggagctcaatcacccgctccacggtggtgaagggaggcgaggagccaaggcgcatgggcggtgcccgagctctgcgtctatggcgaggccgcacgggtcgttctcgacgccaaacaagaggtgttgagctggtcggcgctagccacgccatatgtgcggcgtgatgtcatcggtaactaatataaatgaattaattactaatgatatcaatttttttttcagaacagatatcaattagagtagttaattgatggaaacccacctgagttcgtcgccgcggtatcgcagtgcgcgcgacgacaagcggcggtgtcgcggggctagcattaatttggtcccttttctatagtgtacaattcttgttccaaattaatctatacgctctagaaggatgattaaatttggaaatatattaggatgtaattttttttggcacaaatataccattgatatcgctaaatctttgcacgaatataacgatggcgtgacgagtcgacgaagagcgccacggtctcgtgggacgcgagatgggcggtgtcacagtgcgttggcccgaaatggacaacgttgtcgtagaccaatcttcaaactttgaagattagtaattaaagcaaaccttgcatgaattaagtcttccttattacacggggcacatatgtggtagaaatttagtactcccgacattccatatggcttgcactagtcaacacagtgcatgttaaactgttaagccatatggaatgtcgggactggtactttgataatagaatatttatacctttttttttcataaagatgagtggtccaagtttatacatgaatagtatcttatatcaagtaagagggaacggagggaataatagcatcaacaattaagccaacctagcatgaagatcaatggaagacataaacgttgtactcgacaatggcatcaagtccgtttgggtcgagaaagtaggtgcgggcttgggcatagccacgagcgaagcgaaagtggccggttccgcccaaaatcggcatctcatggataatgtcggatatgtggttgctgccaagcactatgaccacgcttccattatacgacccagcggtgagcacgatattcatggcctgcaagaagcctatccgggcttggtcagacgagacatacatgccctgggcatggcccacgagctttgatgcgggatcgggccgttcggtcaatgggtcatccatgacaaccaccatccccaagaaggtcaacgatgtgttgtttggggggtttactaccctcaccgctgacggtgacggactggtcaccttgtcatggaagtattagtgtaagtgcgtcggcactaaactgttgcctaaggcgttgggcctagacctgtctttcatgtcagccttagtagtagtggccaacacaaataagagtacactcatcaccggcaatcctcttgccattttgatcttagaatcgaatttgcgttaatttgagtcgagtggatgatatactcatgacctatttatggaggcaagggataggacaagtgtgaagcagtgattgagggaatcatggatatctattgtctcctcatgagcaatggatatttcattgacctgtccttgtagaccgagtgaacaaccgaaagagaataagagattgtaatgttttgcatttaaattgtgtatatgtgtggacagtattgaggtacatatatgaaaaatgttactatcactaaaataccccaaactagttggctatttttagttctccaaactgaaggatgcgttaagttaatttggcacattatacgtacaaggaaagactgaaagcaaggtcctaaccagcagcatcatagctagtcaatcaatgcccaaagtccacacggtgcaatatcagttgtgcacaaaaatatgctcctagagggaaaaaatatatgtttgaaccaaatcctagaaaaaaaaaatgaattgcgtgatgcattaagattttcagcgccaacaatgtagtataaatgaacaggaagcaatggtaaagaaattaagcacaaaaaaaacatgctgtaaaaaaatggaaacattgacaattgtgaagatattatttatgtggaatgtactacgttacacttctcacatagtattacctccatcccataataattacatttctagaaattagagatagattaacatcaaacacaatttatcacaataaccatatatatttaataactacactgcatgcgcatattctatatgtctatacttgattaaaaggaaagttgagcaacacattcgatatgtaaacttaattaaaatgaaggttgggggtacacattccatttgttgttgtgtcccatcttaccagaaatacaattttttaagataaaatttgaatggtagaaatacaattattatgggacggagataattcttctataaaaatcaagcaatataattatacttgcgtgtagtagtatgcagaggaaatagttaacatttggcaacaaacatccatgaaattgctgtataaggcccttaacaaacttgttgcctctgtagaaaaaaaaaaacttgtgttttcagactactcgagacaatcacaaaaacttctgtaatatggcatggttggcattatcgttctaaaaaaaacagtttgttcacattcaggtttcataattgtttacatatgcattttgtacccgtttctacaacgaggctttgatgaagtggcttaacaaaagtttgttctaatttatctcgttttcttgagaaagataaattaacttgcacatctaaccggggaaaaaattagcaggatggacataaattaacttgcacatataaaagatgattaaaaaaaatcaaaatctcttatactgtgaaacggaggcagtaccttaacattacaacttaattaaaatccaatggcaacatgatatagtttgaaaggttcgctcaagaaaagaattattgtgagttcacttacgaatttaagcatctattgcagctggttgcagtgactgcggcacatcacatggatctatcgagcttaattcagttggaaaccacctggcccgggtgaccgtctccaagaaactgtgaagcgacaaaagaaaatctcacaagaaaacagttcatcataagatgcaaacaaattttaaagtggtttgcttgcttggatttttttttctggtattcatgcccccatctccggcggccggcagcgccacagccaccgacactagcatgggcctcttccgcacggtctgtcttgctcgtcggtgcagaagaggccgtaaataggcccatcgagatatgggccgtttcatcggtactctctctgtttcacaatgtaagtcattttagcatttcctacattcatattgatgttaatgaatctaaatagatatatatatatgtttagattcattaacatcaatacgaatgtaaaaaatgctagaatgacttacattgtgaaacggaggaagtacgttttatatttgatctttaccttacccatgaattaagactcaaattaatttagagtaaatttcaactaaccccatgtactattatggtctaaattgtacagaaccacgtgggttttgacacgtaacacataaccttgattattatggccatgaagttttacaaaaccacactattgatcattttgaattataagctatttattccttatataagtgttacatacatgtaaacatacaattttgaattttgatataggagtatgtcgatttggttaacgccatgtgttgatggactatggtgcccacctacgatatttgtagagtatgaaaaacgttgagatcatatctagctagcagacaagggacaagtgtttatattggttcggggccttaagatgactaataaccctacttccatttatatgtatatcagggaaaaagtagattacaatcaacgactagggctttggcttcctccgaattgtatctcgatattgctcttgttatggcttgtaattcaatatcctccccttattgggaccctgtatttatagggatgatcatctttttctcaaagtagaaatcagagaacctgaattagatatggtccaagaagaccttattttctctgaatatgactttgacatcttctatccctagaaaacaatttcctttcggatcaccgtattaccttaattgactatatattcctgtatattattaggtatgtggtactttcatatagcacaaacccaaatataagaggtatgtcttatccttaacagttaacactaatagtgtggttttagaaaacttttggaccataattatgtgtcacatgctaaaatctatggttttatgtaaattggctcatgataagtggggttttataaaatttagataattttttacctagcttaatattactgttacaggaagatctgtgatcgagacaagagttgttggctggaatagacacaccacataataatctctatttggcaagcattacaacggcagcttaattttaaaccaaacaaaatcttgatctttttaaaaaaacaaaaaaaaagaagtaacgacagcacgtacgatgcatgagaaggtgagttgttataatcaagcccacagatatatcatatatagcggtatacccctgccgatcaatggaggcacgtgtagaagaggcatcaaaatttaaataactaaagcatgcatttccaccaagtatctccatccatcctaaaatataaggcagaagattttggtgaataaaacatatcctaataccatgaatatgaatagagagttgtccagattcataaggcttgtttgggggagcttaaaattttgagaagcagcaactgagaaactagctagtgagaatctggagaagctgggaaacccagcttctgtcttctagttcattttccagattctacaaccacaaattcttagaatttggataaaaagctggactgttttggtgagcttctggcaagtggtaagtactggagattctaggagaagctacagctgctaaaagctccccaaacagacccatagtagcagaatgtgtctcatcgaatatcatagtcctttttatattttgggatggagaaaataagtgttaaacaagattgaagaaatctaaaccaagccagctgatcttcacctactgcatctactacttctgtcagcttcctcagagtccatatatatcccaacttgcagcgtgtatgccgtaaaagtatctagtatggactatggattacttcattacaaattaacccattacccatcatatgcaagatcagtgtaatcatgtaatgtaaaggcacaatctcgtgctgttttcccttaaaagaattgtaatgtaaagtgaatactaaactgatgaacacacaagatcagctaaaatcaattaactaatcctccattgctagctagatgtattgcatgccgcatgtgcagatgtgctagcttgcagagctagttgtcttcgtcttcgtcttgtcctttgtctagagatttgtctagggagtagagacgacgatgacgacgacgaaatcatcgaactaaacacaaccaccaccacccccttgcctttttatgtagatcaccctatagctacctagctttaattatatcgataaattacctgtgaagaatatggatattccatatctacatgccagttataatttaatcggatatccggtaccaaatatagatagaatatctttatgaagactcgggttagttttttacttgtatgtcaaggaaatacccgagatcttagtcggtcacaattgtattttatctataatcccatattccgttacgataagagttgtattttgtaaagcggactccttcccctatataaggatggtccgtgtgtctctcggggcgcgattcttttttccaatttatacaatcaataacgtactcggcggaatcatccccggacatgagtagggtattacttcatgaatatgaaggcctgaacctgtataaaattcattgtctccaaaaccatcaactttcctagcttgatagccacccccttttattattgccgaaatcttgtttcgacagttggcgcgccaggtaggggcagcgtcaagtttttgccgactaagtgcgatgggttccgtttctggcatcgacaacttcgccttccctcccgggcaggcgttctggttcggcagcctcaacttcatcaccaacgacttcggcaagatctctctccttgactcggattcgaaccagtcggggagagaccaggtccccgtgccgtttggtattccgaactcggccgaggcctactccaagatcatatcttccgagtcggcttcaaaccactcggacgagatccaatctactcctccgcgaccagatcaagacgacgggtcctatccttcaatcttgatgaaacttcctgatgacttggctgccgtcttcacagccaaaacatctcccactcggagatctaggcgagctccggcatcggccccgatctagtctagatccagggaggttggcgttatactccaacctcttgggacagtctcgacggaagagatggatggctacctcagctcccccggcgtcagttcttgaccaaccaagatcctcgactacgacgacttcggctaccactatgaccacggcgacctcgacaacttcgacgacagctatgaggataactacacgcccctcttcttcggcgtattcatggctgccaacgaaacggaggaacagcgccgagcccgagaagcggaccaagatcgcgcacggcaagaagctgaacgtcgccgactggaggaagagcgacagcgacaggagcgagaacgactacagcgtgagcaacaagatcacgaaaggattgcaaaggaggctgaagatcgacggcaacgcgccttggaatccgggcggcgagcgagatagctcattgggcaacaagacgtcgacggaacagcggtctttcgcatcccccagcagaacgcggttgcagcaatcactctcctcgacaccctcctcaaggaagacgcactcaactaagctgatcatgttgtcaacatcttgaaccagacgaagaccatgatcgctgcctcggttccagccaactctgcaagcacccgcaccccgactagtagccaagtccctcatcttcgatctcaagactatcaccagccaagcctcagcattgccggcgccggatctagtcgcaggagcagaggacatgatgaacggtctgttcgttcgcctcccgaacgatatagggagcgtcgagttgaacgaccacactccccacatcgaaggcgccccatcgatcttcgcgacaccatcaaccagcgccgcgcagcaagaggccaccattcaccagatcgttatgacgatgatgtggacggcgttgctgccttcacaagcgatctgcgtcgagtggattggccagccggctttaagccgactgaaatcgagaaatatgacggcaccaccaaccctgagtcttggctcaccgtctatggtctcgcaatccacgcagcaggaggagatagcaaggccatggcaaactatctgcctgtggctctagcggattccgcccgatcctagcttcacggactaccccgtggcatgatcggatcatgggcagaacttcgtgatcacttcattggcaacttcagggcacctttgaacgccccggcacacagtttgatctctacaacgtcgttcagaagtctggagaatcccttcgagattacatccggcgcttctccgagcaacgcaacaagatctccgacatcaccgacgacgtcatcattgccgcctttactaaaggcattcgccacgaggacctagtcggcaagttcggacgcaaacctcccaagacggtcaagcagatgtttgaaaaagccaacgagtatgccaaagccgaagatgctattacggcgtccaagcagtcaggcaccacttggaagccaaagaaggacacgccgaccgcaggagggagtggaagtaacaaccgcaaggatcgcaagtgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacttaagccttcaaacggagagcaaggcacatcaaagaagaaagacgatgaagacgatgccccgactggttttcaagatcatcgcaaagaactcaatcacatcttcggtggacctctggcttatgaatctaagagaaagcagaagctaacagaacgggagatcaatgtgattcagcccaacatgccccaataccttcggtggtcagaaatagcaatcaagtttgaccgctcggatcatcccgaccgagtggtccacccggggcggtaccccctggtactagacccagtggttcgcaatgtcaagctccgaagaactctcatcgatggtggcagtgcactcaacatccttttcgctaagaccctggacgatatgcagattcctcgcacggaattaaagccgagtaatgcatccttccacggtgttatcccaggattatcagctacaccactcggccagatcactcttccggtcactttcggcactcgggagaattttcgcatagaaaatgtttgtttcgaagtcgctgatttcgagacagcgtaccatgctatacttggatgaccggccctagccaaactcatggccgtcccacactacacctacatgatgatgaagatgcctggtcctcgaggagtcatatcactacgaagcgacatcaagcaagccgtcacatgtgacaaagaacgttgcgagatggcccagacccgcgagattacactcgaccgagaagagatccgactggctacgaccatggcaagcgaaggagaagtgcccgcaaccaagatgctcaaaagcggagaaagcaatgctaagacgaaaaagattcccttagatccctctaatcctgataagactgctgtaataggcgctgagttagattgtaaataggaatgcgcgctcatcacctttcttcaaaataataaagatatctttgcatggaaaccatccgatatgcctggtattcctagagaggtgattgagcactctttacatgttaaggaagacgccaaacccatcaagcaacgactccgccattttgcacaggacaggaaggatgcgatcaaggaggaattaaccaagctgttagcagcgggcttcatcaaggaagtccttcatccagactggctggctaacccagtcctggttcggaaaaagacggggcaatggcgcatgtgtgttgattacaccgacctcaacaagtcttgccccaaagacccttttgggttacctcgcattgactaggtggttgactcaacggcaggctgcgagttactcagtttcttggactgctactcgggatatcatcagattcgactgaaagaatccgactgcttgaagtcctcgtttattacacccttcggggcctactgctacatcaccatgccctttggattgaagaacgcaggagcaacctatcaacgcatgattcagagatatttctcgactcagatcggccgcaatgttgaagcttatgttgatgatgtagtcgtcaagaccaagcagaaggatgacctgatcacagatttagaggaaacttttacaagcattcatgctttcaggatgaaactaaaccctgaaaagtgcatcttcagagtaccgtcagggaagttgctcgaatttatgatatctcaaagaggcatacaggccaacccggagaaaatcaacgccatccttaacatgaaaccgccaagctcccaaaaagacgtccaaaagctgactggttgcatggcggcactcagccggttcgtctcacgactcggcgagcgggggatgccctttttcaagctgctgaagaagactgacaattttcagtggggacccgaagcacaaaaagcctttaaagacttcaagagacttctcaccactccaccagttttggcctcgccgcatccacaagagccgctactgttatatgtgttggcgacctcccaggttgtgagcacgatcctggttgttgagcatgaagaggaaggccatattcaaaaagtccaacgaccaatttattttgtcagcgaggttttagccgactccaagacaaggtatcctcaggttcaaaagttattatatggtgtcttaattaccgtcaggaaattatctcactactttcaaagtcactcggtcacggtggtcacatcgtttccactcggggatatacttcataatcgcgaagcaaacggacggattgcgaagttggccttagaattgatgtctttggacatatcgttcaaaccacgaacttcgaccaagtcacaagctttagctgatttccttgccgagtggaccgagtgccaagaagacatgccagaggaaaagatggaatattggactatgcattttgatgggtcgaagaggcttacaggcactggagctggggttgttttaatctccccgattggagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctgtctagatgatactatgaccgcttatcgacaagaggtacgcaagttggaagacaaattcgatggactcgagctcacccatgtccttcgacataacaatgaggcagccgacaggctggccaattttggttcaaaacgggaagcagctccttcagatcagatgtgttcgttgaacatctttacgaaccaaccgtgcccagaaaagagacaattgaagccatggatactcaaggcgtgagcatgatcgaagccgactggaaagaaccgttcataaaatttttgagcaaacaagaacttcctcaagacaaaaatgaagccgagcggatttctcggcgcagcagactttacattattcatgaaacttatctgtacaagaaaagtccatcaggaatactgcaacgatgtgtgtctttggaagaagaagacaattgttgaaggatatacattctggtatttgtggtaaccatgccgctgcacggactattgtcggcaaagcttaccggcaaggttttttctggcctatagctgtatctgatgctgacaagattgtgcggacgtgcgagggttgtcaattttttgccagacaaattcacctaccagcccaagagttgcaaaccatcccgttgtcctggccgtttgcggtctgggggcttgacatggtcggcccgtttaaaagggcagtcgggggttacatgcatctctttgtggctattgacaaattctccaaatggattgaggctaaaccggtcatcacgattacggcagataaagctagatattttttcattaacattgtgcatcggtttggggtacctaatcggatcatcactgataatggcactcaattcactggcggagcatttaaagacttttgtgaagacttcggtataaaaatttgctatgccaccgtggcacacaccatgagtaacggacaagtcgagcgtgctaatggcatgatacttcaagggataaaagcacgagttttcgaccgactacgtccctatgctggcaagtgggtcaatcagctgtcgtccgtactttggtctttacgcactactcccagtcgggctaccgggcagtcgccgttctttttggtttatggtgcagaagcaatgttgccaagtgaagtggaatttgaatcactacgattttggaacttcaacgaggagcgttatgaagagggccgagtagacgacatcaatcgattagaagaagcccgtgaagcagctttaattcagtcgactcggtatttgcaagggttgcgccgttatcataatcggaatgttcgatcgcgagcctttttagtcggcgacctggttctgaggaaaattcaaaccacacaggatcggcataaattatctcccttatgggaaggaccgtttataattgctgaagttactcggccagtgtcacatcctgattttcgtttcaggatttataaattatttaataaattaataatagaatttatattaaatgttcattaatttacaagtgaagttaaatgtgggaaataaaatttcctaaatataaagcatggttggatttaatttttattaaattctccatggttaattatactctctggaattttctcggattcttcggagctcaattcttaattttaatcatacaaagagcatttcagtaattacccacatattaaattaatcattaaatggtctaattataatttttttaagtactttgagtgtccaagtattttcagaatttttcttgaaattatttgagcattggaagtatttttaacaattgaaagatcatttaagtgattattttaattggaaaaagtttttaaatccttccctaagtcgttgggccgatttcggcccaactctttctctcttcgcgcggccgaatcggcccaatcggcccagctggcgccgaccgccccctcctctctctctctgtcaaagtctgttttgcctccctccttcaatcgggccgaggaaaatgaagcccgtcaaaagtctactttgcctccctgctacagtgtcgtccctaaccttcagccggctgcagccaggccgagcccgagccgccaccttgcgccgcctttcgacttcaaatccgctccaatccgaccccgtttcttccggatttttgaggggttttgatcctctcatccttctctatcttttcccccaagaatcggagcaaatcgttgggtattttatccgaatcaaactcgttttcgagtttatctccaaaaccgagttttgattttcccggatcgatttcttgcgggaggagtccgatctcttcaatccaaggctataaataggaccccctagtcctcctctttcgtttgccccctctcccgtcctctcccgtgacccgtagagccgtcgccaccgtgcaagccgagtcgccggccgtcgtcgttcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcgtttttctttttcctgtttttctaatagattaaatcttcggaaattcataactaaatcatggtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttacattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcatatggttttgatggttgtgctcatgacaattaaggaccggttcgcgagctactgttgtgaaacatttaccgtgccaaccacaagccagcatgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacgataattatggatgctataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagccggagcttcgctagattttatttttccgctgcagttttcttcatggtgaggactaagtgcctcttaagtaagtatttatcgttttagttaatgtgataaatctatatattaaattgtcagtttgtgtacctcggctgattcctggacgagggtttaatgcacaaataagttcggaaattactagtgaatttccgggcgtgacagccaggttcttatcgactcaagcgcgaagatggtactcccatcaacaattcttagaatattgaacaccttcatcaattttatgcttaggcattacgtttgtatctttcctctttgactgctaacctcaagtttttccttgaagttttcagtcggggggctactatgataataattgagtgtgatttttatcaattcaatttgcttacttgatttatcattgccctgtttggtctttcgacttagtcaatgaggactgaaggtttttaatagcttttgcgggttttaggctcaataaggctagataaaggcttttaagaaatcaaaagctaagtatggaacaccaagcatagcataaattcatcagtattgtacaaattgagcctccatcatcattaattatcaaaatcattgttatatcaatcagtatcagttttttcatcatcagacttatcagatccagtcggccgaaggtcgacttcttggaatctttcaaccacatcagcagcaatcttgtcagcggctttctgtgcatcgttaatgaggtcaagagcagcttcttcgctcgtcccgtctgcaaagccatcaatggcatccatatcaacccttggataaagggatttggtcatcgccaatgccagacttgctcccatacttccagcttctttgatattcttgaaataagtatctggagcgactctcagcttgtcgaagatttcggcagtatcaagtgtactcgaaccggcgttattgaagaacattgcctggatgagtggagtagcggcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagccgaatcccactgtcttgccagctctgccttgtcattttccagagtttggatctgcttctctagttgagatatcttggcagcttgcactacattaacttcggttaatcaagattacagagataacagcacaaatcagttgggcagagtttgcgcgaacctttggatgagccactcagttcaaaattggattcctggagcttagcaatccgatccctcagatcgtgttcattctttctggcaagttctctggcctcgtgcagttgactcctggtggtttcaagggttccaagatgaggaactagtttctcaagggttgcggttttcgcctcgtttctaagatgaatcctctgcagagcagtttaatcagcgctcgagccagacggcaaacatgatggctgaggtcaggtgtcaaggaacttacatttacaatgcaagtcgcttggttgagtgccttcttcagtaggcagacttcttcatcttctttttgccggtttattacaattccttgaggttgcaagttgtcatcccaccacttgaccagaatgggagagcacgaatcttcggcaaagtgtatccacttgaccacggtgaatttcttcttcatcaccaatcattggtcctaatgtatccactgacaaaggttagacaattgatcagagttatttgggtcaacatggtttcagacaaagtgtttacccgtaatgatttctggacgaggacgagtggattcggatgcccttaaaggagatccagatctccagtcattgctggcgtcttgtccgcgagggttgtctgcttgggtttcaacttctagaatctcttggcttggccctgcgtccgactggtttccagtcgggggctcctgattaactccggcttcggcttcggccgactggtttccagtcgggggttcgtcgctgggttctacattgttgctggcctacagattatcactcgggagatcttttgcagtcggcccggtttcttttgaggaactcgcctccatgttggtcgggtcagagtcttttccagatgggtctatatcagatggtttcctgcaagtttgattgtcagtactattatcgcaatgggtacgcatcaatgcaatgaagatcgtaatatgagttgcacctagaagacttcctgatctttggcacaagacgactggatgttttcttccttggagtagcctgcttcggcagtttattggttgcctctcggtctccaagctttctagcagtgtcgccttcgtcgtcacttagaaccagcttcctcttgcgagaatttggctggccgactggatcaggagcacttggttgagtttcagaccggattcttggtcctccgcttccctgaccagtttggcggtgaggtgattggcgttgagcgattggcggatccgatttcatcagagcaaattcctgggcgtgacatcctttattgttaactgattcaacaaacagataagaccgtattctgtgaaaagttgaagtgttcggttacataccggtggaggaggattaaaggcattgaatggcacgactggcagcaagtgtgaatagctgacaacgatagcattagagaagatcttatacatcctttccttcatgaccttgaagtcaagagaatctggatcttcacgatttgggtcgtgcttgccgtcaaattcgaaggctgtgcgagatctctctttgattggagctaaccgacacttgataaagtgccgtgtgatctgttctccctgaaggccttgttctttcagctttatcatgcgctccatcagttccactgcttgtgcagcttcgtctcccattggcagtgagttccaagtatcccgataaactggaggaagacaggagtactcggggagagcaggctcagggttttgaacataaaaccaatttgcatgccagcctttgtttgaggtcttgaagggcatggagaagtatttttggcttagcgttccccggagttggaaaccagcacccccaacaacacatggtttgcttttgtttggctggggcttgaggaagaagatgcggcagaacaaggcgaaatgaggcctaatgcccagaaaagcttcgcaggcatgaataaaattggcgatatgcactatagagtttggattcagatgatgcaagctaatcctgtagaagttcataattccccggaagaaccttgaggttggaagagaaaatccgccatagaagaaatgagcaaataccacgatttcgtgtgtatcgggggtcgggaatgcttcgccgaatgctggtcgccatccgatgatctcctttgctggaagaacgccgtgcgccaccatctcctttagattatcttccgtcacatcggaggacgcccactggctctcgaagctttctctctcttccgccatgaatgtggactggatggtttgatttggtccgagatacggctggaaagggatggggaattggagcggtgaatgcgggtagaaattttgtggagtgtttgaggatggattggagcggattgctgaaccctagcttggccggcgcagtttgtactgtagcaggaaatggggaaaatggtgagagtctcggcggggaagacgaagagacatttttcacttcggtgatattagagtatcgggagcgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaacacgatgcaaacaaaaggtgcccgacagaaaggtgttataccatttttgtaagctttattaggctgcaaaagctgtttgggttgatttgagatgactggtttactaatagttattcttttagcatgttatatgcttattttggttattgtaagggtcacagcctaggctattagacccattaatcaccgtgattttttatcatgtttggtgaatcattttaagagtttcttactcggattcctatcaaatatgtctatttttggaccttttgagtgttaatcactcggccctttcatatttttttatccttgatatgttcaaggagtgttgataaaaccactcggttcttgactacgtgtttagtttttcaactaattacatagtcgggggctatacctaattaggtgcatctactcgatgcaccatgttttattttcgcccttcgcagtctttgattttagcactcggcaaactggagcaagttgaattgaagcactcggattgctgttttttgtttcgagaaggttgttttgtcaactgcgaaggtctcgggggctactgtggagaatatggatatcccatttctacatgacagttataatttagtcggatatacggtaccaaatatagatagaatatctttatgaagactcgggttagttttttacttgtatgtcaaggaaatacccgagatcttagtcggttacgattgtattttatctataatcccatattccgttaggatatgggctgtattttgtaaagcggactccttcccctatataaggagggtccgtgtgcctctcggggcgcgattcttttttccaatttatacaatcaataacgtactcggcggaatcatctccggacaggagtaggatattacttgttgaataagaaggcctgaacctatataaaattccttgtcttcaaactcatccactttcctagcttgatagccaccccttttattattgccgaaatcttgtttcgacattaatctagctaattaagcaatggcagcctcgtcgtccttcgtgctcgcggcggcggcgctactcctccaggccgtgacggcggcggcggaggcggcggggcaacaaaaggagatgcggatgcgtgtgtactggcacgatgtggtgaccgggccgaactcgacggtggcgaaggtggcggaggcgccgacgtcgagggcctccgcgacggtgttcggcactgtgtacgtcatcgacgacccgctcaccgacgggcccagcctgacggcgccgtcgaggctggtcggccatgcgcaggggatgtacgtgagcgccgggaaggagacgatgtcgctgctgatggcgatgagcttcgtgttcgccgccgatgagccgtacaacggcagcagcgttgccatcttcgggcccaacccggcgaggccggtgagtgagatccccgtggtcggcggcaccggcgcgttccgcttcgcccgcggctactgccgcgccaccacgtactggtacaacgccgccggcgacgccaccgtcccgtacgatatccatatccgccacgattaactgattcattattattcctttgtgtcaaaatataagaacctaattaatatcggataggacgtatgaaatatctaatccgatcatagaagtttatattttaaaacggagggagtaattagttagccaggtagcgatacgttgtgtgtcaattactactgtatcatgtactacctctccatcccgtaataaagttcattttaattagcaccttctatttagcataaaataaatttatttttagagtaattattaaattagaatttattataataaaaattattattttaaaataaggtgaaaaatagttacattgcgatttgataaattaagagtaatttagctttcttggttttatattggtatacatgagatggatgaaaaatgaaattattttaggatgagaatagtattaggtacatggggaaaatgattttatctctcgagggatatccctagtttcgtgcataccacctaatagtcataaaaaatatgaaaagaaaattagcaacatagattaatataaaatatatcactccacaaacataagcaagttaaaatttaacttctacaagttataacaaaaataacaaatatagttgcgaatatacgataactatttttagtttaatttgttatttttgttacaacttgtagaagttgaatttggtcttgcatgtttgtggagtgatatattttgtattaatctatattataaatttttttaaaaaattttataaatatttagatggtatataaataacgaaggatgttccgtcgaggaatgaaaatccgtatcctagctacatgttgcatgcgggcatggaacccaaaacaaccatcaacattttaacaaaacaaattaagataatatgttacgttgtaatgagtactccttattaacatagacgtcacgtcagtcatacttcgagcttgatattattttgacattttatttaatgagaaaatatattatagttgactttaccgttgagtatcgtgattaaaactctggcctcaaataagatacgtcaagcgatatgggcggctgttaacagtgaaatttgataatcggtaaagacgccatccgcttagaatcattatcggctgcagcatctcggaatcagccgatgggagttatcaagtcgccaatagtcggattcctgctatattcggttaaggaaatcaatctattaaagggagcttatccctaagtgaccgagtttaaagaggatacggcatggcagtttatctattaattaggaatagtttgttagtttccttttatctttaggaaagtgtgtttagtgtccgataaggactttatattttccttttatatttaggttagtttctttcttatctttaggttagtttctttcttgtccgacaaggacttgtatcaacccctgggtataaatatgtacacccggggtctatgtaatctatctccacgatcaatacaattcggagcatcgccaccctttttatttctacttttgtttttacgtttcggcggaacttggcacccgacgcggggctgcatcgtcttcgatctccggtgaagggataagtccaatattccatcggcccaggcaattgtatcgtttacgtcggcgtcgttgaaggctgcatcagtacattcgacctcttggattgctctggtttggatgatatacttgcctatctatttatcatatatctctgttaatctagtcttagcatatcaatttagttctatcggctgcttctcattttagggtttctgccggtatcggctaaatcgcgttgctagattagattagcttagacatctaccaccctgaaaactcagtcaacggcttgattgtctagatattatatttcttttcatacttagtgctgcatcagttaagtttgatctactaagtcgtgcttagaactataatctctagcctgcttcttgattgccaataagtgtttcatcggggtttcagccggtgagttatctggacgttgcatcggctcataaggattgcatatacatataagttggatttagccgatgacaacaaaggcttcattgtttaagctaatcttgtggatttcatgacatcggacctccagccgatgtgtgctttgaccttcggatcgatgcttatttatcatatcattatttgctgattggtttatacttgattacattgttattttattacatcatcgtcagccgattgcctttatatcattatctacattggacatatagtcgattgcttaaaccctatcgctatcggctggtatcggcatcggctattatcggcatcggctggaactactccatcggcttgtcggccgatcggctgttttaatctactatttgcatatcttgtcagttgcaggatcaaactgactggcacgctcgcatctcaccaatctttggacctgcactggagttaagcagatctcccaggccgatgtgttcgattttttcgtcaacagctttagcagtccctgactccccctctcattttccacacgtatgtttttcaaactataaaacattacgttcttttttaaaaaaaattctatacgaaaattgattaaaaaatcatacttattcatttattttaaaaaatagctagtagtgcttaattaattacgtgctaacgaccgcccgttttcaccaacgaaggcagcccatggtgtctcacgttttatgtgggccaattaggcccatcaagtagccgtcatggtcaaagactcaaagttgaccacagccagccgttagatctaatctgaacggttcgcgttgtctcggaatcatcgcctgcatcacacttgacctgtggacctatggtgcgcgcggcggctagcgaaaccgccatggccgcggcgacgatcgagatcccgcgctcgccggcgttccggctgcttctcgtcaccgcggcgaggaagaatctcctttcgggcggcgatcctcgcgctcgccgactcgattgccggccgacgtggggagcaacgcatcgctcgattacacttacacaatccgagtaggaatcgaagtaaacctctctgtatttaatttgcaaggtaaatttgcaaccgacccatcgagcgatcgatctccgaacgaattcgatggcttccacgtcgaggaaacgttcggcgcgtagcctgcaagaagatgagcagacctcatcggcggcagaagcgccggcggcggtgcgagaagaccaagagcagctttccgttgcnggcattgaagcctggaggtttcgggtctcgagattctactggntttccgcgttaaagtcgaccccaccgacgccgacatggttggctgctatcttctaccgagcggg

SEQ ID NO: 3614 - DNA, 6419 bp, Oryza sativa
  unsure (1)..(6419): unsure at all n locations
nnnnnnnnnnnnnnnnnnnnnnnnnnnnnnnnnnnnnnnnnnnnnnagggcgaggtggcgatcctcaccatcgtccgcggcggcggcggaggcggaggcgagctcgacgtggtgtacaagcggcgcaacctgagcttccaccgccgcggcgagagctcctcctccggatgggtcatgcacgagtacgagatcacctcgccgccgctccccgccaccgtgctctcccggatcagggccacccccagggccaaggacaagaagctgtgcatcaaggaggagccctcctgctccacctccgccgccggcgagcgctctggccctaacccagaccacaccgccgccggcgccggtgacagcgccactgccaaccacaacaatacaacgtcggcggcgacaacaactatggcagcggcggtgtagtctaatattatccagaccagccgggtccgagccaccaatatggttacggcgagcaggtcgccggcaatggctttgtggccggcgacgggtggcggcggcgagccattgcacttgtgtgaggactgtgacggcaataacgtttatggctacggctctttgacagggaagagccgctgccgcgagctgactggacaatgtcgctggcctcgagagcagtcgatccacctccaatggcctcaggagtgacggatccaccgtcggcggcacaggaatggtgacctccatcgcctctccccgtccctcgcttcccacggttgagctttgggtagtggcagcacgcttcaggctcgttggatctggtggagctcgacgtgggggacaatgatgacagcttcatcgcctcttctcatacctcgctttgggcagctacgacgctagccttcaagcttacccgatttgacggtggctaggggtataaattatcttggagattttatggctaaaattcttttgcaggagaacatcttcacatgtccgcttacgaaaataagattttgcatgtggttacggtgccagcccataacaatcagtatttttatacatgtttggcgtctgtttgaaaaagctgaatatatatgatcgtttgagaaaaagctttctgtaggagtgcctttctctttagagtgttgtctgttgtagacattggctttaacgagctgtaaataagtattgtacagttacaatttctgtacgatttaattgccaatacttggactatagacaaaatatttttggactgaactataaactgatttgtttttctgttgacccgacttgacccggaataagcctagcacaaacgaagttaaactagaggccttgtcagcaagaacttctaagcgttcaaaaaaaaatctgttgatttttgaacatacagaagcaacataactttgctataattctgttatcacaatttggatagacacgtacagacgttccaaagaccaaaggtgatgatcggagcatatttaattacatcaatagatttctagaacatatataccgaagaagcttggaaattaattaaaccaagcatgccttcatctcaccaaatacctatatacgcggctacgcgtgctaatttcaccttaaaaaagaaaagaagaagaaaaccccagagatcgatgcgagtagttcatacgtaccaattcacagtcagcacttcacctactgcatctgttgccagcttcttcaaaagtccgatcaccgacccagtccattcctaccctctcacacgccaaaagaatttaaaataaattaacatatccaacttgcatgcatgcacgcaagaatgccataagaatttctacatgtagttaatccaagcatgcaagaattattgaagaatgcaatgtaaattaatcaaagtctaaattgaacacacgatcagctagagctaaccttaagaaggtgtcagaagataatatattttttcatcttttagagaaggtattatgagatatcgtattttttatgtaaaatttggtatatcttcaactactagatattccatgataccaaaatttttatgtgtaaataatttagatatctcaagatgggccaaaagtgatcatttttgcatgcggaactctggcccgtctaccaggaaagttatgaaaaaatctctctttttctatgctagtggagcacccgcatacgaaaattcaacttttgcatgcgggtgcttatatcgtccgcacttaaaaataaaaatctgaaaaaattaaaaatcgcaaaaaaattctagccaccgccgccgggctcctccctctgccagcagatccgggcggtgcccgccgcccgctggatccgcgtgggagccgctttcgccacattcgacgtgtgacggagcctgccgccgtgctccatcgctgccgctcgccgcccgactgttccgtgcaaggaagctgtcgttgcctccttcaacgtgcgggggagcccgccaccgtggtccgttgctaccacccactgcccgctgtcagccacgccatccgccgcccattacgaggccggcggaggcggatccgctcgccgcttgccgtcaaccacacagcccgctgctcgttgtcagccgcgtcgcccgccacaaaaatatatttaagaggcccgcctgcgaaacgggcgtctctttgagaggttcgcctgtaaaaataagcttattttagcgtgcgaatccttaagaggaccacttgtgaaaatcgatttttgcgtgcggtcctattaaggagctgtatgcgaaaatggagtacgattttttacatactggactagttacggtctgtctgcaatctaaagaggatcttgtctagaaaaattatttctgtagtagtgcataccgccatggcaaggaatggctcgctctttcatctactcgctggattggagacgtattgtttggcggcggccggtggcggtggcccgtgcggtggccgggcgcaaggaggccagcagcccacggtcgggcggcgacaacagcgactggattttttttattttgtgaatttttgtagtgaatgatgaatggtttgtatattttattggatattttttttgttgatttggggatgatctcacaagatttgtagattgtggatgtgtatgtattggggatgatttttgttgtgcttgatttgtggaaatttttattgggcatgattgatgatttgtgtggatttggctgggggaatagatacaagcagcaaaaagaaccaataaataaaagaaaaaaaacagttgggatgtggcccctatccatctttaaagatggatttttaagcccggttatttcacccgagactaaagatacctatctttagtcctgaattcgtccttcctgttgtaaaacccggagtacaggggttcccaagagggagtaaaacccctttctccactagtgttaactaatttatcctccattatatttctaacctgactgtttgcatatatccgaccatttttgcagtcgccttcctcgcggtgtagacgacgatcgaagaaccttcgaatccagcacacaccaaccacgtccccgacctccccctttaaattcacccatgcacacgtcgtcgcaaatcacatcacacagctaaagctagcttaatccgaaccaagcaatggcggcctcctccctcctccttggtgttcgcggcggcgctcctcgtccctgccgaccgncaacggcggcccaggccgcaaaggaagacgaaacctgcgggtgttctgggcacgacgtggtgaccggcgggcccaaactccacggtggcgcaggtgncggaggcgccgacaacgaacgcctcgacgacgggggtcgggcacggtggtggtgatcgacgacccgctcaccgacgggcccaacctgacggcctcgcgnctggtcggccgcgcgcaggggatgtacgtcgccgccggcaaggacgcgctgtcgctgatgatggcgatgaacttcgtgttcgccggcgacggcccgtacaacggcagcagcctcgcgatcctcggcgccaacccggcggagcgcgccgtgcgggagatgccggtggtgggcggcaccggcgtgttccggttcgcgcgcggctactgccaggcgaccacgtggtggttcaacgccaccaccggcgacgccaccgtcgagtacaacatccatctccgcctcgattaattcattcattcattctcattacttgagacgatgatattgaagatgatgatcgtgttgatcagttcattttactgccggtttttgctgtgtgttgaccagttgattactagaatatataagctgggtgtggtgtcatatgctttttttttccctgtaaaaaaacgctagctatgatttttgttgttgttgttgttggtaggggtgtattcttgaggatgattattgtttataagttcttaatgtgttttagaataatgagagcttcattagcttacctttgttacaattttttattttgatggatggtaatattcctccaagatttttgtgcacgccttggttcacctaacactgaccatcccgtcaagataacatatactcaaaataatcatggaaaattttccccactaaccgagcgtcgtatccacacaagtgttgccgtttccgactctaacaatatataaattttagttttttctaatttattcgatcttcttgttgacactaaatagttggtcaattccagattaatcgataatatttttcgaacagatgctaccaattctatccgtttctatccttagggagcgttcgttctgataagttagggtgagaaaatacatcatagtccacgcacacgcttcccaaactactaaacggtgtgtttttggcaaaaaatttctataggaaagttgctttaaaaaatcatattaatctatttttaaaatttaaaatagtttatactcaattaataatgcgctaatggctcacctcgttttgcgtatcttcccaatcttctcaatcccctatccctcaaactcacccttagagcaagtttaatagtatagcccactactagctccaattcatctacaactaatctaatagccaattcatacaatagttgcttactatactattaatatatggtcccacatgtcatgcacacattacatcttgaagtctgtgctgcagctcttctctctcttattataaaatatgtttatagctggcttattttgttttcactttctgtaatgggatcagcattaatacattttatagataatttttggtaaaattctgcacgaaactcagcaataacaaggtacaccatcggttttatattattaagtcatttcgattttttttttctattcaaacatttttaagtttgatcagaaaagatatagcaacatttcaaacgcaaaataaatatattatcataatatatataatgttatatttaatgaaactaatttggtgttataatatgttactaacttttgttataaacttggtcaactagtaaaaagttgtaatatgaacgaagggagtatttcatatagctgcttgctaatgtaatacatatagaaaacatagcactgaaacatagtcgacgacttaatttaatttttcgcagaaaagcatatagcaatcaaagatcaattaagccccatgtaaatctgttactaattctcataataattcctggcttactttgatgcaacgataacgatcagtatcaccttccaattatctagacaagatcatcgccttgcaccggcgagctgttcgacgcggactccggcgacgtcgacggcggcgacttcgccgggcagctgatgatgtcgcgggcggcgaaatgtagccgaagaaggcggcgtgtggcgacggcgtctaaaaagatgacggccattccggcggcggcgctgaggtgcttggcgacggtgaaggcgacgagcgcgacgtatgtcacgcggaagatgccgcgagcgcgcctatcccggtgaggacgccgacccacccggcgagcgcgccgcacgtcgccgacgagagcgcccacacgacggccgccggctcgccgccagcgcggtacagcgcccacacgccgagcgccacgcacaggaccgacagcgaggagaggccgcacgtggtgccgtagtcgtcgccgccgccgaccttctcctccccggcgccgtgcccggatgttcgccctgaacagcaccaccggcgtcggcggtggcgaccgcggcgacggcgcgtctgtcgtcgtccagctcgtcgtcggagttggccgtgacggtgtcgtaggcggcggagttcatcttgcgtggtggcgttggtgtttggtgcgacatcttggcgacgagagcgaacaagctagggctacgtgaaattatactatgaaattaattgctgggatttactaaggtcttaataatcggtggataaaactaaaccccggtaaaaaggtagtaatattaccacgaatattttggat

SEQ ID NO: 3615 - DNA, 2677 bp, Oryza sativa
  unsure (1)..(2677): unsure at all n locations
cgtgtccttgaagtgcgatcttcttnctaccgcaagnagnncatcatacagncgnccgtaaaaaaaaagggcagaaaaaatgtcacgcaaaaaataaaacgccatcgaaaaaaaggcaaaatttggatcggtttctcggtgacgtactttttggttttttcacacacgcgtcgacgtacttcccgagtcctgcgggagtcctccgtgcgttactaaatcagtttgggtcaggtttttctgcacgtatatatcctattcacgatcacaatttgattcgataagtttcaagatttttttttccgttggtagagatagcatccatccagaaatcgaccgcgtcggtgctgatcaaatgcgatgctaacaacccacaaaactttccttgagctgagtctgccaaataaaaacatgaagcaaaagcctcattgtgacctaaactcctctcgtcacctagcttgttgctcccaccaagcggccaaagccaatcaatgtaagcccatgacgtgctctcgactatcgtccatacgatacttacaatacttgaggcgaggtgggagtgggcggcagcggcgacgacggccaggaggaggagtgacgagacgcggaggaggacagagagggtggcggccttgtcccgcgaaacggcggcggtgcaaggaagaggcagccgcagatcactggcgacagcctccgcattgccgcggggagatctttgccgtcgccatcgccgcgggataggacgaacgcgatggccgaggcgaatagcagagacaggacgcacatggcggcgcagggcagcgccaccacggagcttccctttgccttctcgccgccgctgggcggcggcctccatgttagccacctcgaccataggcttttgatgatgatgtgtacacgtaaggcccacttatctttttcgtcgcttattatcgcgtacagttttgctataaatctactaacgaattccttccttttttaggagaaaatttttccacaaatatatagatagtccctgtcgcgtacatagatcacttttccagcattcctgcccggcattacccaaatgggtcaggcctcatggaccccaatagaacccttgagcttagtgattaaaaaataatttgtgagtaatttttgtatgtgtgtctttaacggctaaaaagttattgctgaaaaagaaactacgttgaaaaaacatcaaaattaagttaatcgtattatgagtaaactaaaaaccgaccccattaagggctcaccacgacaaaggcattggaaaagattgatgggttaatcctcttcgatttcccttccatccctttaagagagaattaacaaaataaggcctaaatcgaaaaaccgagtgctcacccctgtgtgcacatgaagtagttcaagatcaatcccacacaacacaacaccaaatgcatttcgccgccccccggcccggtgccacccaaaaacctttcatgcatagtacacaagctgaccaacatatcaggtgagaaaaagaaacatcaacatattgggacaagaaaataaatatcaggaagttgaataatgatggtgaacttctcaatagttgggaaaacgccggggatcgggcgcccaacgtgcataaagaaaaatcgccccccccccttaacacacatgcgcgtgcgccttcggctggcttccacgcattcccaccactggcgttccattgaacaaataccccacatattacggaaatgccctattaaaggaaaccgtttcattttttttccaccaacaatgtttcagctagcactactacagaaacctggattggtgccagctgggaacccccgttaggtgtcggtttttccaaccggcaccccacaggcgggactgatgactagtgccggttgtagaaccgacacctatatcatatataggtgccggttggaaaccccacaactggcacctaagaggttccactagccaaaaaaaatggctcgatgcatcggctcgagcagctccacatcaccaaaattcagctccccatcacccaaatccaagaacacattcatcaagaacacatttctcacaatatcaccatccacccaacaacacaaagaggcggtagtgaatcaacaataacaacaacaacaacaacaacaacaacaacaacacatttttgttgctcgccgcatccaacaacacattcaacaacagcacaaaattaaaaaccaacagcaacacattcaccacgctgaccgtggggaggctgcccgtcgcgccgtgtgaggaggcaacccaccacgcccggcctcctccaccaccaaagtccaccacgcccggtctcctccaccaccaccatcgaatctggtcggaggaggaggggctccgacctcctccccgagctccggtggggaggggctgtgccggatctggccgtccctgagtgccggtggggtggggggcatgccggatctggccatccccgagtgccggtggggtggggccgtgccggagttggcctccctgagcgccgacgggaagggggtgggacggagaggaggagcggcggcaccggatctggctgcccccgagcagcagttgccggtggccttcccataccgccgcccccggtggaggatgaggtgaggggaaaggggaggagtgatgagctacatgcagagnacgcattcaaaccgcg

SEQ ID NO: 3616 - DNA, 5492 bp, Oryza sativa
ttttttgatatatttagtaaaacatgttcgataaacttggtgaaacaacgcccccgatttttaggcgcctcgcaactatattccccaaaaacttaccacagtgctgtcaagtactcctcttaagagggtataccaaagtgggggtgcatagtaccgcttgaccagtccgacgtcctacacatgaagggctggaaggtatattttaaagccctcattgttgtggaacccttaacttgtcttacaatagcctaaattccatcatgtagtgcccatagaacgactgaagtttaggccttagcttggtataaccaattgagagatcgagaactttacaattctacattccaaaggaggcctaggagcagctccagtgtttggtgaaatcgatcgacgcgtgtgaaaaaaaatcgaactgaacgtctaattaaggtggtttaaagatggttgaaagaaaaaagataaatgaaaagataaccatgtaaaaactgggcccgtttagttgcccaaaaacttttcccaaaaacatcacatcgaatctttagatatatgtatggagcattaaatataaataaaaagaaaaactaatagcacagttaggtgggaaatcgcgagacgaatcttttgagcctaattagtccatgattagctataagtgctacagtaatctacatgtgctaatgacggattaattaggctcaaaagatacgtctcgcggtttccaggcgagttatgaaattagttttttcatttgtgtccaaaaaccccttccgacatccggtcaaacgtccgatgtgacacccaaaaattttcttttagcgaactaaacaggctaagtcatataaaacctttagttttcctacaaacagtcgtactccctccgtaaaaaaaaaactttttttgggacggagggagtacccatcacgactaacgagagagcatcatacttgtcatctcctcatttattagtaaaagactccatcactcctgtcgatgataaaaaagaaaaaaaaaagaaaaaaatccacatattgcttcccttccatagtttaacgtttatatatattcacacacatacatggcacgaacaatttaaaatgttccaaattgaaacagggatgctcacaattaatttagacgtcaacaaagatgggactcaaaatcgaatcagaggcccatgacccctagagcaacggcaagatgggcaatggcctgaaacgctgaagcaaccttcttgatgggagagtctgacgctggcattttcgtcgatttgagcagggcaagcatcacaagtttcccgccccaccagcaagccggaagcgtcggctgctgtccgaggttggctcctgtaattgagatatatcacaccaaaatgacatgaaaaaaaagtgaagatgttttgtatttagttgttggttgttaattgaaagcattttacaccaaaatagaactgattgatcacatggaatttctgatatatcatttatgtatgtactcgatgcaactagctaggcctaatactttattcatgtggatacttaaaaaaatctttaaaataaatcgatatatggggttgggattacttagttttgaaatcctgcatccaccattcttcgatgctcacagtgatggaggcatggagccagaaattatcaaagaataaaactaagttagactcaactaatcagttgttcttttttttatttccaaaatttacatggtgatttgagagaattttaacaagattcgggaaacaatcctatggctcaaagtcctagatacattggactgcctccactcctggatgcgtatgggctacttgtagcagatatggtggtacatacaacttacattgcgattaaatggatcaaatataagttacaatgtaattatactataattatatatatatatatatatttagaagaaaaaatatcgataaatgtatagcaaaatcgttttgtcatggtgactatattgtcatacttgtgatacgcaacaactgaccttatggtgcacatgagctcattgtagtggtcatagacggcgagggtgtagccgaggacgccggccatggctaagccggtgagccagtagacgaagagggcgacgacgaggctgtggaggacgacgccggcgatcaccgggaagatcacccaccacatgcccaatcccgtcacggccatcgccgacttggcgccgtcggcgacgagttccccgcgcagcagcgtcccgttcacgaaggagaccaagcacaggaagtacgggccggagaacaccgccgcgtcaaacaccaccaaccccgccggcggcgggaactccggcagcatcatcatggtgacgatccccgcgaacgcggccgtcccggcgacgatgagggagaggaggcacctcttggatgactcgcggtgggccctctccgcctcggactcgtacgccggcgtcgcctcggcgatggcggagtggtggtggcggcggcgctccgcgacggcgtagcccagcacggcggcggtgtagaccgtgccgaggaacatgcccgccgcgccggtggcgtcggcgaggaggaggaggaaggcaacgcggacgaggacggcggcgcgcgctgccgtgctccacgacacggcggccgtccacacgaggaggtagccgccgatcagcggcgacagcctccacacggccgcggcgaaaatagtcctcctctttctcaaagccgccgcggccgcggggcagcagggacgccgcggcggcgacgaatagcagggacaggacgcacatggcgacctgggcggcgcggggtagcgccgccgaggccgagcttgccttctcctcgccgtcgtcggcgacggcggtggtttccatgttagccggcgcctcgatcgtcaattagggttttcgatagcgaacatacgtacgtgtacacgtattatgaagataacataaataattatataataaaatcgaattgcatacatattccgtatatattctgcatcaaagcaattcttttctatggaaaatcgtgttgaagtttctactttacatattcatgtgacttcaaaaattaattaatactttgagcaaccatataagatggatgaggcgtgatcaaattcatatggaaacatatatatatgatttttcttcttttgtaggggaaaaaaatccaagctagctcatctacccgtgttctgtagtcaaatttggcacaaattaaagtattaaaaaacatgcgtggatcagacaaattaacttccaatcatacatcttgcatatatatgtctagaccgaacaatcaacaaattagcgatcacattcttatagaaaaaaacatatacacgtctggaacatgcatggaacagcgggaaactattttaatccctcgaggggatgtcccctcgttatttgcatgtccccttattgcgagatacaaaagttgaatttgaacttgcatgtttttgggtagtagtaatatatcacgcgttaatacatcttcttaattttttttaatttttttataaacatttgaatgacatgaaaacaacgaggggatatccactcgagggatcaaaatccactcccatggaacggtaaatcaaaatgttccaggctaaaaaaaggtcgataatttgatctattgaaactacacaattaataattgaggtcaagaatatattcatggatccggcacattaatttctagaacaatgacaagatgggcaatggccagaaacgctgaagcagccgtgttgatgagagagtctaacgctggcactttcatcgatctcagctgaacaagaatcgcaagcttctcgtccgacgagcaagccggaagcgtcagacgccgtccgaggttggctcctgtaaaatcacagctaaaattaatcatatgaaacagcaagcaagatgtgtgtatggattatatatattgatcgaccgatctttaaacgtatttcacaactgactctctgaacgtattgtgaccagggatcgcaatttcggtcccaccgggaagtgattatctcaaccagaattttaggtttctctcatatttttgtgaatttggtcaaaatttagtcaaattcagttaaattatgctaaaatttcacaaaaaaaatcggtccaaaaattaacaaaaatcccaatatttcggtagaaccgaaatgagcgaagttttggacgaaattgaaatcgaaaaccctgattgtggccgtgtttaattcaacttctcacacttgtgactatgagctaaaattagtttctttttgaaaagatcatattatatactactccctctgtttcatattataagactttctagcattgctcacattcataacgataagtcttataatatgaaagacgtcaattgttcgattttatcatttactccctcgtctaaaaaaaaagccaaccttagtatggatggaacacttccaattaaggacaacaagtctgtcccatccacctagtacaacaaatctgtcacattcatgtcaaggttggttttttcgggatggagggagtaactttgactggtatagttatgtttaaaatttttcactagtccatacgaaatttctatggtcgaacaaagacctaattataatggtgtagatttgtagttaccttatgatgcgcatgagctcctggtagtggtcgttgacggcgatggtgtagccgaggaagccggccatggcgatgccgaagagccagtggccgtagatgaaggcgacgaaaaggtggagggcggcgccggcgatggccgggacgatcagccatgacgcgcccaggcacgccatgacgatccacatggtgtcgccggagatgaaggacccgcgcatcagcgtgctcgtcacgaacagcgtccagccggcgaggtacggccccgacaccgacgccgccaagcacagcgcgtccgccgccgtcggcatgccgccgccgccgccctccgccggtgcctccttccccaccacccatgacgtgaggacgagggacgcggcgacggtgaccttcaccaagacgacggcgacgaggatgccctccttgccgtgctcgcggcggtccctctccgccttggtctcgtacaccggcgtcgcgtcggcggcggcgttcgaccgggggcgccggcccgccgcgtggtgccggagctccgcgacggcgtggccgagcaccgcggcggagtagaacgggcggcgaacatggccagccgcgcggtgagtcggagtggccccaccagggaagcgcggccttcgcgaggaggagggaggcggtgacccctacgaggcgggtgggcgtcgccgacttcctccacacggcgggccgcaatgaggaagatgtagcccgaagatcacctggcgacagcctccacactgcgggcggggaagttctcttcgtcgccgtcgccgcggggcagcaagtgcgccacgtccgggacgaacagtatggacaggacggacatgggcaccattgtcgtagatggacagcgccgccgaact

SEQ ID NO: 3617 - DNA, 5502 bp, Oryza sativa
  unsure (1)..(5502): unsure at all n locations
agtcctttctcggtggaacagaaatgccgtccctggttacaatcgttaaagacgtcatttgtgtaaacgtgtacggatgggcgtacaacatatatagtccacccacgcttatggcagaagttgtcaatctcgcgggtgaatccattcattaatagtgtggttttgtgaaaatatactaccaaaatatatgtacttaagtaccaagtgttagtgtttgtggttttctataacttggaccataaaacgtgtagttttgtgaaatttactctagaatatatcgataaattgttttcttgtgtaaatacagtcggatttgcatatatattaattccgtatatatttgcatcaaggaaataattgttggggtttagtttatgaaagcaactgatggaatagtcaatagtggatgtgaaaactgaaaacaagatcagaatatcagatcatgtattgtattnnnnnnnnnnnnnnnnnnnnaacacaagatcagaatatatagcagatcatgcattgagtttgaggatagctgaaaactgggtgcctcatgaggcaaagaattagggttggcaacggggcgggtcgggacgggttaggttggaacgcccctgcccccgtccccgctctccgacttcttccccggccccacagaggtggtcgggcgggaaatatcacccgtccccgcccctgcaggggacccacgggtagttagcgtagatcaaatcggattgtactaattatactcagtgtacatttgtatcaagcggtctgctacttaattatagaaaatcgtgcagaaattttctgctcaaaatatatatattcatgtggttgatttccaaattaaattaagttttttgaaaaaaaaaagtgcaaccatagttatatggttatgcgcattgatttcttggggttcctatatatttattgcgtacatgtgcccagcaaactaagataagcatgcgcctatgtcagcgttctttaacatgatcaacatttgtgacagtggcacacgtgtcgtccataatgattccacgtaatcagagttctttttttttaatgaaaccgtttgatttagcacattgcatttttttatggtttttgctttctaacatctaaaactatcgattgaattctaaaaactcaatttaaattctaaacattttaattagaatacgtctcaggcaggaaccattaccggctaattaagttctctagcaaaacactactccctccatttctaaatatttgatgccggtgactttttaaaatatgtttgaccgtttctcttatttaaaaaatttaagtaattattgattcttttcatagcatttgattcattgttaaatatactcatatgtatacatatagttttacatatttcacaaaagtttttaaataaaatgaacggtcaaacatgtgctaaaaagtcaacggtattaaatatttagaatcggagggagtattaattgactttggacataacgtttaatcatttgtgacgtagtttgcataatatacgcacacaaatcaataaattacctatgtgcctcatattctttataagaaaatcgtagaaatgttccaaactagcactccctccgtccaaaaaaaaaaaaggaatagtatttgtccagattcattacactagaatgtcacatctactagattggttttttacgggggcgaacggagtaaaacggaaccgctacggatcagctcttcacttgacagttaattaaataattggggtcaataatatactccgtattcattccgtattcatggctccgacacttgtctaggacagtgccaagatgggcaatggcctgaaacgctgaagcaaccttcttgatgggagagtctgacgctggcattttcgtcgatctgagcagggcaagcagcacaagtttcccgccccaccagcaagccggaagcgtcggctgccgtccaaggctggctcctgtataatctcagcaaaaaaatatatatatatatatgaaacggcgccaaacaacactttgtagtatatacattgattgattattaattaaagatatttcagaagaatatacaattgtatataatggtgcatctgtatatactaccttaaaagactttaagtggtgctatatcacccactaacggacgttataaagttgtgatcgaaaggaattaaagcgatttatattatgtaataaagggagtagtccttagttactctatccatattttattgtatgacactattgattttttaagatacgcttgaccattttttttttcaaaaatttttatgtaagatacgcattatgtaattttaatatacgtagtatcatctattttattatgacttgatttattattaaatattatttaaatatgatataaatatttttatatttatataaaaaatttaaaataaaacaaatggaaaaacgtcggtaaaaagtcaacgacgtcatatattaaaataatacggagtacaggaaacacttttaatcacctaggtggacatccacccatttggtgcatgtcaactaaataggtatgaaaaaattcaaaaaatttgacaagatagatttacatgtaatatatcacccccacaaacatgcaagttcaaaaatcgtcttctacaagctgtagcgaaaataccaaatcaaactctaattagtatacgtatattcgcagttaaatttgttatttttgttacaacttataaaagttaaattttaagttgcatgtttgtgtagtgatatactatatatcaatctttcttgtaattttttttaaaaaaattttatgatcatttagttgatatgcacttaatgagtgaacattcactcgagtgtttagaatccaccttcagtacttaccgtatgatgagcatgagctcctggtagcgctcgttgacggcaaggctgtagccgaggaagccggccatggcgatgccgtagagccagtggccgtagagaacggcgttgatttgccggagaacgatgccggcgacgaccgggacgaacagccacgacatgcccacgcacacggcggcgacgcacatggcgtctccggcgacgaaacacccgcgcagcagaatgctcctcacgaacagggcccagacgccgaggtagggccccgacaacgtcgccgtcacgcacaccacgatcgacgccggcgacggctcgtcgtcgtcgtcgtgccccgtcggctgcggcggcggcgcgtcgttctcgttcggctgtagcgaccacgcgaggtaggtgatcgcggcgggcatggcctccacgaagaagacgatgagggcgatgaacttcttgcaggtctcgcggtggcgccgctccgcctgcgactcgtacgccggcgtcgcctcggcggcggcggcggcgtccgatgcctcggatgcctggtggtgccggcgctcggcgacggcgtagccgaccgccgcggcggagtaggccgtggcggccagcatgggcgcctcgccggcgagtggcccgaccagggagtcggcgtcggcgaggaggaagaaggcggagacgcagacgaggagggagggcgtcgccgtgtccctccacacggcggccgtcacgaggaagaggtaggcgcataccagcggcgacagtcttctcacggcggcggcgaagttctcttcgtcgccgccgcggggcagcacgtacgccacggccgcgacgaacagcagagacaggacggccatggcggccatggcggtgctgggcagcgccgccgacttcgccggcttcacctcgccgtcagcggcggcggcggcggcttccatgtcagccgcctcgatcatcatatattacgaacacacgtctatattgatatatatgaatgatgaagataaataaatgggattctcaattgcatagatattccgtatacatttgcatgaggactttttcctattaaaatgggtgaatagttaaaatggtcccctaagttttatctgaggctcagtttagtccctgatgtttcaatctatccatattagcccttcaatttttcattttagttcaaacttattcttgaaccaacaattctcttcataaatgacacttatacccctcatcattcacatatataagagaaaaattgcatgcttgaattttttttatagataatacatagataatacaaacgtatacgatagcaattgcttaagtttcatgtgcacctgttaaaataatagaaagtacatctgtaatgttgtttattcatgttggctttctcttttctaggatatagttgtatacaaattaagggcaaaaagaacattttttaatagaaatattgactagaaatagccatatggcatattaagtgggcccaaggatgatttcaagccaaaataaatatttggaggagctatgtggacaaaatgaaacgtgaaggaccaaattgtgccttcggtggaacttgagggactaaattagctattcaccctattaaaatcatgcagaaattgtgtgctttacatatattattcaagtgatttccaaattgaagtttacatttttacagccatagattaggcgggaaattaatttcctacgaaattattatggaatcactcagcctcaacacagaatctactaattcaggggaaataaagtgccatcatagtgaagtaatttcctaatacgaaattttctttagcagctggaaataggaacgacttcaaacattcatgaggaaaaaaaagacttgtttcatggtaagaactgcaattatacttgaccacctgattgtaccctacagtcacaaaagaaaaatctgtatatatagatgtgcctttttatatatacaattggcacgtttttaccctggcaaaagttgtaaatatggtggaatgcattcatattaacaaccacttaatttgcatctcaatctgtaatctcttcttgctaacaaaaacgaaaaaaagaagaggcaaattttcgatgcctaatttctgttcaaactgacaatatggtctggctacttagaggtgtcaaaaatgccaggccgtttgctgcctaagtgctctagctagctggagtattatatcatggttcagctcgctgacacatgcagtcaggcattgggagggtgtatatggaaatggaaccatttggtttcctgactccgaaacccttcgactcgctgtgccgatgtatgtcctgcatttggcgcttgaaccgatcccatctgcagccaagaaaatatagttgggtttagttcttgatcaggtgttcactggtgtaaagtggggatcaggtgttgactttgaggatcgctgaaaatagggcgtctaatgaggcaaattttttttatttggaaacttaaaagggaaacccggaaccatttttaatgtgttttaatgggtggtggaactccggtccaaatggcttcatttcattgctctacttcttgaaattagtaagtgggaacagggtattagtggcaatgattagtaaggtgtcacaaaaagttatagttgacatggat

SEQ ID NO: 3618 - DNA, 1787 bp, Oryza sativa
  unsure (1)..(1787): unsure at all n locations
agagctttagaagaagatggtagaataattgaggaacctgcagaactgaaagctcacatatatcagttctataaaaatctgtttggtgctgaagttgccccaaaaattttcctaagtcaagatatgtggatgcatagagggaggctaagtcaagaagagagagagcatctaatcagaccctttacctttgaggaaatggatcaagctttaaaacaaatgaagactgatacagcccctggtcctgatggattcacagtgagcttttacagagccttttggccccagttgagggatcaatttaaagaaatgttggatctactatttgaggggagactggacttgtggagaataaactatggtgtgattagtttaattcccaaagttaaagatgcaaacactatcaaagctttcagaccgatttgccttttgaatgtctgctttaagctaatcaccaaaattctgaccaataggctgacgctagtagcacataatgtaattggggagagtcagactgcctttattcctggtagatttattttggatggggtgattattttgcatgaggttttgcacgaagtgaaaaaaactcaccaatctggcataattctaaaattggattttgaaaaggcatatgataaagttcagtggagtttcttgtttgatgtgcttcagaaaaaaggttttgatgataaatggatcaagtggattaagtcagcaactattgatggaagagtagcaattaatattaatggggagattgatcaatactttaaaactttcaggggagtcagacagggggaccctctatcacctttgctttttaacattgtggctgatgccctttctgagatacttttaaaggccaaagaggctggtcatctggaaggcttggtacctcacttagtgcagggggggctcacgcatttgcaatacgctgacgacgctatcctgttcatgaccaataatgatcagaatgtgataactactaaatttatccgactctgttttgagcccatgtcaggattgaagatcaattaccagaagagtgaggttatagtccttggggagagcccagaagagcctaagagagtggctggcctttttagctgcaaatgcggtaagttccccatgacttcccttggcattcctatcagtgagggaagcctgacagcagcagatctggctattccccctgataagattgagaaaagactttcaacctgcaaatgtggtttactttcttatgggggaaaagcaaaccgtgtcaattcctcacctatgtatatgatgggctttaatatgctccctgaacaaacccatcagagaatggattctattagatcaacatttttttggaaaggaatagaaagaaaaaggaagtatcccatggttaaatgggaggctctttgcagacccaaagattttgggggcttaggttttcttgatactagagtgatgaataaggtacttttgtgcaaatggatttttaagcttgaatcagggcagaaggacccctgctgtgatttgctaagaaggaaatacatgatgaatgggggaggctttttccagtcaagtactgagggatgctctcaattctggagaggtttgcatgaggtaaaacactggttgaaattgggcagctgttatgatttaggggatggcagtgctactagattctgggacgatgtctggctaggagatacacctctgaaaatcaaatttccctacatttacagtatagtggctgttctgntgnggtcgagtcgaatgcatgtcatnntcaccat

SEQ ID NO: 3619 - DNA, 723 bp, Oryza sativa
  unsure (1)..(723): unsure at all n locations
ttattagcatcttgttaagctttgtctacgttttcttgtgtttctcaaacgtcatcgtttagtttatacgtatctgtatagtcacgtagacgtaaaccatttagccaagatttttcacctgttgtatcacggttcaacaagaatccaagttgaataaaacctgtttctactgggataatcgttgtattagcaaactcagaagagccactaatcaaatggctgtacttggtgtacgtagtaggtacttgtatatttacgtgaccattcaaatacaaatatgtggagccgtcagaagttgggctaagtgtatgccctactgggaaaatcccatctgaactatttgggtttgcaactgcccatggcttgtttaacgtaatcttgttagctgtggtgtcaactgcaccaatatcatatgtcctcatctgcattagctgactatacgttccatcgggataagtatagccgaacgagtttttataaccccacatgataatactacgttggtagtcttgcggtgcctgtccgttccatagactaacatcttctacaaaaacctctgtatccccgactttaagtggttttgctagttttgtaaatttaacaggggtagtagagttgtagtttcgtcccccaagagaagggtacgtaatacggttaccatctacgtcatatggggcaatcatagcataacttctaccgacncctataagcgttttactcatg

SEQ ID NO: 3620 - DNA, 46128 bp, Oryza sativa
  unsure (1)..(46128): unsure at all n locations
ctggaccnggtgagattcgtttcacgctggagcaatcacagccacgaccctcgaaaaccactagagtcgacctgcaggcatgcccactctttgatcctccaaggcatgaaagtgcataaacaattcgaatggcacttaaccttggtgtaaatgtaaagatgatcacaggtactcttccaattgggaaaagaaaatccagatgttctattttttttatgtttttttatcacatttccaaaaaaaaaattatttcaggttgttatggtggtgatagttcatgttcagttattatatggtggatcagtaactgcaattttcatctacaatatgatgaacaactagcataaatgttcagtactgcaacctgttcaatcggaaatgcattattataatgtgccataaataagtaactcaattttcttcattaaaaaaaattaaaaaatccattgctcttctgtcattgtttggagccatgggaccatcaccagttcaaagagtctttagctctcatttactgaaaagaagctgctgttctgttctcttgaccattgtgatctatttaatcataactagtgaacatgcacatgcaaggcacgttttcgtaatatatatctttgctgatcatatactggtacagtattaaagaatcatcataggcaccggtaaaaatataattattgcattggttattcatgaaataaacctaatttgttattttattacatagcaacggaatgggaaaaatgtaaattatttgtcatgatagatttcatgtccacttccagaccagtcgctttcatgagatgaggtagcgtcctttagctctgatttgaccgtcctacatctgatggcattattgaggtattcatggatctgagatgaggtagtgtttttcagctctgatttggctgtcctacctggattctgatatcatttagtaggtcgtctctaacgtatggatgcacatgtatataatacgacacatttagtattatgtattttgtatatttaagtagaagaaatgaaatatgtgcatgtacctcgaatggaaccgtacacctcacttttttgggaatagagagttacagacaagctgcaaaacaaccaaattgtgtaccaacactttattaaattattttgtttgtatgaaaaaaaaaattgaccagattacaatgtcttcaaatcgcctgatcgaccctaatcgcacaggcggccatttacataaaaatggttgagatgcaaccaacattaatcatttcaactcaaaattgtattttgcacagtatcaaacacatactggtaaattgttcctttagtcaattcacataccacttggcatgtgtaagattatacattatacaaacagcttggagagcaacaacagtgacaattgtaatatacagtcatgaacagcaataaccttaatgtatctaaaaaaacatttatcaaaaaatcagtagtaaccctgtggtgaaaacaactttagaaaaacaactcccacagcacgatactgggagagccacttaccatggtttccctttcaacgagctgaaataccaaaggtccgaagttacatccatttcattgatttgacatcattacatgctaccgctgctaaagtatttccaacacccaaaaacgcaagttctactttctctattctttctatttaagtttttctattcagtaaggactaaatatatgaagtatctgagttagaaatatttgattgtgtcttggaaatgctattagctcatattatcatagatagtattattttacctttataccagagattagaaatgtacttttttactgttgttggctacaattacgatttgcaaagctcaaagaactgtctatttagtgcattttgctcttggaaggtacaatctgattttgtatttcgttgttctgattctaaaaaaatatctataaaaaatgcattgttccttaaaatacaatataaagaaatggatttctataggatataaatgcatagcaatcaaactgaaattcaataagccagtaatttacatatattgaattaatgaagtgagtatttggatgtacctgcactgtctcaagatatcaacacagtaggcatctctagtacacagattcatctcaccactgcaaagaaataaagttaaataaaggaacagacaaaggtgaaaggaaaaaaaatcgttaaatgaaatccaaatctcaaaatactctacctcttctttgttgtctcctcaacccctaaacttcacaaaagaacaagaaatcctaaaaccaccacagttcctgcaaactggaaaagcaggccgttgcatgatcctctcatattgcgttttatttcttatgaccaacgtagtgtcgtgcgccaaaacttgtttctcacctaccatgacctgatgtcaccaatgtagtgcacctcgatgacaagatagacaatagtacagtccggctgctggttgaactcaagctctcacattaaaggccctatatgatcagaaaaatacctctacttctgccccttttccaatgtgggaatttgtatagaagaattcaacccctctctgggtgcaataacttttgcctggctttctcttcaaaaatcgactaccaacaaagacaaattttcccacgaagaacattgtggaaacagcaaaatacaaaatctgcttgcatcaagacaaagatggcgatcacttattcttcaagtgctcctttgctgaagctttcagcgaatcgatgtttgcctagaaggcacagtaaagaaaagagaaactttatgatatatatatatagtagaaatgtgaaataaaaaaaataactctttttgcgggcaatccaaaaaacacttttgtgaaatgaacaaccgataatatataacacaacccctatctccctcggtttactcaggttgctagcgctccagttttctcggtgcatgagtatgggcgatctccggtgatctcgtccatggtgacgccgtcaccgccgggaggatggaaattctctcctggtgatgctattcgtgaagaggcttggcgtcgcttctattcgccggtccatttctcatcgaaattcagttcgtcacctttccggttagttgtggatcttccccgtgctagctttcgtctcactacttcttcggtggctgtggcccttaggactgctattggtggatctcctgccgatcttgtggtcactcatcttaaggatcgttcttactccttcgtggtctgttcgaagcaagtgggtttgtggatttatcgtcttaaatcttacacttgcggcgattttgttcttcgtttcttcctttggagacagggggccgaattggtagtgggaatttgattcttggagtcgggaacagaaaaaggaatgggtgcttgtggctcccaagaaacgatctacctcttccctaagacggccggatcgttcttatgctcaagttgttcagcaccgtgatatcctgattaagcaggttttttcaagtctaaaggactccttcttacgtgcctccaagcctgaccaacaaagaatttctgttttccaccggcttgataagaggaaaacagtttttatcacttctctagcgacctccaaggcggccgacgctgcgtagtcgtctattctggcaacggagttaattacgcatgcgaaaggtacacgggatcctaatttgtcgcccatttcaaatttggaaaacactccttgcggccgttgcctggaaaatggccattctcgggtttcttgttctgggccgcttagatgtcgggcctgtctcatgccgggtcacttagcccgtttctatttgaccactaagcccacaaaagcccaacaccctaaaaagctgaaccgtcggctcggactactactgtttggaaggccaaaactaatactctggaaatctcgccttcttcctcctaaaaccattcttctcccaaacacacagtgcttcccacccaaagcttccctttgctcccaatggccaatcttaaccataatccgcagcgcttcctaaggcagggtcacgctgtgaatgttgggggtgacttccgtatcccgcgggtcgacctcactatcctgcagcaccatgctcggcgccatgaagacttctatgtggccattgtagagccaatccccttggagcaggactgggatcatcatcgtgccctcattgccaactttgtacaagatgagctacactatgaggttcgtaatagcttccagcacccgtctacagtaggtttcttccagatgaagtctgctatgaatagggatgctctggtcctctctccgcccgagttctatgatggggttcactctgttacttttgttaatcatgaccaaggtcctaattggagggcggctaactaccatagagagggctggttcatgttcctagattttccgcttgatttcattgatcgccatcatgtgcacctggcagttacctcttttggtctgttaaccttttgggcggatgcagacagaatgttgggaagggtttttgttagggcaaagtacagggaccaggattttgtgctgagaaagattgttctctttgatcctcttggtgctgggggtgggggtgaatcttggacaatctcgattttcatgctacagggggattttattaatttcccccctgaagaggatctcccccctgccggtccgcagccgggccctgatgatgcagctgatgaggaccctaatgatggtaatgtttggcagtttggcaaccctaggaaccagggggctagaggttgggatgaggcagtgcagcaacattaggctgcaaatgaacagcaagaggatgcctggggccaagaccatctgatggggcaaattgaagaaaaccttggtcaacttattctgcctcaacagatggccacacctctctgatcagctaggaaggcaaccgtctaggatcctattctagacccacaagtctaggaattcttagctcagctgaacagaattgctagagatgaaactccaaggcacccctacttttatcaaatgaaaggcatattggacaagattgactttctctgtaaagcaaagggcatcatgcagactttgatccaggacaagcctatccctgctgctttgagaatggccaatcctttctcgacattggtcctgccaaggaagtacatctttgattcctctccctcagtgggccaacatgaacctgaatgggctttactgcctttcgagtctaattcccctcctctgccggaaagggtgattgaggatgttctaccaatcagtgtgaggcccccttctagcccaatcagtgtggcccctattgccctgcttccccccaaggcaccggtaaagaagaaaagatgggaagaccattctttacagtccttacagaagacaaagctctagacttctgcaggacatggcaaccaaagaattgcagatggatccaagaatgggcattgggaagccaaggggcaggtctgctaaaaagcttaaggaattagcaggtattgcaaaactctttattaatagtagtatgcaggagtctgatttcaatgaaacttcttatagtgatatgaactctgactcctctccctctaattgttcactttcggtcatacaaaagatgggggtagacatgtgcaggctctctcctaaagaggtggcagaatccagcctggggggtgaaagaagacagaagatccccaggccaaacatggaggataaataatgacgaaagattcagtcttgttgataggcctatgttttccatttatcatgctccaagggtctgtaatttgtttactgtcaaagttgttttattagatatttgtcctgtcagactgccaagacttgtgtgaatgtcttttggtttgtttttcggttagctgtgctagcctgggtacttttgcccctcccacaatggtgtgataatgaatagtaattttaaatcttggaatgtcttgtgctggaacatcagaggaatgaatgccgaaaataagctactgtctttaaggcagaatattgaagggagtggttgccaggttttatgtctgcaagaaacgaaaatggaaaactttgagctttctgacatcaagaaatttgcccccaagcgctttgcctcttttgcttttgccccctccatgggtgcatcaggtggtattctaattgtttgggcatcaagagttttcactgggacacccaaagaagttaaccctttctctgtgactgtggagttaacttctagattcacctcccaagtttggtccttgacttgtgtgtatgggccatgtaatggccctcaaagatcagattttgtgacctggtttaaaaacatccatattgatgctaaacagaactggcttttcctaggggactttaatttctacagatctatttatgatagaaataaagtgggagctgatatgaatgatattttattttcaatgagatcattagttctctaggattgcttggaatcccattaaaagggagaaggttcacctggagcaatatgcaacaaaatcctttgctggaaaggcttgattgggttttcacctctacatcctggactttaaccttccccaatacaactgttctccctctgaccaagaatatctctgaccatgttccatgtgtggtaaagattgatacaaaaatccctaagtctccaattttcagattttaaaacttctgggttgaagcagagggtttctttgatgtggttcagcaagtttggatgttagatcctggttttgatgatcctgcaaaatgtatctccttcaaattgaaaattatgaggaagaaactgaagctttggactaagaatttgtccagaatcatgctcctcttgagtaactgtaataaaataattgattttcttgatcttctagtagaagagagaaacctttctttatttgaatggaatttcaaggaggtagttaaacatcgtatcttaaaacttctagaattctggaaaatatattggaaaaaatgttgtactaatagatggatgatgctgggagaagaaaacaccaagttctttcaatctattgccacaggaaaggtacagaataaacacaatttctcaagttttgaatcatagtggtcagatagtttacctgcatgatcaaaaggcaaatttgttctatcaaagtttcaagaataggatgggtatctcttgctccccaacaatggactttaatttgaatgagcttttttcatagaacagatttggagtgtttgattgacatgttctccacacaagaaattggtaatctcatcactatgatcccagtagataaggcacctggcctagatggtttcaatggttatttcatgaaaaaatgctggcatatcattgcacaagacttctatagacttgtggcacattttcatgctgaatctacatatttatagatcctgaataattcttacatcactcttgtgccaaaaaaaccttctccaaaaacagttaatgatttcagaccaatttccctaatgggtttgagtcttaagtttcttacaaaattgatggctgacagattgcaaggtgtcattctcaaagtggttagtgaaaaccaatatggattcattaagggaagggccattcaggattgtttagcatgggcttttgagtatatttatcaatgtcagcagtcaaaaagagaaataatcatcctcaagacaattgaaaaagcttttgatacaattgaacacacggccatcttatctgtaatgcaaagcatggggttcccacaaaaatggcttaattggatgcaaatggtattctcctcgacaagctctgtagttctgttgaatggggttcctggtatctcttttaattacaagagaggagttaggcagggagatcatttgtctccacttctttttgttctaggggctaaactcttacaaagaatagtaaacatggcttttaatcttgatttaatttcaaagccagtcaatgaaaatgatggaagtgggttccccaacatccaatttgctgatgacactttgatcctgttaaaagcttcaaaaaaagaaatcttctgcttcaaggcactactgaacatatttgctcaatcgattggcctaaaagttaattatgcaaaatccagtctttatcccctcaatctctctgaagaaaagccagatctaattgcaggatttctgggatgttctgttggaaaactgcctttcacatatgtgggactccctgggaactacagggcaaagagtgattgattttcccccctggtagatagagtggaaagaaggctgacatcaagttcaatgttcttacctcaagggggtagactgactttaataaactctgtcctatcatcaatacccacatactacatgtgctccctacaattacccgtcactattatcaaggccattgatactgtgagaaagaattgtctttggataggaaacaaccttaaatccaccataaaatctttggcctcatgggaaaaagtttgtacaccaaaagaaagggggggggggctgggtgtggttaatctaaaagtccaaaatgcagccttgcttatgaaacatcttgttaaagtttactctgcagctgatattccttgggttaatcttgtggctaattcttacctggtaactaaagtccttcatctaataaacaaaggctccttttggttaaagaacattattgctcttgttgatgtttttagaggaattgccaaatgcaacataaggacaggcactacagttctattctggacatatgtggaatgatcaattcaaatgtcagcaatatcaacacctttatgcttcatctctatacaaaaacaattttgtacaagctatgtgtgccaggccattggaggattctttcaagttaccactctcttatcaagcctattgtgagtatctcaaccttcaagatgaactaacacatcttcacttggaacaaggaaggggagattcatggagtttcatttggaataacagttgttttacccccaaaagattctataaactcaatttggctgccattcaagcacacagacctctgatctggatttggaagaccaagtgtgtaatgaaaataaaagtctttgcttggttattcttctgggacagattgagtacaagagatatgttggataggagacattgttgcaaagaagatgacgatctatcatgtgtacggtgcagcactaaccaaagggaaactagagatcatcttatcttcaactatccatttagcactgcttgttggcagtttctgggaatttcatggaatgctaatattgaattttaccaaaggatagcttttacaaggtggcagttcaatgagcctggttttttggaaatcttcttcgtggctgcctggcacatctggaaacaacgaaatggcctcatcttcaggaatttgcagccaaccttccaatcttggaagtctctttttacagatgaaattcttctgcatctctgcagaatgaaggatcccctgaagcaaactattgttaattggttacaatctttatagagttttttcattttctcttgtattttcctgtaaatattacctgtaaaatattccttcaataaatgaaaatcacactgctgggctaagccctggcagtactttcagtaaaaaaaaatataacacgctttgatgtttccacacatcaagtgttattcagaccatttcatgagataaaccagtagcacctaaaaacacatgaacaattatatttagatgaataatagcattccgtggatactttctgaatgctagcaatatatatctagcaggctagaataaatatatgcatacaccgagttaaagagattagtgtaaactgagttacgctcctttcataaatgaaacagagcagagcataatccatgtgaaaaactgaaaaccatacagaaaatggagctgaattgataactattaagccttttcgtttgccctcttagcttccgttagaactgcacataaacaaactgaacaaatatccaaatttgtccagtaaatgcataaagatgcaaaatataagcagtggtcaactggagagcaggtccatatttgtacagtaagtgcatctgaattcagagtcatggcaagctttaccaataccaatatcagaattgaaagtcatgccaaaaaaattaagtgaagcaccatatagaacctgcagcagtgaaaattaacaagttcgtgctgaactttgtaaagtagcatctctgcttgcaatattaactcagaaaggaaagatcttaaatttgatctggctaaattgctagctaggatcctgatcttgtcatcagaatcaaataaactcccttgaagcactgctgccaaataaaaccaaacatcaacgtgaaaaagatgccaatatagaactctgaataaaataacagataaaagtagtagtcctgctaagaatatctttaatttcatttccaaatgacacagccatgtatatatagacttttgcagcgtcaattcttggtaacacatgaaaatcataaagacaatcatagcatgtaaaatggctctgagtaattgagtccctccaagcagaccaataccatgcaggaaggaccagaaaagaaaaagctaattttcagtggtttcactttctgttagagtgctcattccgatcttgatgttgcgtgcctgcagtttcattcagctgcatgtccaataccagtacgtagctatcaaactttaggttgtcatttaacaacttgacgttggtctagcattatcttttatgtaatcacaccaatgtttgatgcaaactcagtatttgatgtaatcgatacgtattggcatctagtcagataatagtaacaccaattaaaatttatatttagtagcataggaaatatgcatcatacatacaaagtgcttttaaatacgagcacacaattcagcacaaaatgcagcacaaaaattgcacataatggcacaggagggagaggatgccgggagtgcattcggcaaacctgcacgaggtcgctttcaaggatgatgtctaggaagccggatctgcacatgacgtagttgaggattgagataaactgcaacaggatgatggaaataaactccgatgacaaagtgcaccaggcgatggacctgcacccatcggggacgggtggaacaaatcggcgagggcgcgaggcggcgagggcggacggacctgaaagcggcgcgagcagagaagcagggagcaccgtggagtagtgtgggcgtgtgaggaggaggaggaggcggcggcaggcggggacggagattgggtgcggcacggaggagaccggcgacggcggcgaggcgggaagtagggcggctccagcgggaggcggcggcggcgagacgcgcgcgagcggaggggcggcggcgggctcgcacgaggcgagcggctccggcgggaggcggcggcggagggagcgcagccgcgcgcgagcggagttgcggcggcgggatcgcacgaggcgagcggctccggcgggaggcagcgacggtgatgcggcccgcggctccggcgggcgggcgcgcggcggcggtgctgacagatcaggcgcgagggtagacagcggcgcccggttgtccggcatgcgcgcgcgaggaggcgagtagggcgtgtagctccggccggcacgtgcgaggaggaggcgagcgactcctacaagaggcggaggaggcagtggcggcgggggaagtggtggtaggggggagcgggagagcaggcagacaagggagcggcgaccgggattccatgagcggcggccgacggcggtgaaggaaccgtcgacacgggagggggttgcgggaggaatcgggagggaatgcgggcgaaggggggagcgcgatcagggaggtgcgacgtggtcagccgatggtgtaaggtttgtttgggccggatgacaggtgggtcccacacaaaggattgcatgattgttgatgaacacgaactttttatatctatactttctatagcaaaatgccgatgcttcgctacggtgtattaaaactaaaaatatttgtttttaaccgaagttattttcacactgctttggtattttttgctcactagaaaaagtctcaaataatagagagaaatatagtagctcataataaattattattcaacagtgcgttgcaacggaataattttaactaaaatcacaataaatatttttaggatttaatttgtgatatgagtaaggtattcttgatataaatatgccaataaacaacatgttgaaaacaatatatttcttgtttaccagatttaacatcaacaaaggttttgtagcaattaaaaaaaagactaacttcctcttgttgggtaattgtattttgttgggtaatttttatttttagttttttcctatgaattagataggagatataattgagagagctaaagtggacttgttgcttttttttaaaagaaaaagactaaccataccgaatgtggcccaacaactcaatcgcacgtcgttagtgcttcatgggctgcatgcggcccagtagtgctgcatcccagagatggaggccagcccaatgcgggattgatccgagccgctcattttgatggatggctcggatcagtttcaaatccatcaaaacagctggtaccaaaactgatgcgaacccgctacggtttgtggcccgatctttcgatgagaggtaagggataactcgattagatgaagacgacgttcacggcccgactacaactgtccaaagacgctgcgccttagcaaccgatacaccgtctccaatggtcgccgcgaacttgtggtgcgcgtcaacccggccacgagggcactcgtcctgcaagtaatcgaagaacaagcaagaacaagtaggacaagcactgaaattgctagataaagatgaaagtttcactatcaaactcaatatggtggggttccgattacaggcagacgggcggtttagccaacacgcgcgctgcgagctggtagcaagaagctatctctaacatcaaaacccgcctgttcttggcggcgactagaggtataaaaagaggggaagaacgaccatagggtcgtgctccaaccctaggacgcgcccctaatgggcccaacttggatacacagcccattgggccaaaagaggtgacgcaacaccatggacagaaaatagtcgggagtaaaatgacaattgcggccgctccagaacagatatggacatgtggctggatccatttgaaagtagacttgataagctttccatgaagtacttgcacgcccaaatcggagtttgcatgaagtcgtggcggccgtcagaagttggcgctaccctgcagtccgaatccaccccgcgcgaatcctcttccctttggatcctctccatcgttcctgagtaaaatacgagtgcacgcgtctccggggtataaagacgaggaatatgaactcaagaaagaactcacctgataatttagttgacgtgcacgagcgcgggtaataggaccatcatgctgtacatggggggacgtggatgtatcgatggtgttgatgtcctcatcatcctccccttcttgcatttgagtcgtcctcgactcaagctcatcttcttctcccaaatacggcttcaaatctgcaacgttaaatgtggaactaaccccgaaatctgcaggcaaatcaatcttatatgcattctcattaatctttgctaacactttaaatggtccatcagctctaggcatcaatttagactttctcaaatcaggaaatcgttcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcacgttgcttagcatcaaaattcagtttttcagaagatggtaaaggcatcaaatcaattggagcacgaggcaacaaaccatacacaatctgaaaagggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaagtccattgaaatatcttcccaaggaacagtaggaacaggaagaggcatatacaaaccatgtggatgtaagcgtgacttagccttttgacatgtagcgcagcgagcaacgaacctgccaacatctcttcgcatctgtggccaaaagaaatgactagcaaggatgtcatgtgtcttcttggcgccaaaatgtcccatcaaaccgcctccatgcgcttcctgcaacaacaacaggcgaacggagctagctggaatgcatagcttgttagctctgaaaacaaacccatcattgatgacgaatttgttccatgttcttccatccttacaatgcagcaacacatcattaaaatcagcatcatgcgcatattggtctttgattgtttccaggccaaaaatcttgtagtcaagttgtgtcaacaaagtgtatctcctagacaaagcatcagcaatgatgttctccttccctttcttgtgtttgataacataaggaaaagattcaataaattcaacccatttagcatgtctacggttcagcttcccttgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgggaagttggaggagaggtgcatgagtcaacttatctttcaacatgtggaaggcgttctcttgtgatgtgccccaagtgaaaggcactcccttctttgaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagccaagaaaagaaactcgatctgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaactttgttttaaatgctgttttccattcatcacccaacttcatacgaatctggtggtaaccactacgcaaatcaactttggagaacacaatagagccactcaattcatcaagcatatcatctaacctaggaataggatgacgatatcgaatggtaatgttattaatagctctacaatcaacacacatacgccatgaaccatctttctttggtaccaaaattaccggaaccgcacatggactaagagactcgcgtacataccctttatcaagcaactcatgaacttgacgctgaatctccttggtttcctcagggttggttcggtatggcgcacgattcggtagggaagcacctgggatcaagtcgatttgatgctgaatgccgcgcaccggtggcagccccggtggcacttccttgggaaacacatcagagtactcctgcaaaatgttagcaacagcaggggccaaagaatgctgcatatcgtgaagtgaaatcaaagcatctttgcataccaaagcataggcaactgaaggtgatgcaatcaactcattaatatcagatttagtagcaagtaagcatctgggtttcaaattgattgtctcaggtttcttgccatcagattgggcttttttatcactctcacatttggatttggcagccttagcaacatcatcacgcaaaatatcttcaggagacatgggatgcaacacaattttcttatcatggtacagaaaagagtactggtttgacctaccataatgcatagaatccctatcaaattgccatggtctacctagcagaatattacaagcttgcatgggcacaacatcacattcaacaacatcatggtaatttccaattgcaaaattaatgtgcaccagttttgttaccttcgccttaccactgttgttcagccattggatgtagtatggatgtggatgcggtttggtgctaagtgcaagcttctccaccatctcgctgttagccaagttgttgcagctacctccatcaatgatcatgcggcaacaacgctctttgacgacacactttgtttggaacaacgtgtgtcgctgattttgctccgccttctccatttgtgcgctaaggacacgctgcacaatgagactctcatagtgatccgcaaatgcagccccaatgtgctcttccggtggctcattatctgcatggtcagccgcaagcaaagcaagtgtatcatcatcgaaatcactagcagaggagtactcaccatcgttttttactaccaaaactcgcttgctagggcagtcacgctgcacatgcccaaagcccttgcaacggtggcactgaacatctctcattcggcctgtggatgccattgaagaagcactcggtgctggctgagcagcctttatcgctgacttgtcaccagatggaggaggtgctgctcgactggttgtgggtgtggaagatggagaagtagtacggccggccggaggagtggtgcgtgtctgccatgatgaagttttaccagcagaaaaattagccttggcactagcacgtcgtccctgcacttcccttttagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaacctattcagcaagtcacgtgcatagtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgttctcaggaaactcatggcatgcaaatttttggtcaacagcaatctcccaagagaggtacgcatcaggatcatattttccatcaaaaggaggaattttaaatttaattttagaaaaagcatcatcattgttgcgtacctcgcgtcggcggcgaccacccatacctcgtcgattgttgtgtagccgtcgacgatctcgagcatctcgatcatcttgttcagtgtcagcaatatattcatcctccaaattatcctcgacgtactctccgtcaatgtcatcgtcattacccccaccattgcctccagcattgagagcatcaaaatgcctcacaagagcagcaaggctagtgtcaatgcgggcgaccgctgtctccagccctgtaagcttagtgttggtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctagacctgccatggtttagaaatgaaggacaacaaaacaatggaggatgtaatgtaagccctacacaactattgggatgtagcttttgcaagacgctcattctcacttcactcgcagcttgtctcacaagctcttaccagttcttaccttgcccacaggagggggacagcaacccacaagttagcaaccgtggaacgaggtgtatcggtgctgtagcaacaagacctgtcaagctgtagtcgggtttgtggtggagctgttggtgggctgaaagcaatgctcaagagaaaactagaaaccacgttagccaaagcaaattgaataatcgctcaagggtatagtgtacagtgctggtcctaggctagttgaagtagagacgcgagcctaaccacaaaggatgccacaaaacacaaacccaaacagcaacgaaaacaagaaccggtggtggaaggtggtgacaaagggggaatggtggggtgtgctcgctggatccttttttttttttttgcttgctctctctagtgctgaggagagagacacaactttttttttatttttttcttttgatatttttttcacaaccaggagcacactagaaccaaccacagaaaatcttatctcaaacggacaaagtatgaagcttgtagaatttttttcaaagttctatgcgaataggtcccgaagcttctcgccacaaaaacagaattttgcaagaggaatttggcgattttaaatttgccgaacccggcaatgccagggagaatcggatgtaactttttttgtagatgtccgtggatatattataagcctaatttcgagtccgtatgaaaaagatatgactgttttaaggaaggtcactcgaatcagggttctatttcctttctagtggcggcaggatacaaggcaactcacaaaagctatcggcagcaaatcaaacacaaatagaaagtgatttagtgggtgactgcgacggtggtgacggtggtgatgacggcaaaattgatgaaggtggcgatgtgcggtggtggcaagaactcgaaactctaatcgcttaacactaagaccagcaaattaacacaaccgatgcaatcaaaaactcaacaagccttaactaagcagtactagtaaaaaggcacaatggtctataggatcacgggaaaactaatctactatttttttttggtcttttctgggctataggaaaaaaaattaatgacgaagggaagggtaaattctctcaccgatgaaccacgctctgataccacctgatgcgaacccgctagggtttgtggcccgatctttccatgagaggtaagggataactcgattagatgaagacgacgttcacggcccgactacaactgtccaaagacgctgcgccttagcaaccgacacaccgtctccaatggtcgccgcgaacttgtggtgcgcgtcaacccggccacgagggcactcgtcctgcaagcaatcgaagaacaagcaagaacaagtaggacaagcactgaaattgctagataaagatgaaagtttcactatcaaactcaatatggtggggttccgattacaggcagacgggcggtttagccaacacgcgcgctgcgagctggtagcaagaagctatctctatcatcaaaacccgcctgttcttggcggcgactagaggtataaaaagaggggaagaacgaccatagggtcgtgctccaaccctaggatgcgcccctaatgggcccaacttggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttagatcctctccatcgttcctgagtaaaatacgagtgcacgcgtctccggggtataaagacgaggaatatgaactcaagaaagaactcacctgataatttagttgacgtgcacgagcgcgggtaataggaccatcatgctgtacatggggggacgtggatgtatcgatggtgttgatgtcctcatcaaaaaccctaaccagagcttcagtttttcctctcccaattccctcaggctgaaatggcgaaggcggcgatttttggcagtgcgacggcgacaaggcacccgctccccgcgagcggcggcggcaccctccccccaacgagcggctgtggcggcgccctctgtcccgtctcgcctccctcgccccctcctcctctccctctcatctccctcccgcggtggcagcgggttggcggcggcgtcgacgttggcggtagccgcgggcggatctgagggtgatggcggcgtcggcggcagccacgggcagatccctccgccccctctcgcctccctcccgcatcggatccgatggcggtagcggcaaccgtgtgtggatccggcggcagttgtgatggccgagggtggatacgttgatagcagctcctcccatgactgatctggcggctgctgctccctctccccagcgtggcgggtggctgctgcttccctccccggtgtgttggcagcagctgcccccctccccagctgcccctcacctccccgacatggagccaacggtggttctctcggtatagctgtagtttgatttttgatttgtgaatattctgaggattttatgatttgggatgttgatacagtggagattgtttattttgatttgggattgcaattgagtgattttgtgattcatgtgttttgggaattggggccaatgggattgggagcaatcggctcgattagccgattgatcgagttggattttttttttcactccaatgctgtttgattaaatttaaatttgtctgtggggatctagctctgggattttttttttaagatagactcggacacaaacaacggatgaaaaaaatcgatcggaagccttacgtattttttaagtaggtatatagatatagatattgcctgtgatcttaatagtgggatagaatctgactcgacatagaatcaggatataatctgactcctgacgtgggctgggcaaactggagtaggaatcggtgtggggtatttttttgcgtgtgaacctggagtcgtgtgtttttttgtgtatatatgcgatatttttttggtacgcgatcttttttcttgcgtgaacctggactcctcgtttttgtgtatatgcgatcgttccttttttttttttttttttttttttttttttgacatgactacatagagaccgcactctatattgtcttaaccatagactcatcttacacatggttgcatactaggacaccaaatgatacatatttttttttcttcttatagatttttcttttaaattatttatccgatttataatccgattacatcattgtgttcattgcaattaaatctttacaacaagatcttacatgactatattttgataaaagaaatatatatgttataaattacttttattatatatgtaagtttatcatatatataaattacttttcgatttgattaaattacttattatacaatcataatgttgtgagttgtttattttattatcttttttagtcaattccatattttgtgctgattaaatttaatttttagatagactcacgtttttatctccataatggaactacttttaatgttatgacaaagttatttcctttttgtcttaagttacttctataatatatgtaaattactttaaagctttactgaaattacttttatatgtctaaaaagtaatttagtgaaatctaaaagtaatttagatatactataaaagtaatttgtaatttttcatcaaaatataatcatgtgagatcttgttgtaaagatttaattcttatgaacacaaccgtgtaatcggattataaatcggatgaatagtttaagagaaaattttatttaaaacataagtgatagtaatatattttctatttacttgatggggatagtgctacagttaagacatctaggtagggtctctcgttagcactaaaacgagaagcctcttgatttagattttgccttttttttatgcgatcttttttttttggcgtgaacctgaactattgcctgaactattgcgtttgtttgggtgaaccaagaaggagcatgggcttaaaatctggatgaacctggaaggagtatgggcttgtagatggatctagaatcctgaaagcaatttagaatcctgtgtatgggcttatagatggacctaaaatcctggaagcaatttgggcttgtgggcttgtggatggatctaaccaaatcaaaaatcagatacggacaaaaaaaatcatattggtgaaaaattagaggcatatgacggacgaaaagttacggacaaaagattatgactaaaggaaaaatacaaatcttttaattagttaagatataagtgtgaccacaaacaggcaccatgttgagccacgtcataaaaatagtttcaaccgtaggatcgacaagtcttttcaggactagcctttagataaaagtcccctccacttcctcaccaattaaacaatgccattgatcaccaccacatctaaatgctatctatttaatcaggtagttaattggacaacagcaatcaagatattagatcatatttactattccaaccatcattcaatcaatttgatatacatatgctaatagaatatatatatatatatatatatatatatatacatatatatatttatgtatgtatatacacacatatgtatatttatgtatgtatatatatgtatatatatatctatgtatagaactactacatggcgctgtgcgccccacacaatatatgacgcgtgacacacatatccccccactctaacccaccgcaaccaacgcacacgcactgattcatattcgttagttaaatttttattcattcagtataaccattcgttgaccaatattgtaacaatgcgcagatgtgcatgtatagttaaattttaacttttatcgtatacatcgtgtactagcaaatttttaacttaaataaggacaggacaatgctatgatctttttttttcgttaatgtcttggagttattttttaactctgattttttttacaagagtcttagcgttttctttcatttttttaataatatctgactatcatttatacagcggatcttcaggggagtctctgattcatatcattagcgatctgatatactccctctatcccagaatgtttgacgccgttgacttttttaaaaatatttgaccgttcgtcttattcaaaaaatttaagtaattattaattcttttgtatcatttgatttattgttaaatatacttttatgtatacatatagttttatacatttcataaaagtttttgaataagacgaacggtcaaacatgtttaaaaaatcaacggtgtcaaacatttagggaaggagggagtatatcttaaaaaagctaacgattcaaccggtcaccaacgccacatcaatacaaagttaatatttaactcaccagacttttagatgcatacttcatactagccagggatcgaacaattgcattagagtttatgtaactgaaagttaatttgtaacaactattgtagattgggatggaggcaggccatctgcatttagatcgcattaactaatcgtccgtgttgcgcgcgacagagccccaactcaaattactttttaactaacagccctgattgaattagctaatcgtgtgagtcgcgccacattggcttcgctggcgcgcgcaccatgtgtgtcgctctgcgtagcggctccgtatctatgtatacatacatacatacacacatatatacatacatacatacatacatacatatatatatatatacgtacatatatatatatatatatatatatatatatatatatatatatatatatatatacacgtacatatatacatatacatatatatacgtacacacacatatatatataggatacctatgtagccccaattaatttacctatatatatatatatatatatatatatatatatatatagacacactagaaaaatgcccgtgcgttgcaccgggtaatgatatggtgactgaaatttgatttgaactatttttatgaagaaaatgaattataatttaatgaaatataaaattttctgcaatattaattacactcttttaaattatagcaaaagtggtcttgcgttgcaacgaaaagaaaaaacagataaaattgaattaaaacatattaaattctaattaaattctaatatttggtattttttaagtagataggtatctaattaaattaatttataagtaaagtaagtgtaagaaataaaatgttatggttggatttaacttttattaaattttctatattaattatacttgttgaaattttcttggaatttaaatagcttaattgctaattttgataatacaaatatcatttcaacatttattaaaatagtggtagtagtgaggatagtgccctcatatctaataggttaaggtggtttgggctatattttgtacgggtatgggctattactctatattgtgtgttgtttggtggtttgtaatctctacgtcacccttcgtggtcttgtaatagcctatgtttatctgtgagccctttttaggatgttttgcgacttttgtgatttgaatggttaagtgatgtgaacttgtgcgatgatggatggtgtatgcgatattgatatatatgtgagaccatcttatgcttatggatgaatatttcttgaagttcacattgagttattgctcttgtgtgtgtgatatgttgaaatgtgatattgaaatgtgcattagcttcatatttgtggcttatgtttgatatgcacatgtttagggggagcttttgattgttattgcaatatatgtccatgtgttctatgttcgattatttatatatttggggagtttgtcatcgattaccaaaaagggggagattgaaacatctaggcccccgttgttaattttggtatttaatgacaagcgctaattgtggactaaccgttgctattgagataatattttaagttagggccacgtcatgtgtgcccctggatgactttcaagggattaagaaggggcagaaccccaagaaacaagacgattaaaattagtgctttattttagaattgatcgaggcgtagggcgaacaaaatcgtagtttattttctagtttcgccgtactattaagagggggaatgacctagcaaagagatgatttaattgccacattaggacattgcattttcacttgtgctcacattttcatcacacacaaaaactttcactgagctcggcctgaccatgggcggtcagaccggccacatagtggcggtctgaccgttttttttggccggtctgaccggccttacagcggcggtctcaccggcccataaggccggtctgaccggcggcacatgcccggtcagaccgtccccctggaggctgggatggtgctgctcggggtggcctttacagagccgacggagccgtatttggtcagaccgagcttatggtggtctgaccgagcccaggccagtctgaccgcctactcaacaccagtctgactggccaggccgatggggccctctgacagcactacaatggctagttttctagccgttgtagagtagcacggtctgaccggccacatacctccggtcagaccggcagagcacaaagttgggggatttcgcccccaacggctagttttggttggttggagtataaatactccctctccagcagcaaggggactctcttggcacccaattcaattacatacaccccttgcacctctctcacacccacttgagctttgtgttcatccatctagtgtgttagagggttgattagcctagagtcaagtgcattgcttccattgtagagctagtgtggcacttgattgatcatctccacgccatgtcattgcttgttactcttcgaggttgccgcctcctagacggcttgtggaggagttgcccggtgacctttccgagaagattgtggaggaggtccggcgccggtttgtgagtggtttagagttcaccaccttcggagtgaaggaagaactaccctagtgatcgaggcttgggtagtcctctccgggggccagtgtcacaccctgcagttctcctcccaagcctaaaatttaatttataaatgaccctaagaaaatgccggtgcaaatcaagagaaaaccctaagaaagtaatacaaataataatcgaatctggcatgtggaatttttcttgagttctacatgtcgaaagtcactaacaggatttatagtggaattttcagagccctagaaataattttaaccaattaaaattgagcaagcaatattttaattccagggaaaatccttttcttcctttttctttttctttttcccccttttcttttcgagtgggccgccggcccattctccttcctcctctcctcccgctgggccggccgaaggccaaggcccagctaggccgcgctggccggccgcccgccttctctcacccgggtcgccgacaggtgggccccacctgtcgggcccgtcacctaccttgcgcccgcgccgccgtgcccgaaaccgacggcgagcccacaccttcgcctcctacgggccacgtcggccacacccgcgcatgcgccggaccttccgcgcccactcccctctctctcccgccggcgcccacgcccgagatggccgggattcgatttttgaatcccacctctctctcctcccccactcccccacgttggccggtgattcccgcctcccccggccatgtccggccccctctctacctatttaagctgcgccgtcgtcccctctctcctttttcccatttcgccgaactccctcgtgctccccatcactcccgcgccgtgcacccacccgccgccgcctttcccgccgctccggccgccgctagccgccgctaggctcgccgccgcaccgcgccgtcgccgccgtcgggttcgcaaggacgaactccaccccgtccgcccttcctccgccgggattcgtcgccagaattcgcgtcccctcgcgctccgggcaccccgaagcccgtccgccggttgccgtcgtcctcccgtagcttgccgtcgcccttcgctgtcgtcttcctccgcgccggccaccctcggtgaggcttcctctcccctctattcccctccctttccttcctagccgccgcttagcgccgccgccttcgcgtcgcctttgcgccgtcgcctccgccgccggttgccgtcgctgaaaacgcgttcgcgcgcgcgtgccgtcgccatcgccgtgggcggtcggccggccttgagccgagccgagctgggtcgccgtcgcccgtccgatcaacaccgggggtgatctgggccgtcggtcccgtggaccggcggtggaccacctgcgtggtcccggtccacggtggaccacccccccttttttgagccgctgcctagtggggcccgcttgccggcgccccttttccctctctcccgagccgctgaccggtgggccccgtatgtcggcgccgtgcccccttgatgacgtcagccctgggaattattgcgcaataaatggtttaaggactttttgttatagtaataaacacagtgaatcttctaaaattcataactaattcatccgtgctccgtttaagcccattcaagtctcagtaaatcaagaaaaatgtgtagaatccattaaaaatggttttgttctctgtttcagtagtattatagcctgtttgcaatgtttgccttgtatgtcgctagattccagttcttccgatgctccggtgtacttcgaaatagtcgccgaggttcctccagcagcagagcaaggcaagtcatgcttgccacttgaacatgttgatcctatattgcaaatgctctattgtttgtcttcaaatactgcatcgttttataatgttattatgggatgtttacctattgtcatagccatgctattgttgtaccatgtccctttgtcagcttggggttataacatgactagagattggactagggattgcttagccatgcttagttcaactagtgcacaatggggaaaatcctattaatgtttagactgttggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcatacttaccacaagccagcgtgggcaacggctgggcttgtagtgtaactttcctctagctgacgcatccaggcaagggtgggcgtgatggagcggggcgggccctgcgacggcctctgtcgcttccggattcacctaggcaccagaggggactgcccgttgcccgctagggacgggggtgaaacctgaagtgtggtgtgcttggctagagggggttatgcgaagggtcctgtcacggcctcttttcggtatgtcgtggtggcatgtcggcgcacggaaacgtgtcgtggggctgtgtcttgtgggtatagttgtacacctctgatcagagtaaaactattcaaatagccgagcccgcggttatgggtggtcaaccagattcaccatgattagtctcaccctagtgtaatcttttgaatttggatagtttaggtggatggttgggcctgttgcaacgtgggatagcattggacagtggatagttaatattaattaattactacaactgtttaaatctttcaacttctgtttataaatgctcgctttatgcaaatgaaccactctaactctcctttgataattccctgcatcatacccctattccggtatgacttgctgagtacagtgggtagtactcagtcttgctctatttttcccaaccccagagtacgagtatgtgtcagatggaggtttctccgaggagtaggcttcgtccgtgccgtcgaggatgcctgtggagtggtgttcccgctgcagttctagtcaaggcttagctccggttgtctttcgcttttccgctgcatttatgtaagacttttatgatgtttgtaagacgtgggtctgaatgtcaactttgtcgtttgtgtaccccggccggtcctggacggggattttaatgcacaatctgcttggaattctattcgagaatttctgggcgtgcggtggcttcgtggttgagcagtggagttgggctcgcctcaacggggagtaggaaaccggcgagtttcccaacctcggtgaaaaatctcttgtctccttgtctcatttgattgtcgcatttacatttgtacaatttacatttctagagacatacttgagatcatatcacctaggattgctaaacattgacataggagtgtgatttactttcgtagagatataattgagccactatcaccctaggtttgcaaaacataacttagttgcttagttagagttgaccctcaccaagcctagcaacttaggttagttttgattaggtgtcatttagttttaaatcacctattcacccctcctctagtcgacatctcgatcctacaagtggtatcagagcttagtctctcttgattgggcttcaccgcctagagagaagatatcgaacgaggtgaaccatgtagggaaggctcccatgtttaatggcaaaaactatttcacttggaaaattaaaatgtctactcaccacaaagctatgagcttccatatttggagtattgtggatgtaggctttgctatcaccggcacgtccttgacggagattgataaccgcaacctccaactcaatgcccaagccatgaatgctttgttcaactctttgagccaagaggagtttgatagagtgagcaaccttgagaccgcatatgagatttggaacaagttggcggagatccatgaggacacaagtgagtacaaggatgccaagcttcatttcctcaagatccaatatgagacattctccatgttgcctcatgagagtgtgaatgacatgtatgggaggctcaatgtcattgtgaatgatctcaaggggcttggggtaaactacaccgatcttgaggttgcccaaaagatgcttagggctctaccagagaagtatgagacccttgtcaccatgctcatcaattccgatatgtcaaggatgacacccgcaagcctcttggggaagatcaacaccaatgacatgtacaagttgaagaagaaggagatggaggaagcctcaccttccaagaagtgtattgctctccaagccgaagttgaagacaagggcaagggtaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggggacaagtcatccaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaagaagaagaagatggccgttgttgccatcaaggtaacatctcttagtgatagtgagagtgatgatgattgtgatgatgtttcctatgatgagcttgtgagtatgtttgaggagctccatgcttatagtgagaagtagattgtcaagttcaaggccctaaagaaggatcatgcttctttggaggtcttgtatgaggagctaaagacttctcatgagagactcaccatttctcatgagaagcttaaggaagctcatgacaacctcatttccactactcaacttggagctctcattgatgttggcatatcttgtgatttgcttgatgatagtgctactcgccatattgctcatgttgcatcatctagcatttctacctcttgtgatgatcttgtggatatgtctagctctagctctagctcttgtgtttctatttgtgatgcctcacttgttgttgagaagaatgagcttaaggagcaaatggctaagctcaacaagagcttggagaggtgcttcaagggtaagaacactcttgacaagattttgagtgagcaacggtgcatccttaacaaggagggacttggattcattccaaagaagggtaagaaaccttctcaccgtgccactcgttttgttaagagcaatggtaagtattgctccaagtgtcgtgaggttggacatttggtgaatgattgccccggtggtaagcctcctaagacttgcatgtttgattctcattatatgcttaggaaggcttatgatgcaagcattgttgctagatatgtggattaccctatactcggtggaaaaaagaatgccatttgggtgcccaaagctttggtctctaacctccaagtacccaaacaagtttgggtacctaaaagagcttgatcttcttttgtaggtgaactaccacaccggtgggagccattgggtgcttgatagtggatgcactcaacacatgaccggtgatagggctatgttcaccacatttgaagtaggagggaatgaacaagagaaagtgacatttggagacaatagcaaaggaaaggtaattgggttaggtaaaattgctatctccaatgatttgtcaattgataatgtctctcttgttaaatccctaaatttcaatttgctttcggtcgctcaaatttgtgatcttggcttgtcatgtgctttcttcccgcaagaagttattgtttctagccttcttgacaagtcttgtgtgttcaaaggttttagatatggaaatctttatttggttgattttaattctagtgaagcaaatttgaaaacttgtttagttgcaaaaacttcgttgggttggctttggcataggaggctagcccatgttggcatgaatcaattgagtaaactttcaaaacgtgatctagttgtgggcttaaaaaatgtgaagtttgagaaagataagctttgtagtgcttgtcaagccggcaagcaagttgcatgttctcatcctactaaaagtatcatgtccacatctagaccattggagctcttgcatatggatttgtttggcccaacaacctataagagcattggtggtaatagtcattgtcttgtgattgttgatgattattctcgctatacttgggtgttctttttgcatgacaagtctattgttgccgagcttttcaaaaagtttgcaaaaagggtccaaaatgaatttaattgcactattgtgaaaattataagtgacaatggttccgagtttaagaataccaatatcgaggactattgtgatgatcttggtatcaaacacgaactttccgctacctactcaccccaacaaaatggtgtaatggagaggaaaaatcgtacattgattgagatggcatggactatgcttgatgaatatggtgtttccgatttcttttgggtggaagccataaacaccgcttgccatgcaaccaataggctttatttgcatcgtctcttgaaaaagacttcctatgagctaattgttgggaggaagccaaatgttgcctattttcgagtttttggttgcaaatgttatatttaccgaaagggtgttagactaaccaaatttgaaagtcggtgtgatgaagggtttcttctaggttatgcctcaaaaagcaaggcataccgggtctacaacaagaacaaaggtattgtggaagaaaccgccgatgttcaatttgatgagactaatggctcccaagaagggtacgagaatttggatgatgtatgtgatgaaggcttgatgagagctatgaagaacatgtctattggagatgtcaagcctattgaagtggaagacaagccatccacctccactcaagatgagccatctacttccgctacgccaagtcaagctcaagttgaagtggaggaggagaaggcacaagatccacctatgcctccaaggatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtgggtctttaggaacaaacacgatgagaacgggttggtggtgagaaacaaggcaaggttggtggcacaaggtttcacacaagttgaaggtttggacttcggtgaaacttttgcccccgtggcaagacttgaggctattcgcatccttcttgcatttgcatcatgatttgatataaaactatttcaaatggatgtgaaaagtgcttttctaaatggtgaaattgccgaacttgtctttgttgaataacctcccggttttgaagatcctaaaaatcctaaacatgtttacaaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtgtgtcaaatttatgttgatgacatcatattcggttctactaatgaggtattttgcaaggaatttggtgatatgatgtctagggaatttgagatgtccatgattggagagttgagcttcttccttggacttcaaattaagcaactcaaggatgggacgttcgtgagcaaaaccaagtacatcaaggatctactcaagaggtttggcttggaggatgcgaagcccatcaagacacctatggcaaccaacgggtatcttgaccttgatgagggaggtaaaccggtagatttaaagctttatcgttctatgattggtagcttgctttaccttaccgcatctaggccggatatcatgtttagtgtttgcatgtgtgcacgatttcaagccgctcctaaggagtgtcacttagtggccatgaaaaggattctaagatatttaaagcattcctctactattggcttgtggtacccaaaaggtgctaagtttaagcttgttggctattccgattcggattatgccggttgcaaagtggatagaaagagcacatctggtagttgccaaatgcttggtagatcccttgtgtcatggtcatccaagaaacaaaactccgtagccctctctaccgccgaggcggaatatgtttcggtgtgtagttgttgtgcccaattgctttggatgaaacaaacattgttggactatggcatatccttcaccaaaaccccactcctatgtgacaatgatagtgccataaagatagccaataacccggtccaacattctagaaccaagcatattgacatacgccatcacttcctaagagaccatgttgccaagtgtgacatagtcattagccacataagaaccgaggatcaactagccgacatctttaccaagcctcttgatgaaacccgcttttgcaagttgaggaatgagttaaatgtcatagacttctctaatgtggcttgagatggtgcaccatggttgcttctgttgcatattgtatatttgctcctatttgctcttatgctttggatttattgccatttggttcttcattgcgaaaatggagcatgtcacattaagggggagttttgcattcttgcatgtgctctacttccctttatatgtgagcaaatcaactagtggtgctagtagtattttcaaaatgcccaagtcaaaataagtcaaaacttttgcaaaatcaatgtaatttgaaaattatctcttggaaaatgtttcaaaaggtttcctatatgttttccaagcctctcattgcaagaaaaatgatttttaaatgaaaatgcccttttggccctcttttgaagaaattagattcttatttttggccaaaatgagattttcctccaaaatgagattgagagagaatttgagaaaagtttcaaaacaaagttggtaaagaggaggatttgaaatgtttttagtattcatcaaatcatattcaaaaaccaaatatttcaaaagttatttgaaaaacaatttagcccaaaaacccctatagaccataaaaggtcacctcctagcactaaagtgagttttgttgcaaatcatcataatcttcaaatattatgggtggttagcaatatttaaactcacacatttcaaaaattgctccaaaaatcaaatttttgttgaattttattgtgtggggttgccggcttgtgcaagggctgtgcacagccggcagggggcctggcggtctgaccggcgctataatggcggtctgaccggccacatagggccggtctaaccggccggcaggtgggcctaggacttttgtcctttttcttctctcttcttcccctacccgacccaatattctcccattcagccatcttcttacccaactcgtaaaaaaactcctctctcctctcccaaaccctagccacctccctccaccaaatcccctcggtttgaccgcagatttctctccggttacaccgtaagtgattctcatccgcttcttctctttattccatggattagttcgtgtttttgttgagtttttgatccatggcatggaaccctaggtgaagcacgaggtgttcttcgatttgcaccaatagagggtagtttcttggtgtgattcaacacctccaactggtaaatcactctccctcttgtgcattctctcaaatcgatctatttcaacctagggcaatgggtagttgttccaatcttgatgaaataggtccaaccctttgatgttctagttccaatcttgtgcaatattgttcttgcaatttttagactcaaatgaggtctgcccggagccacaggcggtctgaccgtgggttagccgctggtttgacaggcgtgtgtgcccggtttgaccggccggcagccgtcgatctgaccggccaccggtgggcggtctgaccggcctgatgccgtcgttctgactggctaccatgggcggtctgaccggcctgatgccgtcggtctgaccgccgtactggctgcggtctgaccacccctccacaggatataggcaaattttcacctctccaaattgtttctagaattattgctaatatcctatcatcctttgatctttgatagtgatgcctccccgcacttgtcatgatcgtcgtgcgcccactccggatcccgtgagtgagcctggggaatcgagcggagaggattacgctcaaagtgatgaagaggttgaggcaaatgttgagggggctagtgaggaggcaagtggagatgatgacagtggaagtggagaggatgaggatgaaggaagtgatgatatgcacattgatccctccatccaatttgttgattacataaggaatccatcgcagtataccatcttgaggcaccatgatcagtttttgaggcctcgggacaccccggatccccgttttcacaccgctttctagaagagtgtgtatgagcaagtttatgtagggaaagcttttgcagagcataagtggatttcttggagagacatcaatgagactccagagtttgagggcttgcaggatctcttcaagactgttggcattgatcggattatgactctcaagcaagactacaatgaagatctgatccggcagttttatgctacagtgtgggtggctggggactatagtgagatgaagtggatgtccgacaccctccagtgttctatctctaggaggcaattctggcggctcctcaatattcgcttggactttggagatgacttgcatgaggagcacacccataatccgctctccatagactacctctctcagttttatgaagatggagtgcggtacacacatgggaaggttgccggcttgaggaccatccccagtgtggttaacaggattgtgagagctaccatcctccctcgccttggcaacaatgatgacattaggggggtggcttggcacgtcatcgatgcgatcattcagggtcgtcagttcgacattgtgtctctcatgatgcaagagattgccatctctaaggggaccttcactcagggaatctattatgccccttacatcatgaggttgattcaagacaagcttggggctgctgggcaaaatttgaagaagcataagcagtacaagccccgccttcagcttggaactccccgtgctcctagagcggcgccctcctctcatcctggagctagctcaagctcagcacctcctcctcctcctcatgggtatgttccaaatgctttcttccatcctcagtatgcctactttggaatgtagccaaacgaatacttcaacccggtacttggggctattaataccctaagtgaaagcattcaacgcttgtctaccgggcatgaagctttgcatgaggatgttcgtggcttgcgcacgaatgttggagacttgaatgcttccgtggggagattgcacactagagtgggtacattggattctcgagtccaaatattggagagctcccaagcatgtgtatcatcgtcgtcgtgatgctcctcattcttccatttcggcacatcttccttctcctccacaagagtgaagacctttttggtgcttgatgccaaaagggggagaaaagtgtgctttgtgttttgtgggttgggactagtagtagtgaggatagtgccctcatatctaaaaggttaaggtggtttgggctatattttgtatgggtatgggctattctctatattgtgtgttctttgtcgttctataatctctatgtcatttggatccttcatggtcttgtaatagcctatgtttatttgtgagccctttttaggatgttttgcgacttttgtgatttgaatggttaagtgatatgaacttgtgcgatgatggatggtgtatgcgatattgatacatatgtgagaccatcttatgcttatggatgaatatttcttgaagttcacattgagttattgctcttgtgtttgtgatatgttgaatgtgatattgaaatgtgcattggcttcatatttgttgtttatgtttgatatgcacatgtttagggggagcttttgattgttattgcaatatatgtccatgtgttctatgtttgattatttatatatttgtggtgtttgtcatcaattaccaaaaagggggagattgaagcatctaggccccgttgttaattttggtacataatgacaagcgctaattgtggactaaccgttgctattgagataatattttaagttaggtccacgtcatgtgtgcacatggatgactatcaatggattaaaattgacggcgcaaagcaaagagaaacaagacggtaaaactagtgctttaatttagaattgatcgaggtgtagggcgatcaaatttgctagtttattttctagtttcgccatactattaagaggggtaatgacctagcaaagagatgattaaattgccacattaggtcattgcattttcacttatgctcacattttcatcacacacaaaaactttcattgagctcggcctgaccatgggcggtcagaccggccactatgtggccggtctgactagccggtctgactggcgtgccctggccggtctgaccggcctcacaacggcggtctgaccggcccataaggccggtctgaccggtggcacatgcccggtcagaccagccgcctagaggccgggatggtgctgctcggggtggctgatacagagccgacggagccgtagttggtcagaccgagccaatggcagtctgatcgagccgaggccggtctgaccgcccactcaacgccggtctgaccggccaggtcaatggggccctctaacagcactacaacggctagttttctagccgttgcagagtagcacggtctgaccggccaaatacatccggtcagaccggcagagcacaaagttgggggatttcgcccccaacagctagttttggttggtgggagtataaatactccccctccagcagcaaagggactctcttggcacccaattcaattgcatacaccccttgcacctctctcacacccacttgagctttgtgttcatccattttcggagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaaccggtgagtttccgaacctcagtgaaaaatctcttgtctccttgtctcatttgattgtcgcatttacatttgtgcattttacatttctagagacatacttgagatcatatcaccctaggattgctaaacattgacataggagtgtgatttactttcctagagatataattgagccactatcaccctaggtttgcaaaacataacttagttgcttagataaagttgaccctcaccaagccaagccacttaggttagatttgattaggtgtcatttagttttaaatagcctattcacccccgctctagtcaacatctcgatcaaacaagccgcctcctctttccccgcccccaacgatgcctcctcctccccctctccacttttattgtgcctctccccctaccttttctcgcaggcgggcgactcccccgccaccggggccgtccctcccttctcgccggcacggagcggcgacagccgggtgcggcggggtgtggcggcagcggcgccttcccccatggcgagcggcggcggcggcggcgcctcccccacggtgagcagcggcggcggcgcctcccacacaccgagcaacggcggcgggggcgggggcgccgccctccccacagcacgatgccccccgactctctccacttctccccctttctctctgtgtggcggcggcgggagggccggcgacgccctcccctccgctagatcaggggtaggggaggtgcggcggcgctggtcctggcggaacgggaggagcggcggcccgacggcgtggaggcgggcgtcggcggccgccgttttttttgtaattttttccatggctattgctaaccgaatcggattgtgtatggacgaaaaacgcacgaaaattagatgtgacgaccggaaaaatacgaatatttatattagttatagatatatatgcacatatatatatacatataggaaaacgcttatatatatatatatatatatatatatatagacacacacatgttcgtacatatacatgtatatatatgtacatatatatatatatatgtatatagccatactatactagacccatggtgcgtagtaactaaaatgctccccctcacatcctactgttaacgaccaaatttagcaatatcagcattggagatgaggattagatcgaggtggaatcgaagacgaagatcgattcgggaacagagtaagaatcggctggagtccaaatcggctacgatcaggatcggctgggtctgaatcagactgggtaagccgatacagctgattccgacaatacgacttggtgtacgacatcgggttgagttgatatgcttcaagatgattgccgcgcatggatagagtcctgagaaggcaattgtatctattaattaggatattttatgtaatttccttagagatatgtttagggcaaaagtctgtcgtaaagacttatggtatcttagagtttattagagataagagtcgtgtccgatatggacatagattgtaattttcgggtataaatagaccccgaaccccatgcaatcaatttacacacatgttcaatacaatttcggcgcatcgccacccttttgctttatttttattttgatgaggtcttgctttcgggttgagctgtatcggttttgatcttcaacaagagataaaacttgttatgacagcttgcgttctcaggattagtgcttccatctttctgatactctaatcttgtttatgtaattcgtcgagttatcatatatcttacataatctccagcaatattgctgtttaacctattatcggctaacatctgtcggtagagggcagctgattaggttaaacatcgatgttgacttagattatataggatatacaccactctatgaaacttccagcggtttgattgtctagatattgttcttctttttatactaaatgctgcatcagttgagtttgatctattaagtcgttcttagaatatcaatctctagcctgccttctggttgccaattagggtagtatcggggtttcagccgatcttatctaatttaactatatttactctatacgcctcattgatatgtgaaatctaccctttatgttaagatcttgtcacatttaagtatattagacttttgtttgatatactctacttgttttaaaatcttagtatagagtggtattagagtattagctggtacatgctagatatatctgatcggctatgctatgaacatatatagtctcgatattaatatatatttcgatttaagtgattcatactgtctcggcatagcgaccgatctatcccaatcacttgatttaagtatatatcgatataaggagtacatattgttaatatctacagccgattgagtagatctacttctttcttacttatttatgaccgccgattgatacataaatgacatcggcccaaagataaattatatgtcatcagcacttagccgatcggctatcgtttataggtttaaccgcggtttgcttgtatctatttcttttttattacaggatcaaatcaactggcacgctagcatacccgaaggcgagtttggacctgcactggagttaagcagatcttccaggcctcgtgttttccatcaacacgcttttggcacacccggtgggacagattagaagtcagaaattttctctcatggacgacaagccgccagcatcgctgtcctcggctagccccagttctattaaagagaagattcagtagttgggcctatccgaggttaatgaaggcaacatcgtgaacatcactccagacaagctgatacctaatcaaaagaaggattttgaagcgatgatgcagcaggcacgtaaccagttcttgagctcatttatgcaaacccgcaaggctcagtggtgcagaagtataaggtaaaggtagttgctgatgttcctggtactggttcttccaaggatggagaggtgaaacaagctccagatggctcggctcaaccgagtgacaaaggtgctttagatggttctcaaggaaatcaaggtgacaactcccaaggagtacagggagtttgaaagtgcattaatcctcctagtgggttttggtgattaatgacaaatgtggttaagggactaatgagctcattgagtagctttcaggtgcattagtccaaggtgtggaagatggatgcttggagaccccccaaaaagtataaaatcaaagcggaccggaactcgagaagtacataggatagttatcttctgaaatcgagtttttaggtaaaaccgtactatgaagaggggttccaagtgatgctctgagatatatcaagtgctcttagtgtgaaccaagtgtcaagtttccctaggagttctttttttttttgaaaatactccatctgtccaaaaatgcaagtccggaacttcctgtcttccaagtccgaaagttccggtcttgtgaaaaagattttcctaagtgtagtccggaagttcccgtcttccaggtcccgaacttcctgtcttgtttccagttcaaatttgtgagtaacggctagatgacgtcacctagctgttatacatatacagctcgtttccagctcgttccttagccattccactttcacttttcaaacctagagctattgctagcctctctgaagtgtttcttgtctttccactgaatctacagcctaattcttgtgtgaaaaagagattgagagggagagaagaagatttggagaggtgtgaagactaggatcttgggtgagcactaggaatatctcgtgggctgtcatcttggtgcttattactcttggagatgatcaactagacggttaggtgtcacccgcgagaatccattgcatattgtggatgtcccgggtaattttgtgaaggatttcccctcctccgaaagggaacgaggtaagttagtgaagttcttgtactgagattctagaggctttccaagtagagcaacccatacttgtggtggatttctagaagtaggttgagttggatcttggtggtcactcaattctagaaatttgcctaggggtgtttggggttaaaggctgtggatttcctctggggtttttgcacaagtgaggcaaggggttaatcgagacccagctcttggagctcctcaacggagagtaggatcacaagattcgaacttcgggaaaaaatcgctcttgtctctttctgtgatagttctgtggatgattctgtggtatatcctctgcttagaatacctgtgcaccatcttgtgaagattggcttagtctcttgtttcgaaatttaaatttcctctctgttctgttacccggaagttcctgtcttagaacaccggaagttccgggcctgggaggtcggaagttccggagttgcttaccaggaagttctgggtctaattgaattttaccgctgtgatttgtttttaagttttcagggacagcctattcaccccccctctaggcttcatcagcgcgttcaaacacgccactcctgcctcggcttcgttttcttcagccgatgattgatttcttgctcgtcttcctgaaagcactccctattcctcaatctttgaacccttctcttttgattcgtcgtaatgataccagaaggacaccattgagttttactgttttcattgtcctcctagccacgatcttgatttactggacccaatctctgatgaacaggaactcttgtctgccttagccgattgcccctaccaaacgatcggcttgagctctccgcaatatcactgcacccaggatagtcctcaatagatggcagcctcataccttcattccaacaaaatcgaaagaactcgcaaccccaatgaggatcaaagccatcatcatcttcttcataatgcttctcctgctgcttgtcatacttcctctgatatttgttgataatcttagccgaatttacctgaaatccttttgcacgacccccatcggctgttcggcaagctgtatgcaccatattgacaggattgccatcaaccttcattggcctcttagaatcatcaaacttgattttgcctcctttaatagccgcttggatctgctgcttgaagactttgcaatcattagtagtatgagacccagaattatgccacttgcaataccttttcttgcccaattcatcagccgatggaattgtgtgatcggtaggaagttgaatctgcttctctcggaatagcaagtcaaaaattttgtcagccttggttatatcaaagtcatacctctcctctttccctgagttcttcacccactggctgcagctatctcagagacatcatcctcatcatccgatccatatatataaggacatacatgattaacctttctagaattcttcctagcctctgcaaacctttgttcatgcaagcttacattctatgtaagatgtgacaagctttcaaagtcctcagatgagaatttctccctaattggagcaatcataccctgaaaagccaaatcggctaactgggcatcagttaaacttaagctgtctcaattattcctcatttctctgaacctctgaatatactcgtacacaggctcatcatgtctttacttgattgctgtcaaatcggacaatttcatctcatgtaccccactgtagaaatagttgtgaaaatgcttctccaaattagcccaactgttaatcgacccatgtggcaaggaagaaaactaagtgaaagccgatccagacaaagacaactggaataacctaaccctcaaggcatccacagccgatgcttcaccacactgagctaaaaatcggctaacatgctcataagttgatgcgctatcttgccctgagaattttgaaaaatctggaactttaaaccggttaggtagaggaactctctcaaaccattcaggatatggctgtcggtataaatttccagcatctttcggcctaagcccaaactgctccttcatgacatccacaatcaaatcagcccatggtcattgctgcggtgttccttgagattgctgtggcatgggctcgaattgattatattgaggaacaaactggggttgagccgaccctgcctgctagtattgaacttgaggtgatggtggctgatactaatagttcaaattgcccgcttggtaattctgaagatccggctggatgttgcgcaccaaatgctcgggaataacttgaggtatcacagctgtttcttgttgtaatgatgaaccgatcgctatgccacacctcattctaccgcataccatatagtgtatagtattgtgtcgctgnnccatcgagtagctaatcaaangngcacca

SEQ ID NO: 3621 - DNA, 2443 bp, Oryza sativa
  unsure (1)..(2443): unsure at all n locations
tgtgnannaagtagtaacactggtacagnagctcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacattctcatcgtcttctacaaacagtggcggagcgctcggtatggcaaggtctggcactcgccatacctcgctccggccgccggtacccccacccccgcgcgcgtctttgaccgtgactccacgagcgcaggcgcagcgcggcgtcaccgttgctgctgggcggttgggccactcggtgctcgtacgcattaagcccatcgtgctcttttttttttttggtaaatactccgtatgtgggagtagtaaccctatccggcgcatttgggaaaaaaaaatccacagtcgctgcatcgattgagcgattgtcagcgtgcggccgtgcgccatgcgcgtgatgatgacgcggggaggccggcagtcggcggcagcaaggcgcaggtgctgtcccgctgaggcgggtaccgcgaaggcatgcgccaggcgagcgatgggccgacggcaagcagcagcaacaggcgggcgacggtcggcggcaacaagaggcgcgcaagcggcgctggtgctggctgcggctggggatggcaccgcaccgcgcagcaagtagccaagcagggagcaggcgagcagagcagcacttagcacttcagcagggggcagccaactttggggaaaatgaatagattggagaagggaaatgtcttggcatcacaaagaggtgcctatttttgaaaatttcaaaacattgcgaatttcagcactcagcacttcattacttgaagtattcttcgtggtatactcttttatttatgcaaatggataatggattacgatcaatggttgttgccatgcttaatataggtttattgacataatattttgtcgtacaatatcgtgcaattgagattattttttccttatttttgttgggtttccattgttgggtttccattctcgcgctagtccatatgtgccacacctagttttttttccatcctccgccactttctacaaagcaggattgctagtctactataagcggagtataatactgtgtactaagagtggctaaatgctactatctcttcaatagtttcctactttcctggccatcttagaggcagcgaatcgaagctgaaatccactcaccgatgcggagaggtcggtgatggcgctgagggcctcctcctcctcatcatcatcctaccaatccccctcctcatccccatcatcatatatagtacgtaaaatctaaacaatgcacgctctcattttagtctaatcgcgcgatgcatctcccaccgtccaatctcgttatcttttcattttcggcttacgttatcgctttctccactagtacttgactgtagataggctgacacacccacgtaacagtaaagattgatatagacatgtatgcctgttttctcttcaaataaaattttctctcaaattatttatccgatctacaatccaattacatcattgtgttcgttacaattaaatcttcacaacaagatcttacatgattatattacgatgaaaaaatatttatatttgtaaattacttttattatatacgtaagttacttttattatatgtttaagttacttttagatttgactaaattatttcttagatatataaaagtaaatttaataaagtctaaaagtaatttatatatatatattataaaagtaacttaaaacaaaacggaagtaactttgtcacgacattagaagtaaattcattgtagggataaaatatgaatttatatagaaaactttatttaatcaatacagagcaacacacataagtttaacaaattttaaaagtaagttcaatgttaacttcaacacacataagatacatactattgcattattcaagtcgaaaggagacactagatggattataaaccaactacgactagctgtttagtcatgtccaatgaaaaatgcatgcattaaagttactttcttttgttctaagttacttctataatatatgtaaattacctttaggttttgctgaatttacttttatatgtctaagatgtaacttagtgaaatctaaaagtaatttagacatatcataaaagtaatttgtgatttttcatcaaaatagtcatatgagatcttgttataaagatttaattattatgaacacaacggtgtaatcggatcgtagatcggatgagtaatttaagagaaaattttatttgaagcataggtggatagagtctctcatagatgggagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3622 - DNA, 9387 bp, Oryza sativa
  unsure (1)..(9387): unsure at all n locations
agagaatagcaagttcatacgaaagcagacgacagagatacacattccccatcgccaccgccaccaccaccgtacaggtccctcgttgcggatgaagcatatagaccgccggtgttaatattggtaataaatgacaagcgctaaatgtggactaaccgttgtctttgagctatacattttgagttaggtccacgtcatatgtgcgcatggatgattatcgatggattaaaattgacggcgcaaagcaaagggaaagaagacggccaaactagcattttaatttagaattgatcgaggtgtagggcgatcaaatttgctagtttatttttagtttcgctgtactattaagaggggtaatgacctagcaaagagatgatttcaattgccacattaggtcattatgcatttagacttgtgctcacatttcacacacacacacacacacttcactgggttcggcctgaccaggggcggtcagaccggccacatagtggcggtctgactggcgtgccctagccggtctgaccggccccaagcgggcggtctgaccggcgcataaggccggtctgaccgccgccacatgcgcggtcagaccggccccctggaggccgggatggtgctgctcgggatggccgatacagagccgacggagtcgtattcggtctgaccgagccgaggccggtctgaccgcccactcaacgccggtctgaccggccaggccgatggggccctctgacagcactacaacggctagttttctagccgttgcagagtagcacggtctgaccggccacatacctccggtcagaccggcagagcacagagttgggggatttcgcccccaacggctagttttggtgggtgggagtataaatactctcccaccagcagcaagggggctctcttggcacccaattcaaaagctctttatggtttaaaacaagctcctagggcttggtatgaaagattgagagattttcttttgttaaaggatttcaaaattggaaaagttgacaccacccttttcacaaaaatcattggtgatgacttctttgtgtgtcaaatttatgttgatgatatcatattcggttctactaatgaggtattttgcaaggaatttggtgatatgatgtctagggaatttgagatgtccatgattggagagttgagcttcttccttggacttcaaatcaagcaactcaaggatgggatgttcgtgagccaaaccaagtacatcaaggatctactcaagaggtttggcttggaggatgcgaagcccatcaagacacctatggcaaccaacggacatctcgaccttaatgagggaggtaaaccggtagacttaaagctttatcgttccatgattggtagcttgctttaccttaccgcatctaggccggatatcatgtttagtgtttgcatgtgtgcacggtttcaatccgctcctaaggagtgtcacttagtggccgtgaaaaggattctaagatatttaaagcattcctctactattggcttgtggtacccaaaaggtgctaagtttaaacttgttggctattccgattcggattatgccggttgcaaagtggatagaaagagcacatccggtagttgccaaatgcttggtagatcccttgtgtcatggtcatccaagaaacaaaactccgtagccctctctaccgccgaggcgggatatgtttcggcaggtagttgttgtgcccaattgctttggatgaaacaaaccttgttggactatggcatatccttcaccaaaaccccactcctatgtgacaatgatagtgccataaagatagccaataacccggtccaacattctagaaccaagcatattgacatttgccatcacttcctaagagaccatgttgccaagtgtgacatagtcattagccacataagaaccgaggatcaactagccgacatctttaacaagcctcttgatgaaacccgcttttgcaagttgaggaatgagttaaatgtcatagatttctgaaatgtggcttgagatggtgcaccatggttgcttcttttgcattgtgtatatttgctctcatttgctcttatgctttggatttattgccatttggttcttctttgcgaaaatggagtatgtgacattaagggggagttttgcactcttgcatgtgctctacttccttttaatcttttatatgtgagcaaatcaactagtggtgctagtagtattttcaaaatgcccaagtcatcataagtcaaaacttttgcaaaatcaatgtaatttgaaaactatctcttggaaaatgtttcaaaagggtccttatatgttttccaagcctcatattgcaagaaaaatgtttttttgaatgaaaatgccattttggctctcttttgaagaaactagattcttgtttttggccaaaatgagattaaaccccaaaatgagtttgagaaggaatttgagaaaagtttcaaaacaaaattggtagagaggaggatttgaaatgtttttggttttcaaatcatattcaaaaaccaaatatttcaaaagttgtttgaaaatcaaattcgccccaaaaacccctatagaccataaaaggtcacctcctagcactcacgtgagttttgttgcaaatcatcataatcttcaaatattatggatggttagcaatatttaaactcatacatttcaaaattgctccaaaaatcaaatttttgttgaattttattgtgtgggggtagccgaactatgcaagggctgtgcacagtatgctggtggctaggcggtctgaccggcgctatatgcgctgtccgacctgcctggtagcggcggtctgaccggcctctagggcccggtctgaccggccgcaccccggcagtctgaccggccgcatatagccggtctgaccggcttgggatggtgggcccaggacttggtcctttcttcctcctcctcctccttctacccgacccctcctcatcccatctcatctcttcacttctccaactcgaaatttcttctcctctctcctctcccaaaccctagccacctccctccaccaaatccatccggttcaaccgtcaaaatcactccggttacaccgtaagtgaatctcctcctcttcctctctctattccatggattgatttgagtttttattgagtttgtgatccatggcatggaaccctaggtgaaggaagatgtgttcttcgatttgcaccaatagagggtagtttcttggtgtgattcaactccttcaaccggtaaatcactcttcctcttgtgcattgctctcaaatcgatgtatttcaatctctagggttaagggtagtttcccccattgcttcaatcttgatgaaatagacctacaccttgatattcatgttccaatcttgtgcaactctgtcctagcaatttttagaatcatttgtgtggattgtggaaggattcggttgtgctactgtcagtggcggtctgatcggccgagggccgtcggtctgaccagccttgagccgtcggtctgaccggccgatggccgtcagtcggatcgacttggggcttgcggtctgaccggccttggctctcggtctgaccgcccctgataggcagcactcccccttccccccacctcactatgtggtttctaaaattattgcttatatatcctttgatctttgacagtgatgcctccccgcactcgccatggtcgtcgtccgcccacgcccgatcccgtgagtgaggagtcaagcggagatgagtacactcaaagtgatgaagaggttgaggaaaatgttagggggcaagtgaggcaagtggagatgatgtcagtggaagtggagaggatgaggatgaagaaagtgatgatatgcacattgatacctccatccagtttgttgtgaacatgaggaatccatcgtagtataccatcttgaggtatcatgatcagtttttgaggcctcgggataccccggatccccgttttcacaccgctttccaaaagagtgtgtatgagcaagtttatgcagggaaagcttttgcagaacataagtggatttcttggagagacatcaatgagactccagagtttgagggcttgcaggatctcttcaagactgttggcattgaccggattgtgaccttaaagcaagactacaatgaagatttgatccggcagttctatgctacagtgtgggtggcaggagactatagtgagatgaagtggatgtccaacacccttcagtgttctatctccaagaggcaattccggtggctcctcaatattcgcttggactttggagatgacttgcatgaggagcacacccacaatccgctctccatagactatctctctcagttttatgaagatggagtgcggtacacacatgggaaggttgccggcttgaggactatccccagtgtggtcaacaggattgtgagagctaccatcctccctcgccttggaaacaatgatgatattagggggtggcttggcacgtcatcgatgcaatcatttagggccgtcagttcgacattgtgtctctcatgatgcaagagattgccatctctaaggggaccttcactcagggaatctattataccccttatatcatgaggttgattcaagacaagcttggggctgccgggccaaatttgaaaaagcacaagcaatacaagccctgccttcagcttgaagctccccgtgctcctagggcggtgccctcatctcatcctggagctagctcaagctcaatacctcctcctcctcctgggtatgatccaaatattttcttccattcacagtatgcttattttggaatgcaacccaacgaatacttcaacctggtacttggggctattaataccctaagtgaaaacatccagcgcttgtctaccgggcatgaagctttgcatgaggatgttcgtggcttgcgcaccgatgttggagacttgaatgcttccgtggggagattgcacacttgtcacgcccgaaaattcactagtaatttccgaacttatttgtgcataaaatcatcgtccaggaatcagccgaggtacacaaactgacaatttaatatacaaatccatcttaataataacgttacatacttacaaagaaaagaaaacagcagcggatttaacggtctagcgatggcttcagctccactcccacaggcagctcaactggggtataagccaaacgtcttctccttctggatccttcatcttcaactgaggtttgatgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgagcaacacacccatgctgcacaggcccaaccatcctgaacaaccatacccggctgtacagatctaactcaaaaccaggagctaagcaaattattaccagttatagtatccataattattgtgagagatgtgagactaatcacgaaaaacattgctcaactcgcccataaccgcgggcacggctattcaaatagttttactctggccagagatgtaccactgtacccacaagacacgattccacacatgttgccatgccccgaaataccaccacggcattgcaaagggggaaatcgtgacaatacccttcgcacaacacaactcaccacagtgcaccattcctggatcataatcaccccctctataaatataaccagaggcatggactccccagcgacccccacggacttctcgccgcttctcagtctggcaccctgtaatgaaccatgctatacaaaagataaagccgttgcccacgctggcttgtggttggtacggttaatgtttcacaacagtagctcgcgaaccggtccttaattgtcatgagcacaaccatcaaaaccatatgctcacaacccaccttatccaggttttaattatcaattaattatcataacacgattaaccatcgtgagctacatttaaatctaaccataagtaataagaataatataatataatttatatttaatcccctttaattagctaatgttactaagcatggctaagcaaacatacatataacatttagctgaaccaatccaatatgtaaggttcatgctaatcaaattataacccataggaaaataagatcatcttcggccattaattaattgggaaaggttcaccacccgatgacattcgaaaacaatgcatagttgaaataaaataatagctttaaatgggttcaacatgctcaaagggttgtttgggatctgtgtgacttgccttgggcttccgcaaacgcttcgtaccttcctcaacggaaacgctctccttcagaacgtcgaaaactaaagcgaaagaataaaaatcaacaaaacagtacaaaaacaagcataaacagtacatgtggatatttttaacatgtagatcttgattttagaaaaatttagcaacttgaaccactcgaatcggatctacagttatttagttatgattttcagaagatttaatctattagaaaaagggaaaaagaaaagatgatgatgtcacgatgacgtcatcgacggcagccacgacatgggtggcgacctcgccggagctagagaggtcggccgggctatctaagggcatctacacgtagaggacgacgacgcgatctcaacgatactcaccaacgcgacgaacgacgacggatgacggccggcggcgagcttgtgcggcggtggcgactcggtcgtcggcggcggcgactctccggtgaccggcgacggcggggagggggcggccgagcttcccctcttccacgcgcacccgacggcggcgagaggaggcagcggcgacggccaaaacgacggcgcgaggcggctgttcgtcggccggcgacggcggcggctaagacgacgtggcggcggctctacggttgacgagagagctcgggagatggggcaaaagaaagagaagaactaggggatgctttatataggcttggactagagagatcggactccaaacgagaggaatcgaagccggaaaatcttcgggttagtttggagagataaactcaaaacgaattttatttggataaaatacaaggaattaggttccgattcttgggggaaacgaaagaggaagataaagtaaatatttcccctcaactaattttaggaaaacacaagagaaaaggtcggatttggaggggaaaaaccgagcccactcggtctcagttcggctgctagaggtagaagatgaacagtgccaagggaggcaaattagactttttcggttggctgagaacagaacagagcacttgacttgggccggcttgggctgcacagcacgcgcgccagggagagagaagaggaaggaatgggctgaaaagggcccaagctgaggaggaggatttaaaaacttttttccaattaaaataatcacttaaatgatcttttaattgttaaaaatacttccaatgctcaaataattccaagaaaaatcttgaacatacttggacactcaaagtatttaatataataatatccagatcatttaatgattaatttattatttaaataaattgctaaactgttctttgtattattaacattaggaattgagctccgaaaattccgagaatattccagagagtataattaaccatggagaatttaataaaaattaaatccatccatgctttatatttagaaaattttatttcccacaattaacttcacttgtaaattattgaacatttcatataaattctattaataatttattaaataatttataaatcctaagacgaaaatcagggtgtgacaacactagagtgggtacattggattctcaactccaaatgttggagagctcccaagcatttgtgtatcatcgttgtcgtgatgctcatcatccttccacttcagcgcgtcctccttctcctccacaagaatgaagacctttttggtagttgatgccaaaagggggagaaaaatgtccttaggcgtgctttttgtcttgtgggttgggactagtggtagtgaggttagtcacctcatatctaataggttaaggaggtttgggctatattatgtatgggtatgggctattactctatattgtgtgttccttttcgttttgttgatctctatgtcatttggacccttcgcggtcttgtaatagcctatatttatttgtgagccctttatgtgttcttaatgtgaacttgtgcgatgatggatagttggtgtgacattgatatatttgtgaccatcttatgctcatgattgaatatttcttgaagttcacattgagatattgctcttgtatttgtgatatgttgaaatgagaaattgaaatgtgcattggctccatatttgctatttatgattgttatgcatatgtttagggggagcttttgcttgtcaatgcaatatatgtccatgtgctctatgtttgattatatatatttgtggtgtttgtcatcaattaccaaaaagggggagattgaagcatctaggcccccggtgttaattttggtaattaatgacaagcgctaattgtggactaaccgttgtctttgagctatacattttaagttaggtccacgtcatatgtgcgcatggatgattatcgatggataaaaattgacggcgcaaagcaaagggaaagaagacggtaaaactagcattttaatttagaattgatcgaggtgtagggcgatcaaattttctagtttatttttagtttcgccgtactattaagagggtaatgacctagcaaagagatgattttaattgccacattaggtcattatgcatttagacttgtgctcacatttcacacacacacacacttcactgggttcggcctgaccaggggcggtcagaccggccacatagtggcagtctgaccggcgtgccttggccggtctgaccggccctaagcgggcggtctgaccggcggcacatgcgcagtcagaccggccccctggaggccgggatggtgctgctcgggatggccgatatagagccgatggagccgtattcggtcagaccgagccgatggcggtcatatattntcttgcttattttactacctttaatagacgatttgccatgtcagccaatcaaggctcttgcaaacggtcaagtggaccaaccacattcgaaggttcatgcatgtcaaattatcccccaaagcaaattaaaaactaattcgtcctttatttattggatatagttcatcatgcctcccacatatttcgcatacatgatttactccactcacactcatgcgctcgtggcttctctttaaaatcctc

SEQ ID NO: 3623 - DNA, 21731 bp, Oryza sativa
  unsure (1)..(21731): unsure at all n locations
cgcgatagggcctctgacaacactacaacggctagtttcctagccgtgcaagagtagcacggtgtgaccggccacatacctccggtcagaccggcagagcacagagttgggggatttcgcccccaacggctagttttggtgggtgggagtataaatactcccccaccagcagcaagggggctctcttggcacccaattcaattgcacctctctcacacaacattgagcttagtgttcatccattgtagtggttgagattgatttagccaagagtcaagtgcatttgcttccattgtagagctagtgtggcacttgatcatctccacgccaagtcattgcttgttactcttggagattgccgcctcctagacggcttgtggaggagttgcccggtgacctctccgagaagattgtggaggaggcccggtgccggtttgtgagtggtttggagttcactaccttcggagtgaaggaagaactaccctagtgatcgaggcttgggtagtcctctccgtgggccggctcccgccttgcccaccccttgacgaagggggcgtgcggcggcttcgtggttgagcggtgaagttgggctcgcctcaacggggagtaggaaaccggtgagtttccgaacctcggtgaaaaatctcttgtcttcttgtctcatttgattgtcgcatttatatttgtgcaatttatatttctagagacatacttgagatcatatcaccctaggattgctaaacattgacataggagtgtgatttacttccctagagatataattgagccactatcaccctaggtttgcaaaacataacttagttgcttagttagagttgaccctcactaagcctagcaacttaggttagttttgattaggtgtcatttaattttaaatcgcctattcacccccctctagtcgacatctcgatcctacagcagcgcggcggcctaggcgggcgcggggcatgggcggaggggtggagacgaggaaggggcgaggtggcgccgcggcggtagcgaacgggaggaggcggcgaggggtcggggtcctggaggggaggagaggcatgcagctgcgaggaggcggcttgtaaattagcaccactttgttaaaatttagcaaatattttagaaactagaagggtgtgtttgtaaaatgggttaggagaggtgagattggaaaatgaaaatgaatagacggataggatgaaatgggggtgagaagaatggatggctaagattgaagcttgtcctttgaggggtgggaaatcatatcccaaacctattatccaaacacagccgaaaggtgttacagtgtcaatttccttcgagaaagctactgcatttgggattattgagaaatgtccttccacaaattactccctccatccaaaaaaaagccaacctcgtactaggatatgacacatcctagtacaacgaatctggatgtgtcacatcctagtatgaggttggctttttttgggacggttggatttggggcatatgacattattttcatgtaaatccttttccccgagtagtgatggtacataattttgtggtaatataaaaataaatattgttttcttataaagaacagcaagtatgatagccatttattccttcttcattttgaaattcacgctcatgagataccatattgtttctttttactggaaaaaaagaaacaatatggtatcattgttgtatcaatctcgttattgtatttttttactgtccgtttcattgtgtacgagattgtatcatttcaaaaaatatagtaacgtacaaaatgccatttattccttctttttacatcatctcgtttcattgtgtttttacggtccgttattgtatcattattgattatctctttatttctccaatacatacatgagctcaatattttttttccttggtgcagtgaggtactcctacatgttaaaagaagagaactatggtgccacagtaaatgaaaaagtcaaatcgaccaactatctaaattattgatgtcatgtgaacatggctctgttttttctttattttagtttggtgttatggataacaaactgtctaagctattaaaatgttggcacaatcaattgaaactaggtgaaacctcgcacgttgctgcgggagttcagtaggataacaataggtaaaaaataatgtataagatagctaaacaacataaacttacataaacactaaaaacaattgatctgatatggcttaattagagaatagagaaataacattaaccaagtgagaatgaactacataggtacataagatattataaaaaaataatgaatatatatattgaaatattatgtgaattatgtgggatgatgatttaacatgctttcattttaaaagctctaaaatgtaataaattttaaattatagataatatagcatgtttgcattatattaaatgtattgattgttagtggatgatgatgtgttaacttgttagtggatgatgatgtggtatctttgcatgttaagctttatgagttagtgggttataactttatagtcagataggatatgacgggttctcttagtctagctacttgagatgcgctcatagcgcagtggcaggattgctggcatgcaccccatccgcccaggtttgattctcctcgagcatgctcacttggaatatttgttcctttcttcttaaagccatcagcaccaagccctttcttggtgtccaacttcttaatctagctacctaaaacttcatatgtacatgttctttatctgctagctagtctaatccaggtaactataggcaatgttttgcatcacatagatggcaacatcatatgacctattaaccttatctaggtttgacatgagaagtccatatattatgttttacttgggtgccatcttatagttatcagtgagctttattattgatttattctaatttacctggtgtttttgtccttcaatgcagcccatatctaatgaattgaatttgtatctttattgtgatgtgcatctgttgtatcacacgtattattgtaacttcaggacattagaaataaataagtttgtaatttgatagcaactttgaatgatgttcggcattgccacaagatattatttattctgactgacaatcttataacacaaaaaattgaccaatcttaatgaatgatgttcagtattgcggtattgccgtaagatattatttattctgtgacaatcttataacacaaaattttgaccaatctactgagaaacttgcaagcatttcctgctactgaaaaagcatttatgttaaaaataacaatgctgaggaagacaagcatttcttgaatgtgataatataggcagctgaaatttgtaccagattatgtatactatcgtatacttgtttctaacttattataaacatgtataattaatgtggaattttaggcacaaatctctaaggaggcaatgtacatttgacaaaacgcatgaggacctcatcattgcttaaaaagtacttcatctgtttcacaatataagtcattctaacattttccacattcgtattgatattaatgaatctagatagcatcaatatgaatgtgggaaatgctagaatgacttacattgggaaacggagggagtagtatataagatattctctgcatgggtgaaaaacgaacactctaaaatggttcttatgctaactgatgtgaagaaaactttgtgcggaattataaataataagaatatgtttcaaattgtatgtgtttattactactgctatcttatagcttcacagatttaaacaattggcatcatagggctcatttggcttggtacccaacgaaattagttttggcactaccaatgttttaatagagttggggtataaaagctatattaatttaggtaaatattggcattaatctaaatattcagaaagtactatttaaatttaccaactattttgcagggcaagtttaggcatcaaaccaaaatagcccatagtttgatggactactatctttttgcaatacttttatatatgattattctcaaactaaacatggattttgatgtatttccagtttgtaaaatagaacatctctgacctcaaaatccatgcattttaacaaaatatcactttcttttccaaatgtttccaatcagcttctgtctactttctgataggcggctaggagaaagcatataccgatggaactgaataacaatgaacaccagtctcttctgcggaaaagaaagaaagaaaggaaaaaaaaaaaagccagggtcggttttgcttatcggggtcccccttatccacatcagcgtctcctcaaccaatcgccatttgccgcgccttatccacctcaccaaaaccccacttcttcccccattttccacctccacctccacctcccccttcccttctcgccaatctcacttcatcctcctcctcccatcaatggcggcggcgctcgcgttccccacctgctgctgctgccgccgcccctcgctgcgtccttccgcgggtcgccgcggccgtcgccccgtcgcccgctgcgcgctcccctcctccgaggtgagcgaagcttcttgcgattctttccttttagttgcgcgagcgggatggcttgggtgcctgcattggtgggagccggatggatgggtttggggtggatttctggtgcgcggcaatgtgggtcaatcggtgtggttggtgggaatcgaattagaattatcctacctgcgttgtactatatacgagtattgcggtatctctgtggtggagggggcttgtttactttactgccaggggtacaagtattcagatgttaatgcacacatgattaataacctaatggcctgagagcaatgtattgtggttcttgcaagattttagtttgttcatgtggggacgcttctgcgttgccataagttttcagctcccagtcagcgtgagactgactgacaaggtttgagattttcctctatgtaaagttctgcatgtgcgtttgcttagtgttgcgagttgaaaattgggtgaaaacagtattatagacatgatacgtagtaaaactgttagatgatgcagagttttatagctgcaaatttggaaagtgaattgttgtgtgtccaaactccaaaggattgaagtgcgaaacattgaattttattaagtaactacgatatttttctttcataattgcagctaaacctttttcttttgcgaaagattagatttagttggcaaactttcctatgcttgttcttggttgtagcaaatacggaaccatccaggcatccagtaagattggtaattctgtttccataagctattcttactgactgctgttgtcctgcatgtttcatgtgcgacctaagcttaggaaggtaaaaaatttgttgatggtatgcagcttgtgctattatacgaatgaaaatattttctcctttgcattcataatcatgtgtaaaagttggctatgttcctttcgttcaaatagttgcatttattttctgttctgcccttgtaaaacaacaatttccttcattatcggtacggataaagtttcatactgtgatacctctagtcagatggtttggttctcttttactttgttaatttattctaattttttaattcaattcttgcagaagaattcatttagctggaaagaatatgcaatttctgtagcattatcggctggattaatcactggcgcaccaacgttaggatggccagcacatgcttctcctcttgaaccagtgatcccagatgtttcagttttgatctctggacctcccattaaagatcctggtgctttattgagatatgctttgccaatagataataaagctgttcgtgaagttcaaaaaccactagaggatatcactgacagtcttaagattgctggtgttagagccttggattcagttgaaagagtaagtcatccttttgagctgccgattagaaatggtctaggttttatctagaggacaatgcattcaataactgaaagcagccaccttttatttcaactctcttgaatttacttactcacttgggctactggaaatttataatttttttcttcaaattttagaatgtaagacaagcatcgagggcactgagtaatgggaggaacctaattcttggcggtcttgctgaatccaaaagagcaaatggggaggaattattggataaattggctgttggacttgatgagcttcaacggattgttgaggacagaaacagggatgcagtagctccaaagcagaaagaacttctccagtatgttggaacgtgagtgaacataactcctcaaaacaattatatgtaattgtttgtctttccattgctaatgtatggagtagtagatgttctgaccacaggaggctgatagatacaacaatcctattgcctgacttgttttaagagaaaaggcaaactagatgttttcccacctgccattctggggatcaaacccgggtggtgcatttcagccccacaccttcactactggggacattgacaaattgttatggtttgctgaacaaaagttcttgtgaagtgataactctttagtgctacagaactgaattatgtcagccactaaataaaataattgtgatcactcttacggaaaggctcttctcgtactttcaccactgaggacattgacaaaatgttctggtttgctgaacaaaagttcttgcaaagtgataactctttagtgctagagaactgaattatgttagccactaaataaaataactgtgagcactcttatggaagggctcttctcatttataccttgtcattgactctgcagctgagatcttcctgggacattgcatttctgcagtgtagaagaagatatggtcgatggattcccctatgaagtgccagaagaatacagcagcatgcctcttctcaaaggaagggctaccgtggacatgaaggttaagattaaggacaatcctaatttagaggattgcgtatttcggattgttctggatggatacaatgctcctgtgactgctgggaacttcttagatctggtggaacggaagttctatgatggcatggaaattcaaagaggtaaggttgcttctgtgatacattccatagatatagtccaacattgtttataccaatcaccatttttaattgcattttgataaacatgtagtagataatcttgatagtaactagcaagctcgttttactgactaagccatggcattacccattttttcaatgaagaagcctctctagttgttctctgttatttaggattgagaagtcagaaccttaattatctagtgagcttttgttaactattatcggttcttttgcagctgatggttttgttgttcaaactggcgatcctgagggaccagctgagggatttattgatcccagtactggtaaagttcgtacaatacctcttgagttaatggtcgatggtgacaaagcgcctgtatatggtgaaacacttgaagtaagtaggcacagttctttcttttttcagtttcagaatctaccggaaattttggcaactgtatgttgatgagcttgttcttacagtacacatgatcatgcattcaggaacttggccgctacaaggctcaaacaaagcttccttttaatgcatttggaacaatggcaatggctagagatgtaagtatcatgatactgcttcagtgtaatgtatcaagcatctgcagatatgggcatgcttcagcattttctaacattaaacgtttgaatatcatggcaggaatttgatgacaattctgcttctagccaaatcttttggttgttaaaagagagtgagctaacaccaagcaatgccaatatactggatgggcggtatgccgtatttggatatgtcaccgagaacgaggactacttggcagacctcaaggttggggatgtcattgaatcgattcaagttgtctcaggcttagacaacctcgccaacccaagctataagattgtaggataaaatgtttctttttttcaggagttccttgataggcaattattttaccatattgaaatcagtgtgaagtgctataatctctaaccctcatctcatgaccttctatgttttgtgagctttgcaatatgcgggattcaatattacttgaaagtaaagacgttcatcatttgtctcttgccatatgacctaaaactgaatatcaaccgttttgtctgaaaactagcatggcgtttgtgtgttcaagggtctgctactatgagataatgaattacaagagggaaaagtaaaagatatgttgcttattttcacactgcattctgacttactttaggacttctcagaatggctgtctcccagtgcagttctagttaataattctgaagattttatcattctgttagcgcttttaccagagtagacattgagatataacagtttgtaggggtgtttcatatgtgccactctaaaacagtggtgtttcctatgcaaataagtcgcagttgacaatatgtaatcctatgttataaggccactcttatagttgcattggcatatctcaaactttgcaaaagtacaatggcatggttccaatttacccttatttatttatgtttatttttatataaagtgaatttaccaggagtatctacaatgttttggctctactccaatgagacaatacccaagagggttcagaaacttaccctttggcttatcttggtgaaaaccaaaatggtctaaatatgaacttggaacacctagaaaagctttagaagcttattttagtaattgttatgtgcatgtgtggctatattccggcaaaaaccatgcttgcaaaaaggcccagggaaaccgaaacatctctatgagctctctctctctctctcttgtagagctgtgaggagtgagccatcagcgccgccatcgatcacacacctcccgcttttctatgtctcgtgtgagagtcgagatatacttgatagtacagtggtaagagatgtgtggttttaacaccaaggtcctgtgttcaattcctaacacgctcacaatttcttcttacaaaatgttttgaagtacatctgtccctccaatcctcttttttttccttgtgtgagagtcaccacaccgctggacttcttcgttggttccacttttagccccctttatccttatcctcccacgtgattacttggcttgtcgaaaggatctccgccctggtctggagtgccctcgccgccacaactacccttgccgcgtcaaccgtgtccgacatttgccccgtcgaagcggcgagagccgaaggtgccacaccagcttcggcgaggggcgtcgaaggctctactccctcttcggcagccatctcccctcctgcttcactctcctttcgcttagcaaccttctccttcgcgaccttcttcggtggcattcgctctcaatggtttcgcttagaggtccccacggacggcgccagctgttatcgaatggacaactgcgtcacatcgaaggacgtggttctctcaacagtggttggaagtaaagaatagttatattacttagtgaaaaattttttgggatccccccattacatggcctagaggggctatttataaccctattacaggtcctctcccctagggtttaggctttacaggggaatttacatggttacccttacgataaggacattattagggatacatagtgtcctttacatgtatggaccctaattgggctaaatggcttggcccattgatctggcgaatccttttcggggacgcaacggcccgctgggcttcctcaggtggggtttggtgccttggcgaaacccatgccctcgggccaaggctttcgccttaccatattcgcctaggtgacctcctgacggggtccttgtccggcgaaacacgtgtactcccgagccgtggctttcatccttggggtatccctcttcgaccttctccgctcgcctccggtctgagcctgttgcccaagttttcggtttcggtaggcccggccgaaggcccttcgtggtatacctccaacagtgataattagctgttgtacactcctctcattattttatcatttccagccgaaactaagagagaaagagtggtgaaagtaccaaaatgcctctacgtcgttttgcttgtaaatgctggtcaaaccagacctgatcccctcacgcgccatccctgtgcgcgcgctactcaacgtcctcgcgtcccgccctcggcggtgtgaggctcgcgagatcccacgccccagttaattggggcgttggtgtcatggcgcggcgccgcgggttgtggcagccagcgaggtgcgccttgagcgccagtttggatgacgtgggggcggggaaacggagttcttgaggccgatcgaggagcttgcggtggcggtgggtgtgcagcgcacgggttgcgagtggctggcgagcgtggagagcagcgcggggcagagctgggatgcctttatcgctccagatgctgaagcggaagaagcagcagcagctggtggtgtggcagacgcggtgggacgagcggctactggactccgccggcgactcgatggggcgcaccttcttgtcgatggtgctcatcgtgcaggagctgcagagcttcgcgctgcagcagatgcgggaggcaatgctgggcgacaaccaacagggcgtcctggcgcgagtccatggcgagatgcacgcctccttcgtctggctcttccaggacatcttcgccagcaccctggctctcatggtctcccccatgctcctcctcgccaacttcatcgtccactccatgggtcagtgtcgccgccgcagcagccatccctcccgctctgccttccaccgcggctgtcgcggtggtcgacacccaacacgccgacccatcccagtgggttaaacactattgacccaagggcaaagttgtctctctccattaataataaaataataggagtatccagccgctaattaccactttttacagtgtccacgaaaagattcacgttcttcgggtgtctttaagcaaatgccacaatctttgagtgccctgtagcaaattttgcctttagactatatgcatgtcgccacatgaataatacaattctttgggtaaagcaagtattggtaaggttgcaatcgctaaagttgggtttattacatttaagatgttctaatttttttatgatgtcttagctataacgatcgatacaaacattatcattgacatggttatacttgaaaagtagttagatttttttcacccgttacgacgcatggacatttttgctagtaatacacatgttactcccgtgtatgatacaatgggtggtgtacttaagaatactgactatcatacttaggggtgaaaacgggcgggtacggtcagattatggcattcccatatcctaacccatattttcttttaaattcggaaccggatacggataataccggataatatatcactcatcccgtatcctatcccatattatttccttcgaatcgtatttgggaacggatatctatttgtatctctaattcatagatattaaatatcataaggtcattaaagtattaaaatacatacatcaagaaaaaaaattatacaatattacatgtgaacattaaaataatgattaaccgatcttttatcatgtttctaggtagatttataataaatttacatacatattttataatacgggacatacggacggatacatgtcttcccgtttcgtaacccatatttttctaacgaattcggattcgaactcggtatcccattttttctcccatattcctcccgcgagcctcgggtcgggcgggcggtcgggaaatacccgctccattttcacccctaatcacactaagtttgagctaccaaattttttagacatatgctccgtcacctttatagagagagacgattcaaaagataaggaaaccaaaatagatttattttgagatagtactcctataacagaagaaacccaccgaaggcccaataaagtggaagcatataaccctatgcccttgtaaggtaaccctagggctaaccaccagcttcctcccaatccccaaatccaccgcgcagacacgcacgccggccggccggcggacgcgatccgctccgttgtcatcgctcgcgatacacgcagcgactaggcccagcaggtctgcacggcggtctcctccggctgctcctttcattccaggcacgccgggcacccccggttcgttcatcgcatctcaaagaaggtagggaagcatcgcatctcgccgggtattgccagttcgccgccatgccccaaccgaagtgcccaacggagcggaagaaggctgaccacctccaattgattccttgcggggccccggccgggtcttgcgggggggtcttgcaggataacaatgtgcaccaagattgatgtaagttgctccgagcatatagtgatgtaaattcttatactctcacacatcggcgacatcatgtgttattcttgaatactctcccgcgcctagccgtagcccgaaggcactgagcctcaatacgcatatcatatctaccagttctcctttatttttccattgttattagagaaccggatctgagccgtcttggtctcatgtctttctttctgtctttttttcttttcctaaaaaaaaaattaaaattggatcttgcctggcagtcccgttgtaagacgaacaccttgtccggaaaggatgtcgattccaaaaataacacggagaccatgttcgagttcatttaccaataatccctatggcacgcatatatacatatataagtatagccgatgcagtgtattgtatacagattattattattattttctaacaccgctagttaactcattgctaattctgcatgtacttggcgccatggactatgaattcaagacatacaagaagaggcagaggggacaacagcaaatggactttgaattgaagacataccacaggaagaggcagaggcgaagggggcaccagcaaactgtagagttacccgatgagattgtgagggaagtcttgatctggctccctgtaaaatccctggcaaggttcaagtccgtctgcaaggcctggctttccattatctccgaatcttgttttatccgtgagcatctccagtgctccaagctgaaaagatactggaacccgtcttcctttctcatcacgccccatattcctctgaaaccaggtgactctatctttgctgctttctccaccgacatccgcttctatcagtggtcattacaagaagacacgagggctgctgcaacactcctttataggaggcacttccctgccggtgagtttgaaccggtgctcccaatggcacattgcgatggcttggtgctgctccccactaagaccaaggcctacgtcttcaatccggccacaagggatgtccttgcactgccagagagcaatcgcaacatgaggcaacgtgacaacttgggctttgatgcttcgactggcaaatataaggttgcacgatctttttatcgttcccgtgaatataatcccatggggatcgctgcaatgggtttcgaggtcttcactattaatggagaagaaagctgttggagagaaactttggtggatccaccctaccctgtgctgtattcaaagattgttacacactgcaaggggtgtctattctattacattgataagaagaatcagcaaaatcccccacaggctctgctccgtttcagccttcaagacgaaacatttggtgtcactccgttgcttactgacacgtaccctcaagttgaagatgatgaagttacaattactgagcttggcggtcaactatgtgctactttcttttgcaatactctgcaacaagtatgtatctacatgtcaggagatgtcatggatccagattggaattgttggcatataataaactttatgaattgctatccaatagcctcgcttggcagcggtcggattttattgaggagaggtagtcttgtcttctgtactaatctgaaatcgtacagcatagaagataaattggatattgatgatataaggtaccttgggcccaatgaagacaacttggggcatgcatgggaagacttatgctggtatgacatacttccttacaccgaaagtcttgttccaattattcctagggccaccttacaggccttataatgtgtatgcctttgcgcaccaacttagtggataacccaacatcttcatcgagggaagcatgaagaaaaagaagaatgaagattatttaatgatttaaggggcacttaaatgaggtgttgcatgtttgttatttgagagccggttcattttgtagtgtaaaactttggcatatagccaatatttggtcaggtggtcaggttgagaagtataagttatgtttagattgttaccattgtcttgtgagacgaagattctagaattaacaaagtttggtaatggagacaagtgtcggcaatgtttagaaatttggtaaggttagttttgacaacaaagtgaacatctcctgagttgtttccttataaacaccctaaggcagtgtttggcaaatggcaaagggaaatgatttcccactcatctttaaatcctaaccattcattctcccttcccatccatctttaaatcctaaccattcattctccctctttcacttaattctaacccttcatttatttcccaatcccaatcccaccccccatttcctattatccaaacacaccctaagttcttatgattcttcgcttgtaatagtatttctttctgggtgcctttggcagggctcctgtttgtttacgattctccaagttccagattttgttcatactaaaaaaagggactatctatacaacattcagctaaaaatttgtaggtttttgccgaattttggttcatccgaccagacatgcgtcaacatcccgagcgagagagcagagcgcatgggtagcactcctctgcacactgttctgttttttcattttttaatttttttaatatttacagaaataatctatcggcgttaaaaattacaaaaatagaccctgccgcctcagtggtgggcggcaagctgacgtggcagacggcggctcgaccacgccgtctgccgttgtcggccaaaattacatttagccccttgccgccctttggggctaaatgtaattttggcagcccataaagagcttggggatcgtactttttgcatctgggcccgactaaatgatttatctctatagacaaatgatttttgtctgttatgttaataataattaaagaaatatttgttggtaaaaattgttaataatgttataaaaatgtattgaagttggtggtttcgcaatttcatatgttaagtaagatattattttgtaacttattcgacgtattagtgtgcgaaattgatataggcctatcgcagtctcggtcgtagaaacattatatggacttaaacaaggagaattatgtaacataaagaaatagtagtaaaattttaacatgatacatctatttccactgcggttacgtagatgatattagattcgaactagaagagaggtagtgcaagagttgaacacaacgacgatgtagtaatgggacaaggaagcatgacagtagaaatttcaatatgccaagttgtccgataatagctaacccctacgtgaggatccctctactctctcaaaccgcgctttagtaaccctgtatttctctggtagttcaagctgcacaacacggctaggtggagttagaacccttctggtgtctatacattctctgtattgacatctccttggtggttcctgggggaaagaatagatgtgaagcgaacaaagttagtaaatgttgtcagaaaacaaggattcatgataatcaaaatattcttaccatgaaatcatcgtcaagaatatttggacaaataaagaaccttcgacccaatgtcgtaggctttatggaacgaagaacctgacaacgatcaccgcacctgcatcttggacgggcttcccatggagggagtgctgtagttagcacccgccagtcgcactgttgttcacgacattgtcgttcgtaagccgcttttctctgcaagtattgctcagtactttcggatgtgaaataccagcgtccttgtaaacaagtggttaggtcgagaatgggattttctgtatcgatccactcaatgtatgcgcaaactgtagtgcgggtctgacgaatagagtagtattacgaagaataaaacaattgcccatacagaatgaataagcatatgcagataatagaatatctcacggtcatagttagggcacctaaaaaagcgccttgctcgaatatcaggattcctcgaagccattagttggcatcggtcactacataggcagagaggacgctggcaccaaggtggtagtaggtatacacaaggatcgctatgcagttcggatcctcaacgcctaggcgtctagccattgacgaaagctggtaggatttgtaatggagcaagtggggaagagagtactgaatgtggctgagttatgaaagattgtgaggcctcactcgttaaggcgacttatataggcacaaaaaattgcagtgatatccctaacatgtcaacgtcgtggggcacggtgggtacgcctgattggcgccgaaagttacattggtcgtatgcgggcaatggcaggcaattagtggtatcgcacgtgaataaaggaggctgcatcggtgcggcagaaagtagtcgtgcatgcgccgaaaggtatcgtgcattcgtaaaaagtaacagcaaagttcagggatgagaacccgaataacaacaacgtattcattacacaagcatacagtactagcatgtgaagtaaataaacaaagagaagtctgttctactggccctgccccgcgccgcgaccacgcttggtccttcgggcctgtgcttgcacgtggtcctaggagtacgtaaaacgatccagtggcacagcacgggtagcacgagtgtttggcgacggagtggacagcgactggtcctgcgtctgcacaggcggtgcgcctcccagctgtgaggggccgatgacgtcctttgtcgagcctgaagcgaagtcgaaatcggtgatgtcgaagagcaaggtggaagccaccccgtagtccgacgaggtcccagcatggtccagtggtggaccctgactcgacgtgccggctgcctgtgatgaagtcccgatgtactgccagaactgcgctgagtgcgaggtcgacgcagctgcctgagacgctgaccctgcagcctgggagaagtgggcagcctacgtcgtagcgaactggacgaaacctagacatcgacaatgtaacccttgtaagctaagacataaaatgcatgtaaattgattgtcgaagtactgttgttttttgaagtacctgtggggggcacaacagatggcctagccgaggaaggcggggtgctgaacggtgcacgaaaccctgaagcaatcggatcaatcggctcacatagatgtgcgaggcatgtaaaaaaaatccttaaaaatacttacctctgtgcggagggggagtcggccttggaacgtgcgtagctggacgggaacaagtcggtaggggtggccgctgtggtgctgcgtctgcccgagcaacgtcgtctacatgacaggtgagcactcggagaatcgagcgcatcgactccaccatccgtgtgtacgtcgtaaggtgctcctctacgggtaccggaatccctgcaactaaacgttggatcgtcgttgaaccgtcaacgacgaccctattgatgttgacgacctgcatggttaatttattcgtaaatattcgtaacatttgacgaagagaaaggaataaaagataaaggaatggtgcgatgcagggtactcacagcacgagcgaagtcctggtcgcggtgcctggcgtagaggtctctagtgctcgcaacgtgggcctgttgctcaaagggagcgaaggtgactctagtacgggtgcgtggctggtaccagcgtaggtaggcctcgtacgcctcctctgtgtgtggctctccctcgtgctccacgacctcctcggttgcgagcaaccagtccttaacaaaagcaaccggcgagcatgcgtgcccaagccgccgccggtggtgacatcaccgctgacgtcatcgtcgccgtttcccatagaccggcggtagatcaagtcgacctcggccgttcgttttggatcgagtagatctcggccgtccgttccgtagaccgccgctgtgcacccggtccaccgtgaacccgagcccgctgacgcaataatcctcttttccttttcaaaaataattcattattgcgtcataattcaattaaaatctatataaatgatttcatccgatttaatctttgaaaattcataactaattcatcttagcttggatttagttggttcaagtctctaaatttttctaaaattgagatctacatgttaaaaatatacatatgtactgttcatgcttgtttatgtgctgttttggtgtttttgctcttttttccttagattctgacgttcccggagagtccgatttcgcaggagaagattttgaagagttccaaggccagcaaggcaagtcgcacagatcccaaaacaaccctttgagcatgttgatcccgtttaaagctattgtttctattcaactattgcatttatttttgaatgtcattgggtggaaataacctatggccttgttatagcccttttgctattaattcccaattctttgtcacttggttaataatttgattagctagaacattatatggttttagttaaagtgaataggatgcttagccatgcttagaggccctagctcatataaatgggataacttatgattcactattatttaatgatggcttaatgatagctcatgatggtcaatcgtgattggttaattaattaaattgccaactaaaacctgataatggtgggttgtgagcacatggttttgatggtcgtgctcatgacaattaaggaccggttcacgattttcagttgtgaaacattaaccgtgccaaccacaagccagcgtgggcaacgactttactttccgtatagtatggttcattgtagagcaccagactatgaagtggcggagataagcccacgggggtcgctggggagtccatgcgttgtttacaagggggtgattatgatccgggaacggtgcattgctttgaattatgttatgcagagggtattgtcacaatctctattcgggtacttgttaactatcgcgacgcatggttgacatgatgttgaggttgtgtcttgtgtgtacagtggtacacctctggccagagtttaaactattcgaatagccgtgccagcggttatgggcgggtctaacaatatctttcgtgattagtttcacagttctcaccatattaaatgatgctgttaataacttgtttagctcctggtttggagtggtatattcctggtttggagataaaactgtgcagccgggattggttgttcagaatggttgggcgtatgcaacagggtatgttgtatagcgttggattaatattttttaattaatactttactgttttatgaaattctgaaatgtttattaaatgctatttatgcaaatgagactatattatgccttcctttgttatcccgtgcacttgcatatttgctgcatggcttgctgagtatgtcatatactcaccttgcaatcattcatcagaggagttctacagtgatgctgatggtgtggaggattaggcgtagccctggtcaagctgcctgtggagtggagtcgtctgcgtcgtttatcttattttccgctgcttagaactttattgattgagaggaactatctacctctgtaatgacattttattcgcttattaattagagtaataattgtactctattattaatttgttattgtgtgcctcggctaattcctggacgagggtttacacacatgtaagcgtttggaattttggatagaaattccgggcgtgacaaataccccggactgattgatcaaagcatgatgcatagcgtaatcaacccgatcttgaaagttattgaaaaaatcttatgctagttcactattctgattaagatttcctccttgtggctcctgtgcaccatcaccttggacgccatgaactccttcagaattgtcgccttgatcgcttggggagccgtcggtagcacctttagtactcggctgagccgagttgcctagagcttgtttcacttctccatctttagaagaaccagtcccaggactatcagcaaccacgtttattttatacttctgaacaagtgtccccttgcgggtctgcatgaatgagttcaggaactgatcccgtgcctgctgcagcgttgcttcaaactcctccttctgcgcaggcgtgaatttctctggatcgatcggcatgacgttgtcatcaatgatgtcagtcaatcccagcttcaacgccttgcctttaacggaacctaggcttgatggtggtggtggctgtttctcggccatgagtaagaactgacgtctgacttcttacaggtcccaccgggcgtgccaaaagcgtgttgacagaaaacacgtggcctgggagatctgcttaactccagtgcaggtccaaagctcgccttcggctatattagcgtgccagttgatttgatcctgtaatcaacaagaaatacaagcaaagaaaccgtggttcaatctataaatgatagccgatcggctagatgccgatgacatatcatttatctttgagccgatgtcatctgtgaatcgatcggcagtcatgaataagtaaagtagaactagatctattcgatcggctgtagatattaacaatatatactccttatattgatatatacttaaatcaagtgattgggatagatcggtcaccatgccgagacaatataaatcacttagatcgaaatatatatcaagaccaggcttatatatgtttacagcatagcaatcagatagatttagcatgtattggctaccactccaatactactctatatcaggatatcaaagcaagaatatatatccaaccaaaggcctaacatacttagatgcacaatatcttgatataaagggcagatttaacatgtcaatgaagtatatagaccaaatatagttaaatcagataagatcggctgaaactttgatgctattctaatcaacaactagaaggcaggctagagatcgatattctaagaacgacttaatagatcaaactcaactgatatagcattaagtatgaaaagaagaccaatatctaaccaatcaagccgctagaagtttcatagagtggtagatatcttatataatctagatcaacgtcaaaatctaacctaatcggctgccttctgctaacagatgttagccgatagtaggttagatggcggtattgctagagattatataagatatataataactccggggaaaaacccggggaaaaaatttntaaacgaattacataaacaagattagagtatcataaagatggaagaactaatcctaggaacacaatccgtcataacaagttttacctcttgttgaagatcgaaaccgatgcagctcaacccgaaagcaagaactcgtcgaaacaaaactaaagcaaaaagggtgatgaactactgtaccatgtngtagacgattngngagcgcc

SEQ ID NO: 3624 - DNA, 15481 bp, Oryza sativa
  unsure (1)..(15481): unsure at all n locations
gtggcccgtgagtgccctccctacgcagnacntcatcagctgtcatgcatcagcaatatgagccgatcatgcgttaacccaaacacttgggtaatatttcttcgaatatttgccattgagcgctcgcccataaacttcgccatcaagcccttgcaacatatatgctcccttagacacaactttatcaatttggaacggtccttcccagttcggcgaccacttgccgaatttactatcacgagtaccaatcggcaaaatcagcttccacacaagttctccttccgaaaaatctttgggtaccactttcttattataatgtcgagcaacacgttccttatccttggtaaccttcgcaagggcttgcaatcgtgactgaaccagatcctccctctcatcggccataaggttgtaatactcatcggttgttaaatcattttgtaattccgttcgtctagagccgattctaacctcccatggcaaaacagcctcatgcccataaacaagtttgtaaggaggaacttaaattgatccatgacaagccatcctataagaccataacgcttcggccaaccgagtatgccattgctgaggataatcagaaatctttcgcttaatcaatttgatcaaacttttattagacgcctcggcttgcccattagcttgtgcataataaggtgaagaattcaacaatttgatacccacactatcggcaaactgaacaaactcatcagacacgaagatggaaccctgatccgtaataatagtttgaggaagaccaaatcggtagattatatgctcctgaacaaattgaatggcatccccagaatcaactttcttcaatggaatcgcctctacccacttggtaaaataatcagttgccaccaatataaatttatgtcctttactcgatggtgggtttatcataccaatgatgtcagttccccaacccctgaacggccatggtttaataataggattcatagccgacgacggtgctcgctgaattgctacaaacctctgacaatcttgaacaccccttataataaccgaaacaatccctccagcattgtcggccaaaagtaccctacacgccgaagcaaccacttcatcttgtgagccgattgatgagtaccacagatcccttcatgaacttcgccgattgcaaccttagcctgatcggcacccaagcacttaagtaatactccatcaatcgtccgataataaagctcgtcatccaacagtgtatactttaatgccttatatcttaatttcctagaagccgattgagatggactactcaaatactgatgcacatcgtacctccaatcatcgactgacatcgctgcaatttcaactttaacatctttgatcattggcttataccccgacgccccttgagctaaatcattagcttcaatattttgttctcgagatacatgctttaaagtaaccagccgaaactctttcattagttcctggcacttctcattataaaccatcaatgtatcgttcttgcattcatattctcccgccaattgactgattactagcaaagaatcccccatgatttcaatggtatcggcttcaacttccttgagtaattgcaaccccttgagcactgcttcatactcagcctgattattggtcgcatatggttcaatagtataagcaaactcgaaacatgcccccctaggggaaattataactaagccgatgccacaaccatgagtacataccgacccatcaaagaataaagtccacggcactatctcaactgagccgattgaatcatcacgatgctctacaataaaatcggctatagcttgtcccttaatctctttcggcgattcataccgaagatcaaactcggtcaaggagaatatccactttccaactcttccctttaatattggagccgatagcatatacctgactacgtcggctttgcatataacagtgcactcgttagataatagataatgcctcaacctcatacacgaaaaatatagacacaagcataactttttcataggagaataccgagtctcagcatccaagagccggtgactgagataaaatacaactcgttccttcccttccaactcttgaatcaaaaccgaggcgattgacttcttgccagccgataaatataacctaaacggtattcctttctgtggaggaatcaaaacaggaggagagctgagatactccttaatatcatccaaagctttttgctgctctgccccccaagtaaattgctgatcggcttttaaccttaataaaggtgtaaaaggttccaaccttccggacaaattagaaataaaccttctaacaaaatttatcttgccgatcatctcttgtagctctgtcttattttccgggggctgaatcttcttgatcgcattaacgctcctttgggttacctcaatccccctttcatgaacaagaaatcccaaaaactggccggccgacacaccaaaagcacattttgtcggattcatcttcaagccatattttctggttctctcgaaaactttccttaaatcggctatgtggtcctccacttctttagatttgacaaccacatcgtcaatataaacttcaaccaaccagccgattaaatcatgatatatataattcatggccctttgatatgttgctccagcactcttcaagccgaaagtcatgacgacccattcaaataagccggttgcaccagggcatctaaaagctgtcttatggatatcctccttagccataaagatctgattatatcctgcgttcccatccataaaactcaaaattttcttccctgatgcagcatcaaccagctgatcggctactggcattggatattcgtcctttggtgtagctttattcagatatcgaaaatcaatgcacaccctgaccttgccattctttttaataactggaactatgctagaaacccattcggcatatcggcagggacgaataaaaccagcatcatacaatcgtttgatctcagctttaacaggttcgagcatatcggctttacatctccttggaggttgctggcgtggtctaactcctggcttgataggtagccgatgttcaacaatcgatcggctgagtccgggcatctcataatactcccaagcaaagcaatctctaaactctttcaggagctctatcagcttggttctaaattctggagacaaatttttgctaataaatgtcggccttggccgatcgcctggacgtatgtctatttcttccaactcatcggccgacatgaaaccttgaccttgcttgtcatcgagatcatctactgtatccttggcgtagacatttgaaccctccacgacgccctcaaagtaatagcttgggttctccatcttcgattggctgtatatcagaatcggacacttttagaaaatctccatcccaaacttttctagataaacaatcaaggccatccatctcccaaaaggctaaatcggcactggcaacattaactgacctgtcggctggcacgatctctatcttgtcgccttgccattgaatcaagcattgatgcatagttgaagggatgcaacaattggcgtgaatccaatcccttccaagcaacaagctgtactgtcacaccccgaagttctttcccaagcctaaattgaagttataaatggtctcaagaaaatacctgtgtaaagcaagagtaaaccttaataaattaatgcaaataataatcggaattggcatatggaatttttcttgagttctacatgccgaaatacgctaacaagatttttagtggaattttcagagctctagaaataatttttaacgaattaaaattgagcacatgcaattttaatcccaggaaaaatcttttttccttctttttcctttttctttcttttcttttctcttttttctttgaatgggccgccggcccattcctctttttcttcccctcctcccgctgggtcggccgaatgtcgaggcccagctaagccgcgcgagccggccacccaccttctttctccccgggacgccgacaggtgggccccacctgtcggggtcgtccccttcctctggccacccgcccccacgtcgacgcgcccgcaaccgccgccgtgcctcgcgcccgcgcttcctgggccacgtcgttcacgtcggcctcgctctcgtgcctcccgcgcccactttcccctctctcccgctcgcgcccgcgcccgagacggccgggattctattttcgaatcccgcctctctcttctcttccactcccccacgtaggccggcgattccccgctctcccggtcacgttcggacccctctctatctatttaagctccgccgacacccccctctttctttttccccatttcgacgaactctcccgaggtctccatcgctcccgcgccgtgcacccatccgcggccgccgctcccgctactccggccgccgctagccgccgctagactcgccgccgcgccgcgtcgtcaccgtcgtcgggttctcaaggtcaagggccaccccgtccgcacctcctccatcgaggtccgtcgccggagctcgcatcccctcgcactccggtgagcaccacctctaccgccgccttcggccatggtttccgctcgccgtggtccacccctctccctctaatctctctcttttcctctcttagggcatcccggagctcgtccgcccgccgccgttgtcctcccatggctcaccgtcgccgttcgccgtcgtcctcctcctcgccggccactctagatgaggcatccctcctcctctattcccctccctctccttcctagccgcgccgggtcgagccgccgccccggtcgtgcgccgccgcctttgcgccgttggttgccgtcgccggcaacacacgcgtgcgcaccgccgcccttgccatggccggccggccggctttgtgctgagctgagccgagccaggccgccgccgcaccgtccgattggctctgggccgatctgggccgtcggtcccgtggatcggtggtggaccacccgcgtggtcccggtgcacggtagaccggccacccgtgcgccgctgacatgcaggccccgcctgtcggcgccgccccccccccccccccgtttgatgacgtcagccctaggatttattgcgcaataaatgatttaaggactttttgttatagtaataaacacaatgaatcttctaaaattcataactaattcatccgagctccgtttaagcccattcaagtctcagtaaatcaagaaaaatgtgtagaatccattaaaaatggttttgttctctgtttcagtagtcttatagcctgtttgtattgtttgctttgtatgtctcttagattctggttcttccgacgctccggtgtacttcgaaatagtcgccgaggttcctccagcagcagagcaaggcaagtcatgcttgtcacttgaacatgttgatcctatattgcaaatgctctattgtttttcttcaaatactggattgttttataatgttactatgggatgtttacctactatcatagccgtactattttgtaccatgttcctttgttagcttgggatataacatgactagagattggactagagattgcttagccatgcttagttcaactagcacacaataagggagatcctattaattgtttagactgtaggttctaatggtattgttggattagtgacaccgcttcggtgttggttaattaaaataaatcacatggtgggctgtgggtgcatggttttgctggtcgcacccatggcagttaaggaccggttcacgggatgccctggaagaacttatcgtacttaccacaagccagcgtgggcaacggctgggcttgtagtgtagctttcctctagctgacgcatccaggcaagggtaggcgtaatggagcggggcgggcccagcgacggtctctatcgcttccggattcacctaggcacgagaggggaatgcccgctaccttgcgaggagtgggggtgaaacctgaggtgtggtgtgcttggttggagggggttatgcgaagggtcctgtcacggcctctttccggtatgtcgtgatggcatgtcggcgcacggtaacatatagtggggctgtgtcttgtgggtacagttgtacacctctgatcagagtaaaactattcgaatagccgtgcccgcggttatgggtggtcaaccagattcaccgtgattagtttcaccctagtttagtctaatgaaattggatagtttaggtggatggttgggcctgttgcaacgtggagtagcgttggacagtggatgattaatattgattagttaatacaactgtttacttctttcaacttctgtttataaatgctcgctttatgcaaatgaaccactctagctctcctttgataattccctgcatcatacccctattccggtatgacttgctgagtacagtgggtagtactcagtcttgctctattttccccaaccccaaagtatgagtatgtgtccgatggtggtttctccgaggagtaggcttcgtccgtgccgtcgaggatgcctgtggagtggtgttcccgctgcagttcaagtcaaggcttagctcctgttatctctcatttttccgctgcatttatgtaagacttttatgatgtttgtaagacgtggatctgaatgtcagcattgtcgtttgtgtaccccggccggtcctggacggggatcttaatgcacattctgcttggaattctattcgggaatttctgggcgtgacatgtacgaacccttcctatcgatgacaaaaaacgtggtaggaatagtcttgctgccgactgtcaactccacatttagaacacctatggtttccgatggattaccaccaaagtctttgagcaccatatttgtcttgatgagatcctcggcgttcctaccaagcttcctgaatgtagcataaggcatcaaattcaccgcggccccaccatcgaccatcatcttagacatcggcttcccattgacgtagccgtttatatacaatggtttaagatgccgattctctgtcccctcgggtttatcgaatactgcctgctctggtgacggaaccaacttagccgattcctcttccacttcatcgacatcggcctgatcgatcccgaattcagctggcaatgtaaagaccatgttaattggtgccgctacaacactctttccttttgccaacctcttcgcctcatcggctgcagcatcatcggctacgggaacttgattcttaacacgccactcctgtcttggctttggtttcctcagacgatggttgatttcctcttcaacctcctgaaaacgctccctgttcctcaatctctggacccttcttttctgattcttcgtgaaaataccagaaggacaccattgattctttctaattacctcatcctcttggccacgatcttgattcatcggacccaatctttgatgaacgggaagtcttgcctgtcttagccgattacctctactatatgaccggctcgagctctcgacgacatcactgcacctagggcagttttcgatggatggcaacctcatcccttcattccagcataatctaaagaactcacaaccccaatgaggatcaaaaccatcgtcgtattcttcataatgcatctcctgctgcttatcatacttcctttgatacttgttgataattttagccgaatttacttgaaaaccctttgcacggaccctatcggctgcttgaccagctgtatgcaacatattaacaggaaaaggattaccatcgactttcatcggttttttggaatcatcaaacctaatcttgcccccctcaatggcaacctgaatttgctgtctaaaaaccttgcaatcgttagtagaatgagatccagaattatgccatttgcaatatctctttttgcctaattcctcagccgatgggattgtatgaccagcaggaagctgaatttgcttttctcggagtagtaaatcaaaaatcttgtcagctttggtaataccaaagtcatacttttcctcttttccaggacttttcacccattggcatggtatgacctttttgctcctcacccattcggctgcagctattcagaatcatcctcctcgtcatccgacccatacatgtatgggcaaacatgattaactttcttggagcttttcctgacttctgccaacctatgctcatgcaaggttaccttctatatcagatgcgataagctatcaaagtcttcggatgagaatttctccctgattggaggaatcataccctagaaggccaaatcggctaactgagcatcagttaaacttaagctaaagcatttgttcctcatctccctgaacctctgaatatactcgtgcacgggttcatcatgccgctgcttaatcgctgtcaagtcagacaacttcatctcatgaactccactgtagaaatagctgtgaaattgcttctccaaatcggcccaactattgatcgacccatatggcaaagaagaaaaccaagtaaaagctgatccggacagagataaccggaataacctaactttcaaagcgtctacagccgatgcttcaccacactgagcaaggaatcggctgatgtgctcataagtcgacatgccctcttgtcccgaaaacttggagaaatctggaactttaaaccgattggggagagggactctttcaaaccactcaggataaggctgccgatacaagcttccagtctcttttagtttaagcccaaattgttctctcattacattggcaatcacatcggcccacggtcgttgctgagctgctccttgtggctgttgttgcatggaccattctgagatgcgaactggggctgagccaatccccctggctgatattgggcttgtggggaaggaggctgatattgatagctcaagttacccccttggtaattatgaagattcggctggatgttgcgcaccaagtgctcaggaaccatctgaggcatcactattaggggtggaaacgagccgagccgagccaggctcggctcggctcgtggaagctcgcgaaatgccaggctcggcttggctcggctcggttctccaaccgagctgtacattaggctcggctcggctcgtggtctggctcgagccggctcgagctggctcgtgagctttgcaatagcagcagttgtattgccagcagcagttgtgttgctttgcaatgacttggttattcagataataactctcaagtccctacaaagataattaggtatattgtatgcagccaacatataacaaattgatgggcttttttggttttcggccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagcccgagctatttgtccagccctaatcactatgctgtctggctgtgcatgatgcaccaaatgctctaggatgacctaatttacaaactgctgtacaggctgaccagcaggtactgcgaacccggccaatgcatttactgaccccgggtgctgaatcagctgaacgatctgctgtctcaacggagcctgttggatcagctggtgaggctgctgccttggtggcgtctgctgaatcggttgcagaggctgctgccttggtggtgtttgctgagctggttgtacaaccggctggattggtggtgtctgctgaatcggctgctgctgcactcgatcaacaataggtggaggtggcagaaacatggcagcaacttgatcttgggttagccgattcatagcctgcccgccgtgctgtggctgttccctcgttaacaaccgagggttcaccggctgtcctggcgtcatagctagtgtggcaggcaaaggagtcgacgctggcgtcgtcggctgagttgtgggtgcaacagaggaaactgcttgaacagatggctgaacatcagtgatcaaagatcgataatttgggaagacaccttgcaagtaaactgggcctgcagcctgatgctcagctatcgaaccatcggctatcgtcttcatcatgtttgacaaggtattgactaatactgtcacaccctaaaaatcctaaatatataaattgttgtttaattagaattattagaaataattgtaaaagactagaagagaagctctaattttaaataataaattccaatataaaagtgggccggataaaattttattaaatacttcacttgattatatagttcctagatttttctggaattatttgagccaaggaagtatttttcataaatggaattgcatttcatgaataatttaaattgaaaaaggttttaaaatccctcttttggctttgggccgaaagtcggcccaaaaccctttctctctctctccctcggcccagtcggaccgccgcccgcgcgtgctctcccgctcgctgacaggtggggcccacctgtcggactcgtcgtcctcctcgcgcccgaaccctagctgagccgcgccgccgccgcccttccaattccgtcgctcctttccttctccggcgaaatcaattgaggggaaatgatccccgggatcccctctatcttttctcttttggaatcgtcgcctaattcggtttggaaatcggtggattcgatttcaaatcggattcgttttctctctcccgaaccctaactttccttctcgccgccggccgccatgggccttcgtcgccgccccctaaccgctataaaaggacccacggtacctcctctactcgccgccaccctcgccttagctcatcgccgcttgtagcgccgtctccgcgttcacccgtgcgccaccgtcgccgtcgcgagttcagccgagcaccgccgtcgctccggtcattgtcgtcgctcgggaaggtcgccatcgggattgccaagccgtcgccgacctcgttcacccctccgtcatcgccaaggatcgccggaagaccgccgtcgtcgtcaacccgaccgtcgccgctgcttcttcctcgtcgccatcgtcgtccggtgtcacgcccagaaattcactagtaatttctgaactcatttgtgcataaaatcctcgtccagaaatcagccgaggtacacaaactgacaatttaatatacagattcatcaataactaaagcgaataaatacttacataagaggcacttagtcctcaccatgaagaaaactgcagcggaaaaataaaacctagcgagcttcagctccactcccacaggcagctcaactggggtataagccaaaggtcttctccttcagaatcctttttcttcaactgaggtttgatgattattgcaaggtgagcatatgacatactcagcaagccacatagcatatatgcaagtgcacaaggataccaaagaatagcataatatagggcttatttacaaaagcagcatttagcaaacttttgagaattgtaaaacagtagagcaattaatcattaatattaatcaacactgtacaacatacccatgctgcacaggcccaaccatcctgaacaaccatacccggctgtacaaatctatctctaaaccaggaatgtaccattccaaaccaggagctaatcaaattattaccagttatagcatcttttattatggtgagaagtgtgagactaatcacgaaagacattgttagacccgcccataaccgcgggcacggctattcgaatagttttactctggctagaggtgtaccactgtacccacaaggcacagccccacgacatgtcaccatgcacctcaataccaccacggtacctcggaaaggagctgtgacagtacccctcgcacaacacaatccaccacagcgcaccattcctggatcataatcaccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcataacccaccattatcaagttttagttggcaatttaattaattaaccaatcacgattgaccatcgtgagcttccattaaatatccataagtgatagtgaagcatgatttatcccattaatgagctaatgtttctaagcacagctaagcaactataaataacatctagctgaaccaatccaatatataaggtccatgctagtcaaattataacccataggaaaataaagtcatcttcggccataattaaatgggaaaggctcaccacccaatgacattcgaaaacaatgcataagttgaaataaatcaatagctttaaacaggttcaacatgctcaaagggttgtttgagggatctgtgtgacttgccttacaaacaagcgtcttcaattcgtcttcaggaacttctccaacgaacggacgatcctccgaaacaacgggaagtctaaacctaaaacgcaaaacaaggaaaaacactaataaaaaccaaatgaccagtacaattaaagttcatatgggtagagcttgaatttagatgaattatgagacttgaacgacctcattccgagttcgtaagaattagatatgaattttacaagattcaattccaattaaacctattaaagaaaagactattccaaattgattaaacaatttacaaatgatttataactgagacagaagattaaaacatcattcggaaaaagattagatcatatttggtagatgacatatattaaaaaggaataatatgtcattgaaaagagatgacaaatttatattaattttggatggccaagatggcgctgatatcagtgatgacatggctaccacgcaggatcgacgaccgcaagcacgggaacggcagttaccagcgaaccacggtacaatgatgcgaacggagggcaccgggagagagagaggagatcaaggcgacccttaccaccacttacgcgacgacagacggcgagggagatggcaggcgacaagctccaaaggcggcgaccttgggttgacgttggcgacggctttccggcgatgagaggcagcaaccgaggggcggacggtcttcacctcgctcctgcgatcccgagggtggcgacggtgaacgaaggcggcgatggacggcgacgaacggcgcgggctgaagatggaacagatcggcttcacggtgacgacgggcttcccggggtcttcgacgacggggaagtggaggccggtcttcttctcctcctcgcgaacccaacggcggcagcggcgaccgaaggcgacgaccacagcgacggcgcggggctgctggagcggcagccggaggtggagagagaaggcgagcgcggggagagcgattccggcgagattcggcgcaagggaacgggtggccggggtagctctcacccttgcgaagccgagggaggcgacggcgcaggtcggggtcgaccgaggaggcggcgcgacgcggctggagggtcactggcgtcggtggcggctagggcaaggcggcggcggcgctacaagcgacggctcggcttgggacttgaggcaaacggaagaggaggccgaggggatgctatttatagccggaagagggagagatcggctcgggaacggatggaatcggcgacggattaggtagggttcgccggaaaaaggaaggatttgatccgcgaaattggaaagaatttccatataaacttttggggatttcttgggggaaaggaagtggagattgagaggattccattcccacgactaatttggaaagaggagcaacggagagcacgaatttggtggggaggcggcgctgtacacgggcacggcagggaggagatcggccggctggaggttaggggcgacactgtagtagaggggggcaaaacagacttctttccgggcttcatttcctcggcccgattgaaggagggaggcaaatagaacttcggcagagagaggaagagaggatgcaggctcgggttgggccggcggaagagagaggaagggaatgggccggattcggcccgagacaaagaagaggattttgattgactttttaatttaaataattgctgaaatgatgtttcatttattaaaaatacttataatgctcaaataattccgggaaaaatccagaaaatatttggacactaaaaatatttaataaagttttatctatatcaatttaatgttcaaaattttcatatattttattcaaacacttactttaattattaaataaattctaaaaattccttttttacaacaatttataatttagcgattttcagggtgtgacaaatccacccccttatagaaatctcgtcccgagatttggaacggctagcaagaaattgggtatggcaatccttcactgaccactctgtcaaactgactagccaatctaacatacctttctctgactcttctttttccaatagaacataacacttaacttaatccttctgtagatattgataggtcaattttattaaaaaaaacattatcctctcgacccttagaatattgactgagaggtctcaaatcacaaagtcttgtgtgaatacgatagtgtttgttctatattcttctctgagcacccttgactctatcaagtccatagaaacctcacgcatcactggagttgaattagttcccatgatttcacttttctgagaaaaataacatttaacattcgaccgaatccaacctttcgtggtaaaacgatttcctcatgtcttatggaaacaagtctcttaaccattaagtatatctacgaagtatctgagcttcaaagtattttaaattaatagcggatcttgaagcatcttctccgtctgaccttcatcttttgcagtgtaaaacaattattgtttatatctcaaatattcttgaattatttcatgtaacggtgtctccttaacctttctgattctagtttccaatggagcttcttgattagcttgaccatcaactacctgaacagactatcaagactttacttccaacattgatgtaaaccactttgcaaccgtgttttatggtctctttctatgtatccttctccttattatcatctgcataattcagattaaaatagtcgtgatgtctacgctcaactttgtctcattggtgtatgtgtaacttgtagaatgacccatatgctatgttacagaacctttgtagagattcgtcaagtctcacaccagtggtgtgtcgccaagcaagccattcttgtcctcgtaccatattagtagagtataaaccttctttagtgctttcaagtaacttctggtgtagtgatganctacttgcggtcgncggnagtgcaaaatcaaccnntgncacaca

SEQ ID NO: 3625 - DNA, 725 bp, Oryza sativa
  unsure (1)..(725): unsure at all n locations
tatgggnnnnattgatagcacctactcgtaggnactgaagttcatcatacctcggttaccctctcctcgtcggcaaggagaagggcccaccgatcggccacgatctcaaggtggtccacagttccaacatccgtcgggtggccccctcgggaaagccccggagggcanttncattgacggcncttcttacgngngnggnctcggccnaaggggnnaaccgggcctttccggnaaaaatttcccaaaaaaaaccccaaatttttttttgggggaaaaaccgacgccgggacgagcgccgagctgcccgcatgggggaaggcgccttctcatttagagtgccacgctccccttcacgaggcgggccttcccctacagtgaccctggggggacaggttgtagggcctttgtggcgagtctcccgaatgtccggtggccccgaagtttcgccccaaccttacggagaagtatgatggtagcatcaatccctccgagtttcttcagatctacaccacgattattggggctgcagggggtgatgacccggtcatggcgaattactttcccatgaccctcaagggtcacgcgcgtggttggttgatgacccaagcccccgactccattcactcctgggaggatctgtgccacagttcattacgaacttccagggcacatatccccgtcccggggaagagacggacctacacgctgtacaacggaaggacgac

SEQ ID NO: 3626 - DNA, 709 bp, Oryza sativa
  unsure (1)..(709): unsure at all n locations
ngtgccccccaaggagcttagaaatgtccagtgcgtcactgaatgcatgcccgccctgagtcgatttatatcgaggctgggtgagagggcgctacccctattcaagctcctcaaaagctctgggccgtttatatggacggagaagctgagcaagctctcaatcagctgaaacgcccttttttttttaaaaacccccccctttttccccaaaactctttttacccccccctgggtctttggtagccccggggccgaaggaaccattgctactctacttggccgcgacccctcatgtggtgagtgccgccctaatagttgagcgtgaggaaggcgaacgggaggcccctccggctcgcaacggcccctcgtcccccgaaggcctagcgcccaaagctcccagcccccgggaggaccccgaggcccccgagggaggaggggaggctttggcaggtggccccgagccttatgatcctgaggcaatccgggatccccccgggacctccgaacaggcgcgccccggatcatctacccctgacaacacgaaccggccccgccgaaaggtgcagcggcccgtctactttgtcagcgaggcacttcgagatgcgaaaacccggtatccgcaggcccagaaaatgctttatgccgttttgatggcctcaaggaagttgtataanctactgcagcaaagcgaatcaccatcaaggggcca

SEQ ID NO: 3627 - DNA, 1137 bp, Oryza sativa
  unsure (1)..(1137): unsure at all n locations
ngacttatccctaggaacccaatcggtaataccaagttttccctcttttaaagatcgaacccaatcaagttcaacccgaaaccaaaacttcgtcgaaccaaaattaaacaaaaaagggtgccaatgcgccgaaattatattgaacgtgtgttgttaaaaattacatagggctcagggtctatttatacccgagaattacaatatatgcccataccggacacgactattatctctaccaaactctaagataccataagtctttgcggcagacttttgcccatatttatctataaggaatctacacaaaatatcctaattaatagatacaattgccttcccaggactttatccgtgcgtggcaatcatcttgaagtacatcaacttgaacccaatatcgcgtacaagtcgtattgtcggaatcggctgtatcggcttacttagcccgactcaaacccagccgatcctagccgtagccgatctggacctccagccgattcctgctctgtttccgaactcgatctccgcctccgacttcgctttgatccaatcctctttcctgacacagatgttaccaaatttggttgttaacacgagccaagtggacaagtcctttcaggcgaaagaggaaggaatgaagaggtatcttcgcattcgataggaaaagtgttacaccgggataacggtcgaacacctacctcgggatcagaacaaagaagctgacaccttgccgagatctgctgcttgtggtggactgcatgcgataggaatctttttcaaagtcctgtacgcaccaagtgtgcccgctgagagcctggatgtcatggcaatcgaccaagttgaactatgtcgacgtttgatgtcgcgattccggtatttgcatagtatagggatcggtggtactagggtatatgcgagattgaggtaaaagagatggagacagggagttttatacaggttcaggcccctgaattatcaggtaatagccctacatcctgttggccgaagcccgtattgctcttattcatcataatcacaccagtacaatatttggggtagcctatctaactgttgtcgacatggcggtctgaagttctgactcgtagtcgacaacagggtagtcttccttctcgaatccgg

SEQ ID NO: 3628 - DNA, 7417 bp, Oryza sativa
  unsure (1)..(7417): unsure at all n locations
atctctgcctgatggttggactgaatccaccaggattctttttcaaattcctgtacgcaccaagtgtgcccgctaagagcttggatgtcatgccattcgaccaagttgaactatgtcaacgtttgaatgtcacaatttccggtatttgcatagtatagggatcgttggtactaggggaaattataaaaaatatgggggggcccccgaaaaaaaaggtaaattttttgaaagggtaaaaaagaagatggaagacagggagttttatacaggttcaggcccctgaattatcaggtaatagccctacatcctgttggccgaagccggtattgctcttattcatcataatcacaccagtacaatatttggggtagcctatctaactgttgtcgacatggcggtctgaagttctgactcgtagtcgacaacagggtagtcttcctcctcgaatccgtgcccggcgagatcagagatagcgctttcgtctctgatgacagtatccggagacaccatagggtactagccgtgcttatcactgaagtcgatatccggcggcttgtcttggcatatgttggcttgtatgttgatcttgtgtcttgatctattgttccgtgtcccctctcctcctagggggccttgtatttatacccataggtgtccccttgtcaaagtagaagtaggaaaaccaatatggatacaatctgagtagtccttgtcgttttcatgtagaactctggttgtctttccttatccagaactccctcgaggtcagtttccgtataagacatggtatgtggtgggtcctgccgagatttagtcgaccactattaggtatgtggtatccataaccctgacaaactaggcaaagacccagaagattggcgaactccattcgtgaagtacctcagggatggttggctctcggaggacgaagcagaagcaaaacacttacagctccgagttgccaagtacaaactagtctccgggcaattatatcgcatcggcgtgctacaacctatgcttcgctgcatctctttcgctgaaggtgaggagatggtgaaagaaatacaccaagggatgtgcggtgctcatcaggctgcaagaacagtctcttctaaaatattttgccaaggcatatactggccaactgtgctgaaagtatgtgtggaacaaatcaagaagtgcgaaggctgccaatggcatggccgaagccagacagtgccacagtgtgagctacagctgatcgcaccagtctggttgttcgcaagatagggactggacatcatcggcccgtttccaatggctcggaatgggtacaagttcgttatcatggcgattgagttcttttctcgttggattgaagccgatccactcggcgcgattacttcggcggtagttcaaaagtttgtttgggctgtcaccacctctacacctacctcaacgtactgtgggatacgcagcaattactggataataattacctaaacaccacgtctaagcaattaatatctactttagtgtttataactcaccaaagcaatcactatattttagttgattatagtgaacaataatcccgtatgctatttacgaactaaccaagatataattctcacaagataaatccaaattactcaagaagaatattatattgaattcagagtaataaacagaataaaagaaataggagaagatcaccgacaactccagaattcttccgactcctactcttctctcttcctattctagtatacaatatagtacaatagagcctcttataattcagctcaagcttggaagtgtgtgtatgaagtgaggaagtgaagcctttatatagaggtaggtatgacggttggcgaaggggaaatgtccgaaatgccccgcaaccgccatcagggagtgatctagagcgtccacgccaaaccccacatccaacggtggaggtggtggttcggccgaaccagagggttcgatcgaacctgggctgggtccatctggcctggcctttggcccaagtcctctgtcacgaccggaaataacccaacgggcgtttcttacgtgcgtgcattattccttgtcccaggaggcaaggtacaccaaaagttgatacaattcagagtttaacaagcggaagcgcaattaattaatttattacatgggcggcgaaggcccagcacaccagaagacaaacgaaaaacagcggaagactagggcgacgaccacaggcgcttgacggcaggcacgagctagacaccaaagccttcatcttccaggggctcctcttctgggtttgggaaaaattgagcaagactgagtacaaccaccatactcaacaagacacacccacaagtgcagaataaatgcaagggagtacaagggggttataatataaagggttagggtttgcagtaaacagcattaaaagacacttagttgctcaaagctattttgtaaacacgattctagagctatacaatattattaaacaaggccgtgaacccacacgaacctgccttaacccaaggcttacgatgattcagaccgaactggcaacccgaccctgagtcccagctcgtcccaagccaacccaggccaaccattccatattttagttgttaagcaggttttaagaattaaaaaaacactaacttgggtacattgctcggcttgcccataaccgagggcgcggctattcgaatagattatactctgatcagaggtgtacatttttacccacaagacacatcttcctcacatgtaaccacgtgccacataccactacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatctgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaaccagcgaagcatctatctaaaatcatactagtggtaccatgagtagagtgcccactagttggggttttgtttaatctagggtgaacaaggtaataatatcaataacaataataataaggtcataacaaaggtaaataggtgtcgcgtcccaaaacgactctaaaatacatccccgaaattatgcctagaataattaaaatccgtgtggaagcctccaacaattaaaatgtgcaaagttaaaagtcaaataaggcttggaggatttttgtatatttcctaaaagcctaaaatgcgtaaataaattttagtggaatttttagagcacaaataataattaagaagaaataaacaaagttaaaaaggttttataaaaagaaaaaccctaaaaagtacttttccccctcctccccctcttgggccggctcggcccatctctctccctctctctcctctcccccgcggcccattcggccttctccccgcgcgcgtgccgctgacgggcgggcccgcccgccaccctcgctgacgggtggggcccacccgtcatcccctttcttccggcgctcccgccgccttgcccgtgccctagcgccgccgccgccgcgaatcccggcgtcttccgccgtccacgcgcgcaataaagtggggggaaatattccccgtgattccctccctctttccccccatttttccctccctctctccctcggattcgtttggaaacctctcccctaacctcgccggcgccatcaatggtgaccggatcttccacgcccgtttccccctcgtccggcagctccctccccctcccaatcctatataaaccttccccgtgcctccctccaccgtttccgccactcgccgccctttctccccgtcggaatcgagctcgcgccgtcgctctctctctccgccgtcaccgccgagctccggtccgccgccgtcgtcgccccggaccacctaccgcatcggagtcgccactttcggcttcaccgcatccccggagacctcgtccacccaaccgtttcgctcgccgaccgccggagcaccgtcgaccccgtccacccgagccgcgccgccgccttcatatgctccggtcgccgtttccgtcgtcgccgtcgacccggggtgagccgtggaccgccgcttcttttcccccttcccttcccctctctcggccgccgttccgccgtgcctatggccgccgccggtgaccataggggcgcgggcgcgccgcctcccgccgctgcgccggcgtggccgccttcgggcgcaccgtgcggctgccgcgtggggcccggctgtcagccgcccgcgtcctcgggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaattttttcttaagaagtcaagaacctatttttgtgctttgttcctgctggttatatggagtttattagagtaaaagccttttcttttccgttggtcgtgtagacgctgtagcttcggaagatccgctcttcgtggaggttgaagccgacgtttgggaaagcgagcaaggcaagtcacatcatccttgaacatattgaatcccagtttataaaattattttgatttaaattaatgcattatcgctttatttaaattcccgcgttatcactgttttatttagccatgcctattgtcacgaccggaaataacccaacgggcgttccttacgtgagtgcattattccttgtcccaggaggtaaggtacaccaaaagttgatacagttcagagttcaacaagcagaagcgtaaatagttaatttattacatgggcagtgaaggcccagcacacacaaagacaaacgagaaacagcggaagactagggcgacgaccacaggcgcttgacggcaggcacgagctagacaccaaaaccttcatcttccagagactcctcttctgggtttgggaaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctgttttgtaaacacgattctagaactatacaatattatttatcaaggccgtgaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatggattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggtaggtaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaatactccaacaattccaaagtgtccaggtgatatgaatatcccaaagtctagagttgtaaaaccgcctaatgttacctaattaaatagcgaagaatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccacgaagagcggatcttccgaagctgcagcgtctacacgaccaacggaaaagaaaaggcttttactctaataaactccatataacaagcaggaacaaagcataaaaataggttcttgacttcttaagaaaaaattagagacttgaacggtccaattccgagttcaaatggccaagttatggccatttgaagtttatatgctctttaaatgaatatttgcgaatttcttcatttaaattttgatttaaaaagagtttattgcgtcagccgagaaggaggggcgcgcggaccgggtccacgggagtggggcccacacggcgaccaccggcgcggcggagcggcggccgagagaggggagggaagggggaaaggaggcgacggtccacggctcaccccggggcgacggcggcgacggagggggcggtcggagcggagggaggcggcggcgcggctcgagtcgacggggtcgacggcgttccggcggtcggcgaccgaaacggagaggtggacgaggttggcgaggatgcggcgaagccgaaggaggcggcgccgaggtgggagttggtccggggcgacgacggcggcggaccggagctcggcggcgaccgcggagagagagagcgacgtcgcgggtgatgngctnctgaaccgtctgtcaatccattnngccag

SEQ ID NO: 3629 - DNA, 1490 bp, Oryza sativa
  unsure (1)..(1490): unsure at all n locations
ttagtaattaaattgccacttaaaccctgataatggtgggttgtgagcacatggttttgatggtcgtgctcatgacaattaaggaccggttcacgattttcagttgtgaaacattaaccgtgccaaccacaagccagcgtgggcaacgactttactttccgtatagtatggttcattgtagagcaccagactatgaagtggcggagataagcccacgggggtcgctggggagtccatgcgttgtttacaagggggtgattatgatccgggaacggtgcattgctttgaattatgttatgcagagggtattgtcacaatctctattcgggtacttgttaactatcgcgacgcatggttgacatgatgttgaggttgtgtcttgtgtgtacagtggtacacctctggccagagttaaactattcgaatagccgtgccagcggttatgggcgggtctaacaatatctttcgtgattagtttcacagttctcaccatattaaatgatgttgttagtaacctgttagctcctggtttggaatggtatattcctggtttggagatagaactgtgcagccgggattggttgttcagaatggttgggcctatgcaacagggtatgttgtatagcgttggattaatactgtttaattaatactctactgttttattaaattctgaaatatttattaaatgctatttatgcaaatgagactatactatgccatcctttgttatcctatgcacttgcatatttgctgcgtggcttgctgagaatgtcatatactcaccttacaatcattcattagaggagttctacagtgatgctgatggtgtggaagattaggcgtagccctggtcaagttgcctgtggagtggagtcgtctgcgctgcttaccttattttttccgctgcttagaactttattgtttgagaggaactatctacctctgtaatgacattttattcgcttattaattagagtaataattgtactctattatcaaattgttattgtgtgcctcggctgattcctggacgagggtttacacacatgtaagcgtttggaattttggatagaaattccgggcgtgacaaatatggagcacaaaaagttagccgatctcccgaagtctattgaagaacagaaagcaagactcaaatcggctatcaagcacgttgctgatctgaccaagtctctgaaagttatccctgtaaccgacgctcaagatgctcaagccatagaaaaagtaaaacagattaggcagaaggctatatcggccatccagcgatacttatctcaataatctttgtgtaataggacttagaaattttgtaattggctaagacattctgatactttactgtcttaacaatccttcgtgctgattaatatgactttgaaatttgctcaaaaaattttgcactacattttgatatatatgtgccccctagtttttgatgnnctnctacggtaaagcactcacggggccaa

SEQ ID NO: 3630 - DNA, 1523 bp, Oryza sativa
  unsure (1)..(1523): unsure at all n locations
cccgaacagacatgttgacaagattatccatatnaannnctcaaaaaaannnnnnngtgatggttaaaannnnnnnnttgtaancaacgcatggactccccagggaccncngtgggcttatctccgccacttcacagtctggtgctctacagtgaaccatactatacagaagggggggtttttaaaaaaaaaaaaaaaaggggccccccgggggtttttggcccacacgctgagcttgtgagttggcacggtaaatgtttcacaaccgaaaatcgtgaacccgtccttaattgtcatgagcacgaccatcaaaaccatgtgctcacaacccaccattatcaggttttagttggcaatttaattaattaaccaatcacgattgaccatcgtgagctatcattaagccatcattaaataatagtgaatcataaactatcccatttatatgagctagtgcctctaagcatggctaagcatcctattcactttaactaaaaccatataatgttctagctaatcaaattattaaccaagtgacaaagaatagggaatcaatagcaaaagggctataacaaggcaataggttatttccacccaatgacattcaaaaataaatgcaatagttgaatagaaacaatagctttaaacgggatcaacatgctcaaagggttgttttgggatctgtgcgacttgccttgctggccttggaactcttcaaaatcttctcctgcgaaatcggactctccgggaacgtcagaatctaaggaaaaaagagcaaaaacaccaaaacagcacataaacaagcatgaacagtacatatgtatatttttaacatgtagatctcaattttagaaaaatttagagacttgaaccaactaaatccaagctaagatgaattagttatgaattttcaaagattaaatcggatgaaatcatttatatagattttaattgaattatgacgcaataatgaattatttttgaaaaggaaaagaggattattgcgtcagcgggctcgggttcacggtggaccgggtgcacagcggcggtctacggaacggacggccgagatctactcgatccaaaacgaacggccgaggtcgacttgatctaccgccggtctatgggaaacggcgacgatgacgtcagcggtgatgtcaccaccggcggcggcttgggcacgcatgctcgccggttgcttttgttaaggactggttgctcgcaaccgaggaggtcgtggagcacgagggagagccacacacagaggaggcgtacgaagcctacctacgctggtaccaagccacgccaaccccggttaacccttttaaaggggaaaggggttttttccccaaaaaccctttgttcctttgacaacagccacgtgggagcactaaaacctttaccccaggcaccgcgaccaggacttcgctcggcttgtgagtaccctgcattgcaccatttctttaactttaatcctttctcttcggcaaatgtggggaattttacccacacattaccatgcg

SEQ ID NO: 3631 - DNA, 1020 bp, Oryza sativa
  unsure (1)..(1020): unsure at all n locations
cggcgcacccgtgattgacgattagttcagaaccncatcatgctttatgccgntttgatggccctaaggaagttgcgtcactacttccaagcgcatcaagtttccgtagtgacgtcgtaccctctcggccaaattttgcacaaccgagagggtactggacgggtggtaaaatgggccatcgagctggctgagttcgatctgcacttcgaaccgcggcacgcgatcaaaagtcaagtcctggctgacttcatcgcggaatggaccccagtggatgaacctgttccatccgatgtccctttcccccctagagaggaagaggatccaaacgccgacattcgcggcgggcactggattatgcatttcgatggctccctcaaccttcaggtgcaggtgccagagtcacactgacctcgccaagcggagacgtcctcaaatacgtcgttcgactcgacttccgagccacgaacaacatggctagaataatgaaaggggctttcccctttttttggggccccgggggggggggggaaaaaaatttttttagggcggnaccagaatgggcatccgccatctcctggtcctaggtgactcccagctggtcgtaaatcaagtatccaaagagtatcagtgcaccgacccgcaaatggaagcatatgtctacgaagtacggcgcatggaacgccacttcgacggacttgagctccagcacgtgccccgacgcggcaacacagttgctgacgagttgttgcgtgttgcgtcggcacgagccccactccccccagggactttcgaagaaaggctcgcgcaaccatcggcgcgaccgaaccctttgagggaccccaacaacacgccctccaaccctggtatggatgaccgacatccggggtatctcgacggcaatactcttcataaggatcgcgcagaagctgaaaaggtcgcgcgcatctccaaacggtacgtcctcatagaagggtgatgaacgncttgcagtcaacagagagacaaacaaaggtggcgcat

SEQ ID NO: 3632 - DNA, 1251 bp, Oryza sativa
  unsure (1)..(1251): unsure at all n locations
atgtatacaaccaagtnanaacagagtttaaccaaacantcaggcttcaggttccggaaccttgcagtgtaaacctatttttggctgatctacctttaaatattgtttccaactagtagttggtatcgccatatgtgaatctccaactattcagtttttttcagaaattttttttttttttttttgggggggcccccaaaaggggaattccttggcttttagggaagtacattgaagaggttcaagcggcctacgaacaccataagcatgataccctggtttgtactatttttttcccacagagatatgcatagtatccatcatctatgcaggatacattgacactattttttcatcgagcaggattctccaaaagcaagcaaattcactggtgtggagatgacagaggaacaagctgtagctgagcaacagaggatgtttgctgaggcccgagcaaggatgaacaatggtgccgccaaaccgaaggagccagaacctgaagcgcagcaacaaacacaacagccaccacagcctcagctgcaccctcaaccacagcaacccctgcagcctcaacttcagctccatcctcaaccacaacaacagccctcacagctacatcctcaacagctgctgcatcctcaatcgcagcaaactccgcagcctcaacctcaggtccacccttaaccacagcagccttcacagctgcaaccgcaacctcagctttttcagcaaccgcagctgccccaacagctgcagccgcaatctcagctccccccacaaccgcagcagcccccacagctgcagctgcaatctcagcttcacccacaaccgcagcagcccccacagctgcagccgcaacctcagcttcatcagcaaccgcagccgcaggcagagctgcaatcacagtcacaaccacaaacagaacatggcttggacagttcatgattcagattccatgttgtgtagcctcagtataaggaaaagttggtgtacttccgctggcatttaactagagactcttgtggtggccccccccccccttttttttgggggaaatttttaaaaggggggggttttttaggtttccatgcttcatgtacaatgtaaatccagtgtgatttcagttaccatgttgctaataatctnaaactttctttaatcactgaannnnnnttcattcagtttcagccttgntnttactctatgactgnnnnnnnnnnntcgnatttcnccnatcatatcaagggttat

SEQ ID NO: 3633 - DNA, 1210 bp, Oryza sativa
  unsure (1)..(1210): unsure at all n locations
tcaattttcagaaaatgtntaataaaaaaataccatcttagaacaacccgaaatacttgtatttaagaacccccatatttcgattgttcccacgtttcatcattnnnncaagtgttgtgaagctgtttcccttttggttaactttgtttcttgcttgttcttcgattgcttgtaggttcaagtttgttcttcgggaccccacaaaaccgcgggggggggggccccaaaaaaaaagggaaatacccaaaacaaacaaaccgtggaagtcttgtgtaccggttgctaaggcgcagcacccctgtggtagttgtagtcggaccgccaatgtcgtgtcctcccccaaatcaaagtttattgtagggtcccgaaactaatgattcggtaactgatgtatcaagccctggatcagtaaattgatacagattcaacaatctggatcttcattgcatacatttggacaagatttcaaaggaaatttctttacataaaataatagggtatttataaaattgtggctaactattacaacagaagctatagaatgacctaacaaaacctagcttctaaatcctcataagctagataacaatcaagtgcttctcaaaatcttaggccatgtttggggagctgttaacgaccaaatttggtaaattaagcatcggagatggagttaaaaccgaagcggaatcaaaaggattgacggtttcggaaacagagtgcgcatcggcagagttcgaatcggataaggtggccagaacagccgatgaagccgattccgacaagaaaaagatcaaagtcattatcagattgggttgatatgcttaatgagtattgccacacatggattgagtccgaagaaggcaattgtatctattaattaggatattttatgcaatttccttatattttgagttggtaagagttcacctaagggacttgttcgtatctagaattgtaatagagatagggagtcgtgttcttgacaaaggaacaattaaatttttttaaaatttgggggttttaaaacacccccttttttttttggtaaaaagcaaccaaacccatgaatcagatacaattagttcaacaacactttcggggcattgccacccttttacttttcgtttgtttcgacgagttcttgctttcgagtttggctgcattagtctagatcttcgacgggaggtaaaacttgccatgacgggttgcg

SEQ ID NO: 3634 - DNA, 2071 bp, Oryza sativa
tctgagaaaaataggtttaccattggcccgaatccaacctttcgtggtaaacgatttcctcatgtcttatggaaacaagtctcttaccattaagtatatctacaagtatctgagctcaaagtattttaattaaacggatcttaacatctttccgtctacctgaaaaattttttaccccttttttttttttttgggcccccaaggttggtaaaaacaaattattgtttaatatctcaaatattcttgaattatttcatgtaacggtgtctccttaacctttctgattctagtttccaatggagcttcttgattagcttgaccatcaactacctgaacagactatcaagactttacttccaacattgatgtaaaccactttgcaaccgtgttttatggtctctttctatgtatccttctccttattatcatctgcataattcagattaaaatagtcgtgatgtctacgctcaactttgtctcattggtgtatgtgtaacttgtagaatgacccatatgctatcttacagaaactttgtagagattcgtcaagtctcataccagtggtgtgtcgacaagcaaaccattcttgtcctcgtaccatattagtagagtataaaccttctttagtgctttcaagtaacctctggtgtaggggacttccactacgacattatatatccttgattaattatcacttcgtctttattctcattttcctgagttactataaacatccatttcacagtggtacacctctggctagagtaaaactattcgaatagccgtgcccgcggttatgggtgggtctaacaatgtctttcgtgattagtctcacacttctcaccataataaaagatgctataactggtaataatttgattagctcctggtttggaatggtacattcctggtttgaagatagatctgtacagccgggtatggttgttcaggatgattgggcctgtgcagcatgggtatgttgtacagtgttgattaatattgatgattaattgctctactgttttacaattctcaaaagtttgctaaatgctgcttttgcaaataagccctatattatgctattctttggtatccttgtgcacttgcatatttgctgtgtggcttgttgagtatgtcatatgctcagcttgcaataatcatcaaacctcagttgaagaaaaaggattctgaaggagaagacgtttggcttataccccagttgagctgcctgtgggagtggagctgaagctcgctaggttttatttttccactgcagttttcttcatggtgaggactaagtgcctcttatgtaagtatttattcgctttagttattgatgaatctgtatattaaattgtcagtttgtgtacctcggctgattcctggacgaggattttatgcacaaatgagttcggaaattactagtgaatttctgggcgtgacatccggtcgccgtccgctgccgttcgtgcctcggtaaggatcgccgcgtcgcccgcaacccgttggtgccctccgtttgcgccgccgcgccgtcgtttgccggcgagcgtgcgttgccgagctgcagccgagccgcagccggtgataacgtcattgctgacgttagcgctgacgctagccgtagacccgcgatggattagattgatctcggccgtccgttttggatagggttaatctagaccgttcgttttcgtagaccgccgccgtgcacccggtccaccgtgaacccgagccgctgacgcaataatcctcttttccttttcaaaaataattcattattgcgtcataattcaattaaaatctatataaaggatttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgattttgctcttttctcctgagattccgacgttctcggagcgtccgaatttgcaggagaagatttcgaagagttccaaggccagcaaggcaagtcacacagatct

SEQ ID NO: 3635 - DNA, 683 bp, Oryza sativa
  unsure (1)..(683): unsure at all n locations
gctgtnnccaaggtagaactacttgttgcccacgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttattgccaacataatttattcttatttggatcccctcatctttaaattcagatgtagccttgatgttccctccccatgaagagaagagcgcacatgaaacttaagtacaaaagtcccgacccccaacccataccaattaattcgccaattcttcgggaaattgatccattcaccacttcttcattgatttacaagaaactattggtttaatttaac

SEQ ID NO: 3636 - DNA, 24995 bp, Oryza sativa
  unsure (1)..(24995): unsure at all n locations
cctcactcactcaccaccatcaatcataatcaaccgactgatcgtcacaatcatcgattctcgaatgaccttggtcttatgaacgtcgttngatgaannnnncccccccnccccccagcgccnccggtgatttgcattcgccgnagcncancactcaagcttgcatgctggttctggtaataattatgtactcccctctagcgtggatatggtccgatacagcgattatggttctatcagtgatcctgttatgctctctttggaaatatatactattcaaaaatgttagattgagctaacgggtgatcttttctgggcttgcaggagtttggattccatctttctgtgctggaggttgacaggctttggtgacaacatggtgctgtgtaggtgatatgctaagcagctagtgatcatcagtacaatgggcggtgttcaaatggcattagattggagtctgtttccttttcttctgtaattagaccaacaatatcagtcatgtggtagtagtagtagtggccgaacaaaacagtagcaacgccatgaagtatgaactacccccgtccgtccgtgctaggctggtagttttatggttgttatccactctgttcatgtgtgtttagttcaaagaaaatctgttccgagtcgggatgatcagcaaatgattttgttcttctatgcactgagaatccagatgcatttatcctaattgcttgtctaattctcccttgtgctgcatactatgtttgtgaagttatttgaggttaacgatgtggttactaacatgcttagggcttgttcttttaatcccaaaatggattgaaggagattgggggagaacataggtgtggaattttatcctccaattccctcaatccccttggtctggggattaaacgaacgaggccaagtgtttgggcaaccacacgaggatattattatcttatcaagtgtcgtatcatctggtatgaacaatattgatcaccagggttagcattgcaattcgtacaggaaaccggatctaggttgcattggcatcacaaatcatgcacacaagaccatttgcacgtactcacactttccaaagtataacaagaatagcgattttatgggatgattaattgttattgttaagcatacaaaactgctttcctttttccgtattccttcatacattaagaacacccaaacatctcggggcccacgtcctccagaatggatttcgccgtaatttatgtcaatttgatcatcaatctaccactacaacttaaaaagtgtaccgacaaataactctcttcatcagatctaaacaggtaacaataattccagtgaaaatgggatgtacagataaattcctcagttggagccagaaatgtcgttcagaactaactgcatctcaagaactacagcgcgccgcctccctctcactctgatgagcctcggtatgtatcgatcttgccaactccaggagtaacaactgcaagtatgacaagagcccccaatagcaccagcaacatccccaacgagttcataaacatagcttctgtcgagaaacgcccgatcatttttgcgctctgcatgaagatcgacttctccagaagtcccgaaacgcttgtggcgatggcgagaacgtaaaggaagaggccgaagaagacatgccaggggagcagggaggctcttccactcctagatccaccagggtaccaaaatgtataaaatccagtagcccactgtagagatatcaacgataaagatgagaatatgttggaagcaaacctctttacatatttttatgtttactgaaaagagcatagttcaatatctacctgcaagctgaagaagatgatgcaagaaaggcccaaccaggagtgaagcgtatataagtggtcgatctgtctctcatcgtggaacttccatacagtccagagcccaatcagactcaggagcatggcgaggaactgcaaggcaaggtgtactagcttcttcagtttcttggttcctggcactgtcttgtaggccaaaattgctgcatgcagaaccataagcgatccattaaaaccttattgccatttattataacacactataaaaactatgccttttatgtccagtaaattacatgaggcaccttgatgcatagacactcatttctagactgtttgatacgcatgtatgatcaatatcaaaattcagagtttttcccttcatatacataactcagttcaaactgatttctgttagtttgcactaattgagtttagtttataagtgaccatatatcatgaagctaattcaaactagttaagatgaattcccttttttcccagagtttgatgaatgaacttttttttgtacgacctacatagaagggtattgatttgggtgcatatgtaatataatgcaaataaattataatcacattagtcctcagaacaagggcctggagtggtttctgctaagtcgataaattttctagctacagacaagaactaccaatttgaatgtttcaatcggaaaagagtaatttggtaaccaattcaataggaaatagctagaaagtgacagaaaaagtaaattcagcaactcttttttggttttatatctccaactaagcttttgaagaaaaatatggaactaggtgttgatttgggtaaatcaaatactattcagccaggaccaagtatcattaggtgtaaatatcttacttcggggttgttcactttgatgccaaaataaaccttaccaaattttggcaatgtcaaaattttggcaatattgacaatattaccaaattttggcaggatttcttatgtatttactaaatttgacaacaaactaaatgtagccacttttttggtaactttgccaaaaaatgatatggttgaaaatggcgtcaaagtgaacagccccttcctggttccttggtacttgattttgacatgtatcgagtatcaaggaaactgtatataatctacctaggatgtctcaatgtcattattttttgttcatgctgtactgcatgaaaatacagaggcatgatattttgcatatctgaaaaatgctacagttagatgtatgcataaatcgaaaaaacagtaaactctgtatcctgtttaatgaagcaataaaaatatttatatgcaacaagccaacatgaaggccattccaagatccaattcgattggagttcaatagtggttaacacactaccttccccattcaggactaccaatccaatcagcatcaatactgggtgaacctgaaataacagaaggcagttttaatatcataacaagatgggatttatgtaatcaattcatcaattaacattactatctagcgaacgcaactcaaacccacattttttagccggcaaaacctacaaatcagttgtttacatgaaataaagcacattcgaagtttcaaaattcaaaccacttgaggacatggaaattattattttagattatatgttgattaaatgtataatatatgttgattaaatgtataagtaaaaatattacatagttggctgcttaattcatttcccagccttatttagcaaaatatggaacagaatattacacaaaaactttcaattgcccaagataggacaaaatcatgttcactagctggcagaaaactttactgtttattttctagggccactctgctcttttgtgcgtgaaccgcagtgcacgcacacgtgtgtaaatgctaaccaaagagagtgccatgtactagctactttcaccttcttttcgtaggtatccacataaattaatataaattcccttccctagtaattccacatgtgttattattctacaatcggtaaaaccattatgttcagtgatataaattcccttccctagtaatcatgcccacgtaggaatacaagtagagttacagtatgtatggagtaaaagctccctcaaagtcttcctagacagcaccacaaatggtgattctatttgtgaaagacaggcttactggtgtaaaaccagaaaaagataactcaaaaacaattctcagaacaaagcatgaattgcttcttgttgtctttctcatgtgctataatgctgaaagttgcttcttgtggtgctgcctattaaatgatttaggtggctatccaagtgcatatgcattttcctccctgaactaaaatgatctaactgcaggactcaagtactctgaaataattaattatcctcggtagtcgatgctttttttttgttcatcacttaaatgtcaacaattaagaagccaaaacttcaaaagatttccaggcttgttacaaacttactatccaaccaagccttcaaatcttctctcattttcattctgaaaagggttttctttcccttttcattaaaaatttagaataactttgagccattaacgacaaacttcaggaacatagtccaatggcaatgtacaacgatctcgaacaagggatgtggtgcagtttggtaatcctattaatgtagcccaaaattacaaacttgagcaaatggagtgagaaaaacgaaacaaacaaagcttagcactcactaaaacaaaagacgcctaagatatcacacccatgaagtcatcacacgaacccaaatcatctcaggtctaaaatatccctagaagagagcgctaaactccttcgaaatgcatcaggctcgattgtcagcttcccagaattcaaaattctccccttgtaattaacttcttgcaaaaaagctaaacccttcctccaatccaaattcactacacgcagcagccaaaaaaaaaaactctcctaaacctccgaaatacgcaacaaaagaaagccctcgcattgcatcttcgctgggtcaatacacaagaactcgatcgaaaccttgggaaaacaacagatcagattattcccgcacacagacagagacaccaccaagatcagcgcgcgatccgcgggccaggggggctagagatatatatacagaggcagggatctctcgagaatactccattattattacgttgaagatgaggagcttgtccgtctcggaggagagcgccatcccgccgcggaagtggacggcccagacgacgatggccgccgcggccgccaggcccagcagccgcacgatcccgaacaccgggaacctcgccgccggcgccgccgccatcgccaaaatggtgtgcggcgactcagcgagatcgagcgccggaggggaaggaggaggagggagacgaggagaagcaaagacgccaacaatttttttttcttcctttcgagctgaccaagtgtgaactagtgaatacgtattcctaagggagaagcgtctttcatgtgtacgctttctgcttagttgttgtggagtactaattttacgcaagcgcctgaacacctacgcctccatcaaaaaaaaaaaaaaaaagagttcactctacatatgaatctggataaatacttgtacatgttcgtagctaggcagtgtttgactaatgggataggaaaatgatttcccacccaccaaaagatatctttaaatcttaattattcattctctcttccatttaatcttaacccttcatttatttcctaattccaatcccaccccacatttctcattccaaacacacccctagagtttgcctttttatggaacatagtagtgtgttcttccccccatttttttaacccatttctctcgtttttctcgtgcacgcttttcaaactgctaaacggtgtgatttatgaaatactttctatatgaaagttgtttaaaaaaatcatattaatcaatttttcaaaaaaaatttgttaatacttaattaatcatgcaatgaaatgaacctcgttttgcgtgccagggaggaggggttacagcctaaaaagggctatgaatgtgatagttgttatgtcaaggactggcaagaaatataatgtaattcctctaactcaaaataaataaatctagtacaggatgttggtattaggatatgtcatatctcatattagatttgtttattttgaaatagaaggaatagaagagacacgtcttttttatattggattggctaggctcggcgtacgcatttttatattggattgaaacattaacattaattaacaagcatataaatgcccaaactacatgtttttttgacccgataaaataaaaaaaaacttgttgaacattatgcaatggtaaaagggaaatagaagcgactaacaaaactatgctgttaaaatgacagaaacacgagggtttatttggtaacattgaaatttatacgcttgtaaaaactttatacctgtttcttttttcaccccataaacccaaagcaaaacagagaatttaaagtccccctttatttattttacacacacgtatacctaactcctgttaaattaatgttgtaatttgggtaaattaactatgaagaacaatcctttgaacaatagctctcaacatcttgtactgaaatcattgggcgtgcataatctaaaacaacaaaactaactagctagtcaagccgtccaaccacctcattaagcacggtcatcaacctcaaaattctcaagtgcactagcttccatccatctgtcaggttgccttgttctcaattatactcctatatataatcaccagtgctagtcagtgcggtttcaaattaagtaatattctctcctttccatagggatatctgctccagaatttggagtctccaactgtcataccctatacgataccaaaatttcgtgcaaacataaaagaatataaaatatttttatacaatctttaatgataaatcaagtcacagcaaaataataataataattaaataaaacggatagaaaatatattaaaaaattataggtgtcatatattaaaacccgaacggagtacatttcattaggttttttttatgggcattgtattgggaattaatatgcaagcactgacgagagcgtggtaattcttttcttttttttcttatattttgaagaccatgaccaatatggtgtacatatcgcaggagttagctgcacacaagacaatagagttattttcgccggtcaaatatgacaaagtttagttagaaccagtattgcaaggacacgcataataagatcatcttagcggtggaaactaagaccatggcggttttacctcctaattaccatgggccctctcaaactaaaaccggaaccagcgccattgggtaaatcagcttcattgttgcatctgtaggaggcacctagtagcttgatattggtcgatgagcaacaattaatcttggtcttcatttttcatcttttaaaacaaaatcttcgactactttggcagtctgtaaatctgccaagaacgaaaaaagctcaacatattctccaagtaatttacttttcactcttatactacatccgtattaaaatataaacatttctaattatttaaacaaaaagttaaggttgaatagaaaagaatataattccctcattaaatgagttatggttagggcatgagagaggttaagggtaatatgtgaaaaaaattgaatgatatgtgcttgtaagacacgtggtgttagaaatgattatattttgacattaaaattacttatatattttggaatggagcgagtagtagtttgttttagttctttttcccctgttgtggctgcaaacccgttctattttaattatcttcaaaataacatggttttagtcaagttcagaggatgaagtgaacgactttaagagttatatgttgtatataatcattaatttaattagtttcaaggtttttacaagtgcttaaaacactttttttcttgcactatattgtttttttttaccgatactgatatagccgcgagccacacatagcagggagatatattatttattaaggttttttttaaaaaatatatgagcacacacgttaagcctaatacttagaatctaccaacctgagcagagaccatgattttatttgtttttttagagttgtagatgaggttgaaacttactagtgcatagtttccttcgctttacttgttctctccatcacgaatctttgtggagataaatgtattatcctttctttcatcgtttttgaaccttgtcgcgctctccgtgtctgcatccacttcctctccatatttatacacacacatatacacctgcaaactgcaactactaccaccacaccacattgcacttgctttcttgtttcttgcaacgatcgacgtacgacgccatgggcggcgacggcgagttcttcagcgtgggggagtgcgacggccagaagaccatcgacggcgagcaggtgccgctggtgctgacgccggcgtcgtccggctccggcgagcgaggcggcgaggcgctggcggcggcgctgcgcgcgaggcgcgagtgggtggaggcgaaggtggtgtcgaacagcgccgtgctgctgcgcgggttcggcgtgcgcgacgctgccgagttcgacgccgtggtgggcgccctggggtggccggacatccggtacgtcggcccggcgcctcgcacccacgtccacggccgcgtctggaccgccaacgagggccccctcgacgagttcatctactaccaccacgagatggtcctggtacgtacgtagtactcggccaccgccgccgcgtcgcgtcgccattgacgacaaggtgttcgtccgtgtcgccgccgccattgacacgaaggtgttcgtccgtgtggtgggttaattgcagataaaggagttcccggggaaggtgatactgttctgcgaggtggcgccgccggagggaggggagacgccgttcgtgccgagcttcagggtcacggagagggtgatggaggagttcccggagatggtggaggagctcgacgagaagggcctccggtacacgttcacggcgctgagcaagaacgacaccaagtccatgcgcggccgagggtgggaggacgccttcgccaccaccgacaaggccgaggccgagaagaggtaattgacctacaattctagtgttgcgtgtctttccctgtcagcttaagttttataaattataaccaattaaaccgagcaatatacggttttgttggttgaaattgcatttttcagagttgcaataatctcaatgtaactaaataaattcacatatatacactgttggttgaaattgtaatttaatatatggtcaaaatcgcaccaaatctcaatatggtaataaagccaataattaaaaaaaattgcatgtagatgttataaaagtttagaatatatgtcaaagttcacgtcataggacggacggatgctaaagtatgaatgcaccatctggtgaagatgtttgttaacacgaatgctccatttctcataacttaatcaccaaagccggcaaaattcacctgttatcagaaccaacaaaatcaatgcaagtagcatctgtaataccgaagtggattttaagtcgtactctaggacacgtgctctcatttgttgcatttgatttgaatagttatgatttaaaacggtaacacgagttaaattattgtaacatatggtcaaatcaacctacacacataagaaaaaacgcatgcaaacgcgagtatactttttcatactccaatttaatatgtttttttactttttttagactaaatttaattttgcattaaaaaaggggtgatgaagtcataggcacgtgacgttcactagagttcaactaatcattattccaaccatttataatgcacacatccacacagtttcaatacatttattttaatcattgattttggctctagccttcgtatttttatgggttagagtgcgcattcggaaacgtgccatgtggtatgtgcacgtgtatgttttgttttgcataattggaaacatgactttgctatttatgaaagagatatatgtgatacaattagtatagtttcccagaccaatccataggaaattaggaatattaattcatcaccgtctaagagcaagtttaatagtaaagctgactgtcaattattagtaatcctattgccaatatatataatagattagttgttagattgtgttcaatttttcttctcctaactattctctcacttatgcattcaatgtatttgtcttggagtacgtgcagagtaaatattgcatgagagccaacaccttcttttttctttgttggctctgtcctccacgtaagcatacagttaacttatagcgcacttttatccttgctctaatgggccatgtgtgcgtattcagggctcgggcgctagggatggaggtggagtggctggcgaacggcggggcgaggacgatcctagggccgaggaagctgacgcgagtcttcccggggcggcagggtcggcggatgtggttcaacacggtggtggggatgcacgggaaggcactgagctcggcgacgatggcggacggcgccgagatcccaacggcgttcgtggcgcggtgcggcgagatcatcgaggaggagagcatccagttccggtgggaggtgggcgacgtgctcatcctcgacaacctcgccaccctccacggccgccgcccctcgctgccgccccgccgagtcctcgtcgccacctgcaagtgaaatgtcgtcacatcacttcttattactctctccgtttcaggttataatacgttttgactttggtcaaagtcaaacagtttcaagtttgactaagtttacagataaatatagcaatatttataatactaaattagttttatcaaaacaataattgaatatattttcataataaatttgtcttgagttaaaaatgttactagttttttctacaaacttagtaaaacttaaagcagtttgactttgaccaaaatcaaaacgttttataacctgaaacggagggagtatcaattaagctggttaattaaattattattcctcctcggtgatgctacatttggctctcttccatggtgcgttaaaagtttgatacgtgtatatatgtgtgtgcaattatatatattttatatatataataaaagcttcaaggttggagtaagtcaacgggattagttagatttgtgatggtaattagaagtagcaacaagtggggagatggttgtggttaatgatgtattagtagctgtgcttttgtcagcttgtgccagtatcagtgtgttgtatgacatgtgtgatcatgtctttgtgtgtggactgtttaactgttatcttctttaatttaataaaataatcgatgtgatatcactgatatatggaggccctgctttctcagttttcatgtgctatttggcatcttttctgtaatgcaagccttggtttcatgcacggttatggtgattagctatgatgttgaacttgaattttgcagtaaccaaaacttatggaagtagtggactgcttcattgccttggctaattcacaatttacatggttaaaccgttaaaacacaagagggcgcattcagagcaagtttaatggtatagccaactactagctccaaatcatctatagtcaatgtaatagccaattcatacaatagttgcttattacttcctccgtttcacaatgtaagttattctagtatttttcacattcatattgatgttaataattcatacaatagttgcttactactacctctgtttcacaatataagttattctagcatttcccacattcatatagatgttaatgaatatatgttaatgaatatagacatatgtctacattcattaacatctatatgaatgtgggaaatgctagaatgacttatattatgaaacggagggagtatagtattaatacttggtattctctctctttttatctctttaagatatgtttatagttagcttatagcctactattgtacctgctctcatagcgtcttcctgaaacttgggtgttagactacagtgtaatgcagcttcagatgtattgcccacaaaaacagatgcagcaataagattgccagaatagcttagggttctccgaaatataagaaaggtgtacagtcaattcagtgagacaaatggcaccttgcaattaacaagtcactgaaatcaccatcgccatcggcaaaagtcaagttacactgctaatggagtcccttttgacaaggcatcatacatgccatgatactactacagtcatagagtcagagaaagggtgtttggaaaagtaataacatcagtgactagagagagcttcagattattagcaacatggtaactgaaatcacactggatttacattgtacatgaagcatggaaacctaaaactatcaaggggcacacagagtcctagtaaatgccagcggaagtacaccaacttttccttatactgaggctacacaacatggaatctgaatcatgaactgtccaagccatgttctgtttgtggttgtgactgtgattgcagctctgcctgcggctgcggttgctgatggagctgaggttgcggctgcagctgtgggggctgctgcggttgtgggtggagctgagattgcagctgcagctgtgggggctgctgcggttgtggggggagctgagattgcggctgcagctgttggggcagctgcggttgctggagaagctgaggttgcggttgcagctgtggaggctgctgtggttgagggtggacctgaggttgaggctgcggagtttgctgcgattgaggatgcagcagctgttgaggatgtagctgtgagggctgttgttgtggttgaggatggagctgaagttgaggctgcaggggttgctgtggttgagggtgcagctgaggctgtggtggctgttgtgtttgttgctgcgcttcaggttctggctccttcggtttggcggcaccattgttcatccttgctcgggcctcagcaaacatcctctgttgctcagctacagcttgttcctctgtcatctccacaccagtgaatttgcttgcttttggagaatcctgctcgatgaaaaaatagtgtcaatgtatcctgcatagatgatggatactatgcatatctctgtgggaaaaaaatagtacaaaccagggtatcatgcttatggtgttcgtaggccgcttgaacctcttcaatgtactccctaaagccaagatcctgccaaaatgaaaaaaaaaactgaaataagtctggagatttcacatattggcgagtaccaactactagttggaaaacaattatttcaaaggtagatcagccagaaataggtttacactgcagggttccggaacctggagcctgagtgtttggttaaaacaaggttctcagctggttctatacatattttttcatttacaaaaaaaaaaaattcgagcttttcaagacttgatgtttgaatcatgtagaagcaaaagtacatctcccaggaagaaagcacaacactccatgaaggaagacaagggagcaaggagaatgttgaggtcctatgaaccgtagccaatgctaagccactgcttagcattgcaatgcgatgaggcaacaacatccaccataaaaatttccatcatgtggttatcgccgagtgaatgtggctgtcaacaacttctgaacttcatggtgtgttttaacattggacatcaaatgttgaggctcaactcctgcccaagaagtattttactattgaaatgtttccattgaaatgtttccattggaccttgttcaatacatatccatgatctaaccgaaaaaagtccaccagggcccaaaatggagtacgagtttaagaccacactcaattgggtagtccaagcccaattctactttcagccccctaaaatcatgttaacaaatgaacacatatgtgcagatcagttttagctgtgtagtaatagcattccatggcatatagatatctgaactgccatcagacaaattcagcattttagtttcagactttagtcaatagtcataaccaatttgcactcagaaaaagagctctaagatactcaaatccttcattttcaaaaaagaaacattcatatattccccttttactctgttccaggcattctgttatttttatctttattttgcagtatactgaaacaatatagataaggtccataatcataaggaaaaaatattgacaatatactacaaaactacgaccatgataaaacaggtaggacagcatcataagtgataaaaaataatgttaatattcaggaaatgaaaggcaaacctgcagagctctaagaacatgctcaggagcaatagttttcttgtcctctcggctgcaaacttcattggattcagaagataggaggttgatgaactctgatatataaaaaatatgcatattgtgattagatccagaaagggagaaatttcagctattttttacaaccaatatcccttaggttgaaataaggttgaaagttgcaagagacatcttgcaagagacatccaagaaaatatccaaactgtttggggaataacttattttaatgtttaaggaactcacaacatggagggattataacatgaataaatttggtgagagtatggattttatgctccaggcaggaaaatacggtatgtgattaacaatactatacacaaatcagatatcgaccctaccattttttttacgggccacaatagattttgcattagaatcgtaaatacatccagtcagacttgactaaacatagaacacttaaaatcgtaaatacccttaattctcttttacattaatgattaaacatagaaaacttagaattgtaaatacatccagtcagatttgactaaattttaccagataataacgtcacaatggtccaccagactgtttttaaaacggataactttgtaagattaaaaatacactgttcatattcttgattaaaaatagtaccaacttctcttacctacacagcattccacaagaagatcttgtgcatctcttgccactcgaacatcagggggcaacatctcctttataatcttaaacattgttgctgaaatgtaacagaaaacggctaacttaaatcagctacaatttattacagaaaaatgctactacctccgccctaaaataaagcaacttttggctatgaatttcgattcacagttgtccaaattcatagctagaaatactacatcaggcccagagaaatatttatggatcacaattataattcgctaaaacagctgcgctgtgctgtcaaacgtcaaagcagtaaacattactggacttcatagtaagcatcaaagaccatttatcacaaggtttataattgaaatgcattaattttcgatctgaaggaaacaactactcaaggaaaggtatgtggctatgtgctataaccacaaaagaaacaaatcgtcaacttggagcatgaaatcaatgtacacaaaaggagtaccatatttacaacaccaatcagattatcagaacccgacaaatgtagtgccaacttcaagcaacatactcctaagaaataagcagcacaatctagattttccatgaaagttaacattctattccatgtctgctgtcatcgataatatctgaaacatggaccgatcacatacaatctcactatgcatcaaataagaaaacccctaaaataatcagcgcaatcttcaagtccacatttaccacaaattcacacaacctaggcatacagaatctattcaccaaaagtgaattcaacctccctaacaacggattagcacagcagaacaccccctccctccctctgtaagagcatgtaaataaaatcacatacaaaaaaaaaagaaaccctaaattcttgtctcaacaagtcgcctgcctgagacaacacacataatgtaacctgacgggagtatcaactctaaaaagaaatagaactgacgcaaattaaattaaattaaattaccctaaccagataattcgcagattaaccatggcccggtcgcagacaagcacaattgcatcaaaatttctaggcacgaagagaaagcatgaaaaaaaaacgcataatcagaatcaagggagttcagctcacatttggggagggagacgtcctccttggacttccccacgatatccatcggatccatctccgcgtctccaggcgcgacacctaacgtcgggggggcatgcgccgttcacctgaaacccctccccaaaaaaaatttggtcagaaaaacaaaaccaaatgttagcgctagggttacggcaaggggaggagaaaagcttccagatctagaagagaggcctgagaaagaggaggagggattgctcaccggcgagggtgaggcgggggcagcaggccgcgcgagcggcgctgctcgcgtggcgggggtgggggggatcggccggcggtgctccggcgagctcacgcggaggagacggggaatcgaggaggggaggggaacgaacgatgatgggcaagggaggaaggagtcagagtcagaggagagagaggctaaccgattacgatgggcttctgcttgctgctatgggctttttgaataggcggacagaatagactacggcccggctgaaagacgagaaactaattcgcgaacgcgcgtcaaacacattttcgaccattaataagtgaggaatccatcttaggacctctttaagctcaaagggcctgttcctaatacgccaccattaataagtgaggaatccatcttagaacctctttaagctcaaagggcctgttcctaatacgccaccattaataagtgaggaatccatcttaggacctctttaatctcaaaaggcctgttcctaatacgccactagtcgggcgcgcggtcagtactaatagtactagtactactacagtactactattactactgctgctgctgttgttatactactattattattactactataacatatatatatatatatatatatatatatatatatatatatatattgatgtataaaaaaatatgcacgtatacaaactttgtatatgatatatacaaactttatatacgtacgtattaaaaaataaaataaaaactagaaaatacatcacgtatacaaagtacaaactttgcatacgcgtatacaaactacgatgtgtataaactttatatacgatatatacaaactttatatacgtacatattaaaaaataaaataaaaactagaaaatacatcacgtatacaaagtacaaactttgcatacacgtatacagactttgcatacgcatatacaaactttgtatacgtacgaatacaaactttatattcatgcatctttaaaaaaacaaaaaagaaacagaagagaaaccggaaaaaaaaatgaaaaaaccaaacaaaaagaaacgagaaaaacggagaaaaaaaagaaaaaaaagaaaaaaacaaccgaacagaaacgacaaaaaacaaagggaaaaacggaaaactcgctactccctcctcctctcgtgcggcgcgtccgccgtccctctccgcgcgcgggaaggggcgcgcgcgactgatcgcccgttagctttttcgtgtttagggagcttctaattactacagctttttccgtgatcagaagctcccctaaacagtctactttttggtccagatactgagaaactgtagttgtagaatccagaaaataaactagaaactagaagctaggaaccagctagcttctcaccagctgcttctcagaatcttaagctcccgttgatgtgaaaaacacacactggcctgagagatctgaactctagtgcaggacctaaatcttgcttttaggttcaaggacgtgccagttggtttgatcctgtaaccaacaagaaacatggaaacaaagttaaatcctcaaacgatagccgatcggctatggccaatgacgtatcgtttataacctagccgatgttgcgtaaagtagatcgacagtgagatataaagcaaaaagaaagttaaatctattcgatcggctgtagatatcaacaatacataaattaagtcttgaaaatatgtttaaactaagtgattgggatagatcggatagtgtgccgagatagtataaatcatttaaaagtactccaaaacagagattatatatgcttatagcatagccgatgttatagatttaacgtgtatcggctaatactccgataccactttatactaagatatcaatataagcaaaatatattaaacataaatcaatcaagtgctaagatagcttaacagattaataacaagcttaatatattttaccacagtgagatcttgatataaagggcagatttagcatatcaagtacataaaataatgaacaagatcaggtaagaacggctgaaactccgatactatctctaatagcaataataaaacaagctagatattataattctagatattacttaataggtcggacctaaccgatgcagcattaagcataaagagaagtataagatctaaacaagtcaatgaaagtctttcgagatggtagatacactatataatctaagtcaacgttgatatctaaccttatcggctggaatccactagtagatgttagccgattcaaggttagatagcaataatgatctagattatatagaatatatgataactcgacgaattacatcaacaagattagagtgtcataaaaatggaagcactaatcccgagaacgcaagccgtcataacaagttttacctcttgtcggagatctagactgatgcagccaaactcgaaagcaagaactcgtcgaaacaaaacgaaagtaaaagggtggcaatgcgccgaaagtgttgttgaactgattgttatctgattacatgggtttgggtttgcttttataccaaaagtacataatatgtccttgtcagacacgactcctatctctattacaattctagatacgaacaagtcccttaggtgaactcttaccgactcaaaatataaggaaattgcataaaatatcctaattaatagatacaattgccttcttcggactcaatccatgtgtggcaatactcattaagcatatcaacccaatctgataatgactttgatctttttcttgtcggaatcggcttcatcggctgttctggccaccttatccgattcgaactctgccgatgcgcactctgtttccgaaaccgtcaatccttttgattccgcttcggttttaactccatctccgatgcttaatttaccaaatttggtcgttaacagctccccaaacatggcctaagattttgagaagcacttgattgttatctagcttatgaggatttagaagctaggttttgttaggtcattctatagcttctgttgtaatagttagccacaattttataaataccctattattttatgtaaagaaatttcctttgaaatcttgtccaaatgtatgcaatgaagatccagattgttgaatctgtatcaatttactgatccagggcttgatacatcagttaccgaatcattagtttcgggaccctacaataaactttgatttgggggaggacacgacattggcggtccgactacaactaccacaggggtgctgcgccttagcaaccggtacacagactccacgttgttgttgttcttgccgtgccaagaacaaccttgaacctacaagcaatcgaagaacaagcaagaacaagttaacaaaaggaaacagctcacaacacttgtcaaatgatgaaactgaaacaatcgaatatggggttctgaatacaagtatccgggtggtctagctgacacacgcgagtacaagtagctgaaactaaacttgcatctaaacaaaacccaaaaaatgcaaaatggtggctgctagggtttatatgggtggagggatgaccaggagaggaggtggaagaaaaccctagtttttgtggacctctaatgggctgtaaagatacaaggcccaagcccaagtttctaatgcgaaaactattttagccattctgagcagcttgggcggaatctgatgctgaggccacacatagttgaaagtagacgacgagatctttccaacaagtactcatttgccccatcgcacttcggagtgaagagcattgacttcaccaaatcaacgctgcttatgctgtttgcgatctggttcctctctcatattcctaacaagtagatcacaacaaccacttagtagcacccaattttgataagcacttgtatgattagctaggaacgactttacctaataattaagttcacgagctcgagctctagtgattggtccttactgtgcaataggcatggttgtatcgttggaaaggatgtcctcatcagccaggattacaatgtacagaccttgttccttacggactagaccttatagatatattacaatagtaaccaactaggattacaggatattttcttgatataagttaacataattcccgaatccttttctaaacatattctacccatatagactatcccttgtaaatatccatgctgtgtgggtatgtggtacccataatgtccacggtatcgcgcatagcataggtgcgagaccaaagcgctctcgcgcctttggagcacgagaccgcgtgattagcggtgccgctttttgattagcgatagtgttattgccttcgcgccgccgttaagcgagatcgccgtctcactaaacaaaagagagaaggctgtatatttacgtaaatctttcccaaatcagtatattcttgtgatttcggtaaaaaaaacatttttttcaattttttttcgttgttgcgcgcatgtgcgatcggcacagcgaggagcaacaaggcacggggtcgaggcgggtccggtgcaccgcggtgctcgggagcactttgcggctcacgggagaagaaaggagctgtatggcgcttgtcctggcccgctgtgtccgtcaggcttgcccgcggacggttgcggcgcacgagagcgacaaggccgacacggcgctgaagtgaggcggcgcacgggacggaggctgctcgcgcgaacaaatcctggcgtggttgacacggcgcaggacacgcgcgctgtgccaggacacgaaataaaggcggcaacgcaatcatgtgtgcgtgcgtggctaaacgagtcggttggctaggcctggaaggctcggctagcggctcacgggttttggtatttcttgacgacattagtagaaatataattccaagcaatgacgcagaaatacttctggttctggtatattatggttacagagttcatccgcaagcacacggatataccattgtagcatttaacccgagagtattccaagggtatcgtatttattttatcccgtgggaagatcatgtaaagagagattgactaataatttatatattacttgtgataatcatattctaagcaggggttaagataatccaagggtagagtgacacacaagcattaacaactcattctcataataaataatctaagctaggtggaaagaaaagagaaaggaaatctattcctatacttaatagtatacatagtatagtatacatacattctagttaactgatatactagctaataccctctatccgatgccctcttggtacttcgagaagccacccctgactgccgagtttctttcgacagcccgtcatgatcatacaaccggggctaaatacgaaggaataccctccccaggaaattaactgtcggagatatgggtccgggggtatgtgaagtagaggggagttaccttccctccagccacgtggctctgcaagctggctgtcacgcccggaaattcactagtaatttccgaactaatttgtgcataaaatcctcgtctaggaatcagccgaggtacacaaactgacaatttaatatacaaatccatcataataataacgttacatacttacaaaagaaaagaaaaacagcagcggaataacagtctagcgatggcttcagctccactcccacaggcagctcaactggggtataagccaaacgtcttctccttctggatcctttttcttcaactgaggtttaatgattattgcaagaatgagcatatgacatactcaacaagccacacagcaaatatgcaagtacacaaggataccaaaggatggcataatatagtctcatttgcgaaagcagcatttagtaaagatttaagagtagtgaaacagtagagtaattaatcatcaattttaatcaacactgaacagcaccccaatgctgcacagggccaaccatcctgaacaaccgtacccggctgtacagatctaactccaaaccaggagctaaacaaattattaccagttattgcatcaataattatttgtgagagttgtgagactaatcaaaaaaacattgctcaacccgcccataaccgcgggcacggctattcgaatagttttactctggccagaggtgtaccactgtacctacaagacacgattccacacatgttgccatgccccgaagtaccaccacggcactgcaaagggggaaatcgtgacaatacccttcgcacaacacaactcaccacagtgcaccattcatggatcataatcaccccctcaaaaaccagaggcatggactccccagcgacccccacggacttctcgccgcttctcagtctggcaccccgtaatgaaccatgctatacaaaagataaagccgttgcccccgttgcccacgctggcttgtgattggtacggttaatgtttcacaacagtagctcgcgaaccggtccttaattgccatgagcacgaccttcaaaaccatgtgctcacaacccaccattgacaagttttaattatcaattaattatcataacacgattaaccatcgtgagctacatttaaatctaaccataagtaataatgtaatatgattcaccccattaatgagctaatgtttctaagcatggctaagcaattatatatatatagcatttagctgaactaaaccaatatataaggttctagctaatcgaattataacccgtaggaaaataaattcatcttcggccaataattaattgggaaaggctcaccacccgatgacattcgaaaataatgtataagttgaaataaaacattagctttaaacgggttcaacatgctcagggtcgtttgggatccgtgtgacttgccttgagcttctgcaaaggcttccgaacctttctcaacgaaaacgctctcctccggaacgtcggaaactaaagcaaatgaataaaatcaacaaaacagtacaaaaacaatcataaacagtacatgtggatatttttaacatgtagatctcgattttagaaacatttagcaacttgaaccactcgaatcggagttacgatgaattagttatgaatttctgaagttttaatctatttgcatctagaaaaaaaactggaaaaaggaaatatgacgtcatgctgacgtcatcatcgccggcatgacacgggcgacgacctcgccggcgatagagaggtcggcagggctatctaaaggcatctacacgtagaggacgacgacgcgaactcaccggtactagcaaacgcgatggacgacgacgaatggtggccggcggcgagctctagcggcggcacggctcgggtcgtcggcggcggcggctctccggtgaccggcaacggcggcgagggggcggccgaggttccccgcctccgtgcgcatctaacggcggcgacaggaagcggcggcgactgataacgcgacggcgcggcgcggctggacgtcggccggcggcggcggcggcggcggcttggacggcgtggcggcggcgctacgggggacgagaaggctcgggagttggggcaaacgaaagaggacgccaaagggatgctatttataggcttggattagagagatcggactccaaacgagaggatttgagccggaaaatccgagggttagttggagagataaactcgaaaacgaattcgatttggtttatccgggcaaaattaatctccgagactttaaaggaaagggagaggataaggtggagatgatttcccctcaactaattttaggaaaacacaagagaaaaggccggatttggtggaggaagcggcggctgcacaggtacaggacggcagctcgggcttctgtccaagcttgaagatgaatagtacacggggaggctaattagactttcggctgggcttctacttccaaggactgattaaaggagggacaaaaagcagactttgggaaagagagggaaaggactgcaggctgagaggagactgggccgagagtgagaggacttttcctaattcggcccgaaaaggaaaaggtgaattttaattacttttccaattaaattaatcactgaaatgatctttgaattgttaaaaatacttatattgctcaaataatttcaagaaaaatcttgaaaatacttggaccctcaaagtatttaaaaaaattataatcagaccatttaatgattaatttaatatgtggataattactgaaattttctttgtatgattaaaattaagaattgagctctgaaaaatccgagaaaattccagagagtataattaaccatggaggatttaataaaaattaaatccatccatgctttatatttaggaaattttatttcccacatttaacttcacttgtaaattaatgaacatttaatataaattctaataataatttattaaataatttataaatctgaaacgaaaatcaggacgtgacactagccccaccgacgcgtcccgcgagtcgcgaaagcggcagggggggggggcctcggggcgtgatgtcgccccctcgagctctcccgtagcttcgccccgaggccctcgcccggctgccacgcggcggagggagagagcgagaggggaactcaggctgaacaaacataaatgtgcgacgccccnncttgatgngtngctgcggaggaggcgtcgaccatcaagnngccccggnggnngggnngancgccgcggagaaaaacctacagaacgcactccaacaanntcgagaactaccggagtcccggagtaagtaggtgtaccacgcagagcaaaatatgtaagtctccgcggct

SEQ ID NO: 3637 - DNA, 14989 bp, Oryza sativa
  unsure (1)..(14989): unsure at all n locations
cgctgctgncnagtggatttgcttctactgcaagtagttcatcagtgaccggtctgtgaccggcctattgctgtcacatccgattggtagggtaatcatgtccccacgtcgcctctgtatccggcggagtgggcgtaggtatgatccgtcacatcggagcgtcgctcgaggaagggctgccgcaagtcctcactcatttatgagggaatgacagggttgttccccgtgtcaggcgggggacgacgccgggttccactcgagaaccggttgctgcttagcttccgggagaaggcatggattgaaacccagtcaaagtggagtgggatccccctcccatggagggtaggtagaggcggcgcatgtggtatccccttgaactataaaaggaggaccttgcccactgagatcgggggacgactcccagaaaacctgaactccaggagaaagaaagcgaaaacgctctccggagtgaggaaacctttgtaaaactcatccataatcccaaacacagtagtagggttttacgctccatagcggcccgaacctgtataatccgactgtgtgcaagctagccgttagtcttagggacgaacgagtgatttccaagaggcgagcctctgcccccggccgaactcacaaaagggggctcttacgactccccgctatcgaggatcttccctcgacagctggcgcgccaggtagggggcagttgcgcgtttcgagaagaaatcgctttcttccgtcccaagtttctccaggccttagccgatgatggacgaggtcctggaggtagaggaggaggcagtggcgtttacccccaccccgtccgggagtggggattccggagaaagccgtgatcctcgtcaccatcgccacggttctccaactcctccccgccgcgaaccctcgcggagggaggatcccacccattcgggtggttcggctctctctccaccccctggcggagggaggccgcgatgcgtcggggcacgccgccgtctcgattatggagacggcggttcgccccaaggagcgcttcaggcggcgagtgcccttctgcggcatcccccggtaaacccggagtcggagacccccgttcagcactggctggacgacgtggccaacttggtcactactgcccagcggcagttggccacgggcggccgatccaccgccactggtacgtcgcgtacctcggttaccctctcctcgtcggcaaggagaagggcccaccgatcggccacgatctcaaggcggtccacagttccaacatcgtcgggggcctcgggaagccggaggcatcatgacggcctctacggggcgcaggacgctcgaatcaacattgagcgacgccgggacgagcgccgagctgcccgcatgggggaaggcgccttctcatttagagtgccacgctccccttcacgaggcggccctccccctacgctcacccctggggggacaggttgtagggcctttgtggcgagtctccggaatgtccggtggccccgaagtttcgccccaaccttacggagaagtatgatggtagcatcaatccctccgagttcctccagatctacaccacgattatcgtggctgcagggggtgatgaccgggtcatggcgaattactttcccatgaccctcaagggtcaggcgcgtggttggttgatgacccagccccccgactccattcactcctgggaggatctgtgccagcagttcattacgaacttccagggcacatatccccgtccgggggaagagacggacctacacgctgtacaacggaaggacgacgagtccctccgttcgtacatacagcgcttctgtcaggtccgcaacactattccgtgcattccagctcacgcggttgtatatgcattccggaacggcgtgcggcataattgcatgctggagaagatagcctccaaggagcccaagaccaccgccgagctcttcgagctggcggacaaggtggcccaaaaggaggaggcgtgggcttggaactctcccagcaccggtgcggcggccgcggctacccccgagtctgcccccgctccaagcggcgagataggagaggcaaaaggaaaccagcctgcttcgatgacgagggccatgtccttgcggcagatgggcccgcatgggccccgtgcaaaggaaaggccaccggcgataagccaagccccactgttccctccggcgagggccggtcggcggacaagtggtgctcggtccacaacacttaccgccatagtctcgccgactgccgctcggtcaagaatttggccaagcggttctgaaaggccgatgaggagaagcagcagggtcgacgggagggcaaagctcccgcgacctcaaccggtgaccggcgagaggaggccaagaacaatgcccccgccgatgatggcggagacagtgaggatctggacttccagatacctcaggggaccgtcgtcacgctcgacgggaggggaggggggcttgcgctcacaccttttgccaaggcttcaaggccatgaggcgagagcttctggccgccgttcccatgcacgaagcggtccggaaggcgcgttggtcagaggtgaagctcacgttcgaccagagcgaccattcgacggtgctcgctcggggagggaagttggccctggtggtctccccgactatccacaatgtcaagatgaagcgtgtgctggtggatgggggggccagtctgagcatcatctccccggctgcctttgacgcgctcaaggccccggggatgaagctccagccgtcgctccctatcattggcgttactccggggcacacgtggccgcttggccacgtagagctcccgataaccttcggcgactccaaaaacttccgcaccgagcggatcgacttcgatgtggcggatctcaatctgccctacaacgcagttctaggcagagccgcgttggtgaagttcatggtcgccactcactacgcctacctccagatgaagatgccgggccctgctggccccatcaccgtctttggtgaagtcaaggtcgccctcacctgcgcggagcagcgcgcagacaacctagtggtggccacggagccacaggccccagaggcctctgcgtcccacacctccaagaagcgcctcacctcggctgacgaggtgcccgtcaaggagatcccccttggcgacgatccgtccaagaccgccaagattggcggaactttggacgccaaataggaaagcgcgctcatctccttcctgcgggcgaattctgacgtcttcgcatggaagccgtcggatatgcccggggtccctagggaggtgatcgagcaccgccttgccatgcgaccggatgcgcgacctgtccggcagaaagtgcggcgtcaagccccggagcggcatgccttcatcagggaggatgttgcgcggctcctggaggctgatttcatccgcgaagtgatccatccggagtggctggcaaacccggtggttgtcccggaggccaacggcaagctacggatgtgcatcgactacacagacctcaacaaggcatgccctaaagatcccttccctctgccacgcatagatcagatagtcgactccactgcggggtgcgaccttttatgttttctagatgcatactctgggtaccatcagattcgcatggctagggaagatgaggaaaaaaccgcctttattactcctgtgggcaccttttgttttacaactatgccttttggattgaagaatgcaggccctacttttcagcgcatgactcgtattactttaagtannnnnnnnnnnnnnnnnnnnnnnnnntttgtcgatgacctggtggtaaagacgcgccaccaggacacgttgctacaggacctggccgaaactttcgatagtcttaggtccacgcgcgtaaagctgaaccccgataagtgtgtgttcggcgtgccggcgggcaagcttctcggttttctagtctcttcccggggcatagaagcaaatcctgagaaaatacgtgtgatagagaggatgtgcccccccagcaagcttagggatgtgcagtgcgtcactggatgcatggccgccctgagtcgatttatatcgaggctgggtgagagggcgctacccctattcaagctcctcaagagctctgggccgtttatatggacggaggaagctgagcaagctctcaatcagctgaaagcttacctcacttcccccctggtcttggtagccccggggccggaggaaccattgctactctacttggccgcgacccctcatgtggtgagtgccgccctaatagttgagcgtgaggaaggcgaacgggaggcccctccggctcgcaacggcccctcgtcccccgaaggcctagcgcccaaagctcccagcccccgggaggaccccgaggcccccgagggaggaggggaggctttggcaggtggccccgagccttatgatcctgaggcaatccgggatccccccgggacctccgaacaggcgcgccccggatcatctacccctgacaacacgaaccggccccgccgaaaggtgcagcggcccgtctactttgtcagcgaggcacttcgagatgcgaaaacccggtatccgcaggcccagaaaatgctttatgccgttttgatggcctcaaggaagttgcgtcactacttccaagcgcatcaggtttccgtagtgacgtcgtaccctctcggccaaattttgcacaaccgagagggtactggacgggtggtaaaatgggccatcgagctggctgagttcgatctgcacttcgaaccgcggcacgcgatcaaaagtcaagtcctggctgacttcatcgcggaatggaccccagtggatgaacctgttccatccgatgtccctttcccccctagagaggaagaggatccaaacgccgacattcgcggcgggcactggattatgcatttcgatggctccctcaaccttcaggtgcaggtgccagagtcacactgacctcgccaagcggagacgtcctcaaatacgtcgttcgactcgacttccgagccacgaacaacatggcagaatatgaagggctcctcgcgggattgagggcggcagccagaatgggcatccgccatctcctggtcctaggtgactcccagctggtcgtaaatcaagtatccaaagagtatcagtgcaccgacccgcaaatggaagcatatgtctacgaagtacggcgcatggaacgccacttcgacggacttgagctccagcacgtgccccgacgcggcaacacagttgctgacgagttgttgcgtgttgcgtcggcacgagccccactccccccagggactttcgaagaaaggctcgcgcaaccatcggcgcgaccgaaccctttgagggaccccaacaacacgccctccaaccctcgtatggatgaccgacatccggggtatctcgacggcaatactcttcctaaggatcgcgcagaagctgaaaaggtcgcgcgcatctccaaacggtacgtcctcatagaagggaccctctaccggcgtgccgccaacgggatactcttgaagtgtatttctcgagagcagggcatcgagctcatagccgacgcccatcagggtgagtgcggggcccattcgtcctcagaaactttggtcggaaaagccttccggcaaggtttttattggccggctgcattacaagatgcccaagaatgggtccagcggtgcaaggcatgccagttccacgccaagcagacccaccagccggcccaagccttgcaggtcatcccactctcttggcctttcgcagtctgggggctagacatccttggaccattcaaggcagctcgaggcgggtatctgcacttgtacgttgccatcgacacattcaccaagtggcccgaggcctacccggtcgtcaaaatcgacaagcattctgccctcaagttcatcagaggcattacgtctcgattcggattgcccaaccgtatcattacagacaacggcacccagttcaccagtgagctatttggcgattactgtgatgacatgggcatcaaattgtgctttgcctcacccgcccacccccagagcaatggccaagtcgagcgagccaacgccgaaatcctcaaaggactcaagaccaagacatacaacgtcctgaagaagcacggggattcatggctcgaggagttgcccaccgtgttgtgggcaaatcggactaccccaagccgcgccacgggggaaacaccattttttctgatgtacggcgctgaagcggtcctaccctccgagctttccctggggtcgccttgcgtcacactgtataacgaggccaacatggacgaccttcaccgcgacgatctcgattatcttgaagaacggagaaggtgagcggccctgtgtgccgcgcgctaccaacaaagcttgcgacgctaccatcaacgtcacgtccgggcccgatcactacaagttggcgacctcgtcctatgccgcgttcagtcgcgcctagggctgagcaagctctcaccaatgtgggaagggccatacaaagtgatcggagtaccccggccaggcttcattcggttaaccacggaggacggcatagagctgcccaacccctggaatatcgagcacctccatcgtttctatccataacatcgagattttttgctttcctggagctcgggccagcccccgcacaacccctcggtttgtgcgggcctggccgggggctaccactgtgcatcctttttccttttacaagcaatgaatttttctactttttcatgaagaccgttttctccccttcctctggcttgtcctggtttaagggataatccgagtttgctctaaaccctaagtgccgtaaggcggcctgaaaaccgccgaaagggagcacgaacgcgggccgcgccccgggttgtgtcgaaccccgggggatcggaagggcctacacacggtcgtccccgacccccggtcgtcgcagcctcggtctggccagtcccgctgggcggctccctcggggcgatggtcttgcctatcaccacttaggtaccatggaccgagcgcggatttaccttttcgctagaacaagctcgaggggtggatggggtcaaaacgacatatcaatcacaggcagtctaattatccccttttgccctggttttttcttctctctatgtcacaggcacccaatggaaaaagcaaaagagtaaaaggggttaaggaagtttcagttgtagaacaagacaggatggcacaatggcctaaatacaagaagtgcctgctatgggcacacgacaaaagggaattaaaagcgcgagtagtcacggagtgcccggccccccgaggccagcgccactgacgatgtcgtcctagtcatcgtcgccgtcatcacctccacttccgctttcttcgtccgaggtgagcccaaaggtgaaccggggggccgacccctcgaagttcgagacaatcgcgtcggccgcctcccggacttgctcccgggcccttgcctcggtcctcgggggaaaatcttcgagcgcgcaccatggcatgatgacctcgaggacctcgatccgccaacggatcgtggcttcaaactcctgtgcggagcgggcacaatcatccaaggccctgcgttcagcctcgagtgccactgtccgggcccgcagcgaggcgtcggcctccgatgcccgccgctcgtgggcagcggctgcgtcgaggatgccgcgcgcgtccctgatcctctttgccaagtcctcggcgtgggcctcatactgaaggcggatgtcgcctagtgcttcatccagggcactcgaggcgattagcgccgcctgccgctcctcctccgtctctcgtataacggaatccagcgcctccttgcacgcctggatttcggctagttgggtttggcgcattttgcgccccaccctcaccatgtcgtccacggcgcgacgcccctcatcgactcgcgcgcggtccgcagcgagctgtgcccactctgcatccagggccgttcgctcttccgcccgggcttgaacttgggcgttgagcccctcttgtacagtggagtcggcggcggcgagcacctgcagaagtggctccatactctccgcagtcggggaagaaaaggccgcggtccgcccccggggcgacggggtactgctagatcccccgcgagactgggggctgctctcggctccccttctacgagaccagccccgagggcgccccaagcgcaagggggagcggctgtccctctcgccccccgcttggggtcctcgagtggattcagcctgggcctcgggctcggggccgcccccagcctcggcctcgacctcgggctcgggaccgccctcagccttgacctcaacctcgggctcaggaccacctccggtttcggctcccgagctacgacctccctcaccccccgatcctgggtggcgctccgcatggaccctggtcttagagccgccctcgggagggacgtcgccgccaccgtcgtccccggcaggtcgagtacgtgtccggtatgtgtccggtatgtgtcctttgggtcccaccgcgaggctacaaagaccccgcagccttggattggccaggcccggaccgctccgaccgtttcgatttcgtcccccgcgaggggtccgaccctgagactccctgagaaggaatctcgctacaagagaacccagatcatgttaacgaaagaaaaagaaaaaagaaagaacaagaggacgggctgggtaagagcaccgaagtgagcgccagcaatcgtacctgcagggagggcggttgaagatccacttcaggggctcaatgaagctccctcggcacggctccgtttgccctatcttccggagccgcttctttttctgtctggccttgggcctggcaggtcgcttgtggcccgctggcggatgatctgtcgcgcgctcggaacctcctccacgcgggggagagggtggccaggactcggccaccttccgcttcccttttgggccaccggccgagtcgtctccgggtccgcggctcgggccgggcgcccttgagccaccgccgcctggaccgctggtccggctcccgcccgcggtcgcaccaccgccacccgcgccgacggcgctatcgctggcgccgcctcggctggaccgactccagctggcaccgacagctgacatcatggctaggatgctctcccggtcgcggtcgcagcagaggggaagaatcccatctgggattagtgttggctcggcggagtctaggcccagcacccgccgaatcaccctcttcgcgtcctcctcacctcagtcccagcgctcgcccacatgcgtgcgcatggggtcgttgggaccagtgtattcccacgtgccacgggatcgctcttggagaggtgcgatgcggcggtggaagtaatcgccaaagaccatcgcccccatgaggcccaggcttcgcaggcccctgaggcgatcccaaaccacgtcgtattcctcgcccagctccgaagccaccagccatgcggtggatctttcaggaggaccagcgggaactcgaagtcgcggatggtccggcaacgcagtgtagaaccagtctttcttccagtcctcccatttcttgtgaagatggctctcgatgtattgacccactgtgcctggctggggctggaagtagcatccccccaccaccgcgccttgcagcagctgtgggatgaagaaggcctggaacaaccgcatcgtcggtcgcaccccgatgaacatctcgcacagatacgcaaagatggccagcgtcatcacggcattgggtgcgagatgcaaggcatggatttcgtagaaatccagaacctcatggaagaatctggagaacggcggaatcaagcccgccatagcgaaggacaagaggtgcacggatcgctccggatatcgtggccgcggccgcgactctcccgcccgcacgacggcaccatccggcatgatcttgtggggaaggataaggtgcctgtctgccgtgatgcgggaggaagggagcactgtgtcgctggcgtcttgagccatggtggccggcggagaagtggcggagagcgtggcgcgtgggacagtgtgaagtggcgagaatattagggttcgagaagcgaaaggacgagtgggcggttggcgaaaggaagaaggcagagtctctgcctccgcccccttttatcctcgcctcatccacgctcacctcctcgtttcatgcccccataattgcccccacgatcctcgcgcccgcatttgtctcttcgcttcccgcgcccactcatcacatcgcccgttgtatccgcgtcccgcctttagtgcgcctgtcagtggcacactcgaggtggagtgtgcaacggccatgagcgcaaattgaacaaaccgtcaccgctaccgccgcaggagtggcgagcgagggaatcgaggcgtggtctgaccgacccccctgttatcgcgcctcaagcatcttcatcatgagcgcggtcagtggcagtcaaaccgctgttatggttggcacgccaacctggccaccggcgatatccctttgggttatataccggcgtggaggaatacccatactgagctgtcaccattagcggcccacctctcatccgcaatatataaccccaaataatgctatcccgtaatctagacaccacatctaaacgaccagatactactctaatatcatcgtcttgacatagagtaattgcatcagcaaacattatacccgcaccaaagcatctcccagataagctagccgtatactcagtataacatgaacataatgtaaagtaggtactcgtatactcggaaagtatttcaataccataaatgtatatagaagagtattctaataaaagtacaaagcgtacaaaagaggaaaggaaagctgttagagccatacccgaacacttccaaagacttccggactcctgattcctattctaattctattccaccagctagatactactaaactaaacttgagaggaatgagagagctattgcttgaggtttgtgtgaagtgaagagagtgagctccttatatagaggtagttatgacggttgtggaaggggaattgtgcgaagtgccctccaaccgtcattgggatgcaatcctggacgtccacgccaaaacatggatccaacggcgccaggattggttcagccgaaccaccagtttcggccgaacctggggctggtccaatccagcccaatttcgactggtggcctcctctattgctccactccacagacttgtgaattttggcccaattcatcgtgtcagttctgagttcttggcccatttattcataagtcttattctcgacatcgtctgattgatttatcatttaagttgatgtcgattctcctccactttattgtcattctctacaaaaggttagtaaacctaatactagtggaaaattattactctaacatacttatgcattgcaagcatcacaagttctctcctattttggtagtattgacggtcgaaactgatcgataacgaccgtcaacgaatccccaagcttgaacctttgctcgtcccgagtaaaggacgaaaggaaacaaagacttggttgttgatcaggagttgctactatgctgcatatctcaaagatacaggtgcaaggtatatgcactctctctcatattaaataatctttggcacggtggcttacccttacccctgattcccacgagacactgcttctccttgtcttgagcggttgaaagagagaacagcaattagagcaccaatcatccgatctttattcaactctcattccggaagttttcaaatgattttggaaaagaaaaccaagttcctcaaatgattcactcagtctctccaagtgtatcaaaatgaattaatcaccaaatattgcctttttgattcctactctaaggttttgatatgtggaactcggtagggatcaaacatggcatacttgcattcacatttattactaagtcaaaaacttagactagagcagataactgaacatactcaagatcaagatcgtgcaaaatgtgtgtgatatatggtggaaatggtgtatgaagaaaaataaagaaaaaacttctcctctgtgctcactttcttctccgaaaagtccttttattgattaggagagggcatgattacatttttttttcaacatcatgttcatgcttgatggagcataactttattattttttcataaccatgcctttccctcctctctttttcttctcctttttttaaaggattttttactttttaggagaagaaagcacataaaagcatggagaatttattttggtggtaatatggaaatacaatagaatattgcttagctcctagtgtaggagtttggcatgtgcatatatgtattcgttttccattttttaccgattcttcacaatcgctcgtctgtcattccaccttcgctgctctctcctctcgcttctcggtctcgctcgtctgcatgactgcatccgctggctgcttactcgctcccctatgctagatcagcgccagtggtggctgccggcctgccattctgtcgtacctgtcggctgccactgccgtctgtttgtctacccctctgccggctgctctcatcctttctttgctgtggtgcgtggtctgctccttgattcgtcctgtggttcaacgattgaccgctctcacgtggtgagtattgaattttaatgtatatgttattaggtttatccccgaatctgaacatagattatatttagactggttatactagaatagaatatgttacatcctgttggtccttaatttcctattaggctgaacatgtatactcagagtaatggtcctaggggggcctgtaaaatgggggccccgttcggtcgctccggtcacgcaccctcagtgacggccctgtgtactaggatatgtcactttctactacaaagttatcttattttgggatggagggagtagttcttccaccacttcttctttcattatatttccaatactggtcgtgaaacaccataaacaggaggatgttgaggcccgtaattcgaagtgaattcttgatttgctcgttcctagtctctatttattcctctaacttacttgtagtattcatctaagctacttctaaacatagctacatttagttttcacgtagataccacttgtactgctataggacagaattacttaaaaaaaaacagaagcagaagtaacacttcttttaatgtattagaactttagaagtaactataatgatagaggaaagtaactttgagaaaaaaaagaattaactcttcatgatgttagaagtaattatactaagaaaagtaactttgaaaaataaaaataactcttttatattaatagaaataaccacactgcttaaggagtcaaggataaaatttggataatttgatggatgcagtaaatttacttcacatatttccttatttcaattctcgaactatgtaatggagagttacttctatatattgtagtagaacttatttacttctataatttgagtaaattacttttaaatacttatgatcttgatcagagagcatgagaagtatctacacaagtcacaagagtttgacaaagttcaatagaatggcaagcaaccaaaatgtatatggtttaatcatgatagcacatttttggctctggtaggaatttatatcaaatgaggaactctcaatttcatcattttgaaaaacaaaacatccggaattcaagtcaaactagtatcaagatcatagcaactcatatttactatctcatatctcgcaacaacctagacttagatcagcaagtgcagcccatttacctcaggttcccggataattgttggctacttatatttaacctttgagagagtatttaccaagaacccatatatcagagatatgaaacagagcaactattcatcatttcaacaaagagaactagcttgtcttacctagcatgactcaaacctatcctatctttttggcattttctattttgcaaatttttatgttgttttttttaagttttataagatgcaattggaaagggaaatatgcaatgtgatacaagttacctcagtggggggagagatgtctcccccccaagcttggctttcgctgttggcggttgttacaagccaatctcataccgccaacatctgcataaagttcacataataaaacatccaacatagtgataggtgtttaatctcacatatttcacaagtgttggtatatatttgtatgcaggtgataaactccatttttgaggaaatctagactaaagtgaggagaattctgtatccatacaaggatgggttgtgaactttatcgaaacatcagtaaatcagcccaaaataccatgaaatggaaagaggaggaccaggggaggatgtcacgtcccaaaacgaccctaaaatttatcctttaaattatgcctagaataattaaaatccgtgtgaaaacctccaacaattaaaatgtgcaaagttaaaagtcaaataaggcttagaggatttttgtatatttcctaaaagcctgaaatacgtaaataaattttagtggaattttcagagcacaaataataattgttaagaaataaacaaagttaaaaaggttttataaaaagaaaaaccctaaaaagtccctcttccctcccttgggccggcccggcccatctctccccccctctctctctcctctccccgcggcccatccggcctctccccgcgcgcgccgctgacgggcgggcccgcccgccatcctcgctgacgggtggggcccacccgtcatccccttccttccgccgttcctgccacctcccccgcgccctagcgctgccgccgccgggaataccgccgcctcccgcggtccccgcgtgcaataaagtggggggaattactccttgcgatcccctctccctttccccccattttcccctttctctctcgcgttcaaacagggggatttgcccccgcaaatcttcgct

SEQ ID NO: 3638 - DNA, 786 bp, Oryza sativa
  unsure (1)..(786): unsure at all n locations
nttggtcttatggccgtcgcactcccccagttggagaactatccgtaaccgccatggcgtcgtacgtcgatcgtcgcaagaacaagaaagcaagtgcaatgtggtgtggtggtagtagttcaagttagcaggtgtatatgtgtgtgtataaatatgcagagaaagtggatgcagacacggagagcgcgacaaggttcaaaaacgatgaaagaaaggataatacatttatctccacaaagattcgtgatggagagaccaagtaaagcgaaggaaactatgcactagtaagtttcaacctcatctacaactctaaaaaaacaaataaaatcatggtctctgctcaggttggtagattctaagtattaggcttaacgtgtgtgctcatatattttttaaaaaaaaccttaataaataatatatctccctgctatgtgtggctcgcggctatatcagtatcggtaaaaaaaaacaatatagtgcaagaaaaaaagtgttttaagcacttgtaaaaaccttgaaactaattaaattaatgattatatacaacatataactcttaaagtcgttcacttcatcctctgaacttgactaaatccttaattgtcatgagcacgaccatcaaaaccatgtgctcataacccaccattatcaagttttagttggcaatttaattaattaaccaatcacgattgaccatcgtgagcttccattaaatatccataagtgatagtgaagcatgatttatcccattaatgtgatgaactgctgtncgactgtcatcatcan

SEQ ID NO: 3639 - DNA, 797 bp, Oryza sativa
  unsure (1)..(797): unsure at all n locations
tgaggcccttgatgtctaactcctcgnacagnnacncatcaagtataagaatttacatcactatatgctcggagcaacttacatcaatcttggtgcacattgttatcctgcaagacccccccgcaagacccggccggggccccgcaaggaatcaattggaggtggtcagccttcttccgctccgttgggcacttcggttggggcatggcggcgaactggcaatacccggcgagatgcgatgcttccctaccttctttgagatgcgatgaacgaaccgggggtgcccggcgtgcctggaatgaaaggagcagccggaggagaccgccgtgcagacctgctgggcctagtcgctgcgtgtatcgcgagcgatgacaacggagcggatcgcgtccaccggccggccggcgtgcgtgtctgcgcggtggatttggggattgggaggaagctggtggttagccctagggttaccttacaagggcatagggttatatgcttccactttattgggccttcggtgggtttcttctggtataggagtactatctcaaaatcccactcgtcctttcgcttctcgaaccctaatattctcgccactttacactgttccacgcgccacgctcttcggcactttttcgtcgggcaccatggcttaagaccccagcgacacagtgctcccttccttccgcatcacggcagacaggcaccttatcctttcccacaagatcatgcccgattgtgccgtcctgcggacgggagagtcgcggccgcggccacattttcggagcgatccgtgcact

SEQ ID NO: 3640 - DNA, 735 bp, Oryza sativa
  unsure (1)..(735): unsure at all n locations
cggcccatgttgatggaccactagtggnacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactattggatttatctaacaccttgattatctncacctttcaattgatcn

SEQ ID NO: 3641 - DNA, 748 bp, Oryza sativa
  unsure (1)..(748): unsure at all n locations
ttgaagctgtcgtcgcccatttccatacagaatcttcgactgatgtcgcgtggcaaactcctgctgaccgtggagtccaagaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccactgcagtagaacgccagtcaaacaaannggccacg

SEQ ID NO: 3642 - DNA, 1064 bp, Oryza sativa
  unsure (1)..(1064): unsure at all n locations
aaggagagtctctaacgaaaaaagggttagaaggatgggagagataaaggtgggtagagatatagagaaatgaaaaagatataggaaataatttatatatatataaatatatatatatatatatatataaatatatatatatatatatatatatatatatatatatatatatatatatatatatatatatatatatatatatatatatatatatatatatatatatatatatatatatatatatatatatatacctataaacccataatgaacaattgctttcgccaagttgcaatggctgtcgtacaagagcaaaatcaatacagttgctatgagcagcaaggaaagcttcagaaattttttaaaaaacggtaggaatacagttgctatgagagcttcagaaaaaaaaaaggtacaacaaaagacagttgctatgagcagcaaggaaagctttcagattttttttttaaaaaatggtaggaatacagttgctatgagagcttcagaaaaaaaaggtacacaaaaagaaaaaacaggaactgcaccagccgggaatcgaacccgggtctgtaccgtggcagggtactattctaccactagaccactggtgcctcgtgcaaatgaaaatttcgtcaaaatatataagatacgtgacactgtcagagtcaaaccgaaacaaacgccacccccaccggcccaacccgccgtactctagactctagcctagggtgggctcaagcacgcggccatggcgatctcgcgccgcctcctcctctccctcttcctcctccgcgcattctcctcgcttcccgctcaggccgcagcgagaggcgcctcccatccctcaggtctccctctctctctctctcttaccttgtctgcggtttttttccccgctcatgaaccactgcgtgtggtgccgattggatgttctagagctcgattcgtccgcgtggaatctgtatgttcgatttctcagctggggagctcgggaggacacgaatccactgcttcacttccggattttgatgaagtactgatacgacgtcatcaattnnaccccg

SEQ ID NO: 3643 - DNA, 1231 bp, Oryza sativa
  unsure (1)..(1231): unsure at all n locations
cggtgcagtgagtcgctcctactgcaagtagttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctcttctcagtaaatgatttggaaaacaaggaagatgtgcttgcatcatgtgatgaactgatttctattccctattatatttcttgaggttttaatttattgttgtgccctgttaaggaacatggagctcaagtcatatcgacaataccgacagtgccatatatctttgagtatggtgatggaaggtgcaaaattgcaattattatattatatatacttgttctctgttagttttctaatcatggagtgctttatccagcaaagtgcaagtcgagaaccctgcagctttggcttcaaatcctggaaagcgtatagcagcttgttgggaaccaacagtcattgcaactattattattcctagtgagtaagatctgcttcctttctcatacactcttttagttcatgaatttatacatatttatatttataaaccagaagttcttgagactacccaaccgctttttcaggtatgttgggccagtaattatgctttgttcagagaggaggggcgagcagcaagaatatacattcattgatgcgtaatagtttactccagaaatcattttcttaaaataaattttgttcttgccttacagggctattgtttgtttgtttgatgcagccaaagggctttgttgaagtaccgattaccattgagggaaatcattgtggatttctacaatgaactgaaaagcataacatctggatatgctacttttgattatgaagattctgagtaagtttccttttcaactcggtaaccatacatggtcttgtctaatcttttgattttttttaaacattctgagatggaaaggcatgtatctgttttctttcatcaggtggccttattattcttttctgtttttttgctcctttttgtgatgattattttggaggcctgttttatgccccattcctgaaattcgtactacaccttgctcacaattttctactccctccgtttcacaatgtaagtcattctagcatttcccacattcatattgatattaatgaatctagatagatatatgtctagattcattaacatcaatatgatgatgaactacgtgcagtgaacgccatcaaaggggcg

SEQ ID NO: 3644 - DNA, 26485 bp, Oryza sativa
  unsure (1)..(26485): unsure at all n locations
cgctcctttgataagatgactgcatgnancnancacaanangaangngggaaatgctagaatgacttacattgtgaaacggaggaagtatttacagttcttgtctctactccagcatactaagtactagtagtcacctcactttctttaaaaaaaagcaaagttgtaagcacaaatagaaagctctcttgggagtttaggcatctagtgttttgaccttttgagagtgtttcctgatgaataattattaccaaataatgtgaactataatcacattctggagataatttgcatttcatgcgacttatattatcaaattgcatgtaggtatatttctatggttaaaattaaatgggtgacaaagcaggaaaaaatgccactatggatggctgtttattttcttgtttaactccctttaatttacttcaacaggtaccaacagtctgatcttgttaagatggatattttacttaatggtcagcctgttgatgctatggcaacaatagtccacaaccagaaagctcagagagttggacgagaattagtggataaactcaagaaattcatagaacggtattcatcatgctccttattgtggaaatcctgatgcacagattatgcgcttttataatatttccatatattattagggaacgacaaacataatcgtgattgctgcctacattcttttatcgttgtacagaatgtcaaaaattttcacccatccattaccgccatcctttttcgttatgcttttgtctctgattatgcaggcaaatgtttgagatcactatacaagccgcagttggttcaaaggttatcgcaagggaaacgtaagatagttaaaacctgctgctgtttttttttcccttacaagttaacagcacgattatttttaatggattgtgtttattccctagcttgttgaagttattatttgcatgcacatcactctacagcaagggaattcatagaaaatcacttatctgtccatgagaactgatatttttttctagttgggatgcacttccaactcccaagtaaaattgtgtttgcccattcacatttaccttctaagtagaacaattagatatgctctttggagcttggaacatcctaggtacttggtagtatttggtgtaaagataatcactggagatgtttcctggaaaaaaagcgtttagaaagctaacctttcttagagccgataattttgaatagaactattgtgaacctctattggtctaagcagaactggctgcaaactacaaccatacagccttggtaaatctgttccatgatctgatcttacttggtcatctgtgaaagacctggacataatattccatgcatgactctcagagactcagattatttaccatgcacttagtttcccggtcttaattgtgtctgtaatgtcattcagtttcatggtaaatgttatggtaactataaggttcattccgttcatgtaaaattctgtgcatttgtgtaaatacttaaatatgctatcttgcattgcttccagtctgtcagcaatgagaaagaacgttctggccaagtgctatggtggtgatattactcgcaaaaagaagttgctagagaagcaaaaagaagggaagaagcgcatgaagcgtgtagggtccgttgatattcctcaagaagcatttcatgagctattaaaggtctccaattcaaaatagatgctgtgcttagtgctgtagctgtctaacagcatgagggtgtgttgtggtgaaacacaaacagcatgttctggacttctagtcatcttctgaaaggtgtgtttattacacagttttacacgttatgcccccatgtcccagtgtccagaaaggcctaatttcatgccattttgctctattacaggtgccttttggtctaatgagtacataatgatgtttcttaatgataagaggagacaaagcaccattttgccatcttttgctgtggcaacatattttcatgttgagaagctagcattaccttttgtttttcattgattttcactgtacagaattcggtgatgcctgctgaatcagcagtagcgtcggcttacccttctgattccttaattggcacagccatttagctgaatctcatttctttgttcaaattatgttaagaactttttgggaggaaaatattccagagatagtaagtcctttttttttgggcaatgttaaataattgggtatttccctttgagcttctctagttctgtttaatgcaattttgtaattttgtaactcttctgctgcatggtgtaaacttgttctggcgctttcattcggctttctgtaaacatcacatagaacccgcaaaatataattataatatatatatatatatatatatatatatatatgaagatactaccgtagggtgcgttgtattaaaaagcaaccgcccctaccccccctcctcccccacacccacccaagcagtcccgcacaccccacccccttcttttggttgctcctcatggtaacctgtttactatacaatcacccgtactatacatatactcaattactaaattttactggccattctatttttctcacggttattccccgttttttccggatcgcaggtcggcgacgggcggtcgagcggcgggcggccgccggcttttgcttcctcggcgtgccgggtggtaggcggtggcgatggtgcgccagatccggatggcagtggctggataacccctgattttttactccaatcggagtaaacctatgattatatatatatatatatatatatatatatatatatatatatatatatatatatatatatatatatatatatatatatatatatatatatatatatatatctatatatatctatatatatatatgtctgtctctcaagagctatatatatacatgtgtctatagcagcatggatatgcttatacattttttaaaaaacggtaggaatacagttgctatgagagcttcagaaaaaaaaaaggtacaacaaaagacagttgctatgagcagcaaggaaagctttcagattttttttttaaaaaatggtaggaatacagttgctatgagagcttcagaaaaaaaaggtacacaaaaagaaaaaacaggaactgcaccagccgggaatcgaacccgggtctgtaccgtggcagggtactattctaccactagaccactggtgcctcgtgcaaatgaaaatttcgtcaaaatatataagatacgtgacactgtcagagtcaaaccgaaacaaacgccacccccaccggcccaacccgccgtactctagactctagcctagggtgggctcaagcacgcggccatggcgatctcgcgccgcctcctcctctccctcttcctcctccgcgcattctcctcgcttcccgctcaggccgcagcgagaggcgcctcccatccctcaggtctccctctctctctctctcttaccttgtctgcggtttttttccccgctcatgaaccactgcgtgtggtgccgattggatgttctagagctcgattcgtccgcgtggaatctgtatgttcgatttctcagctggggagctcgggaggacacgaatccactgcttcacttccggatttgtgggggcgatgtctgtgcctggacaattttggtacaagtgacttccggattggggacgatgatgtcagtgcgtggacagtgatgaagagcacaaactcttcgagtgcaatatgagggtgtagttgtgtggaagattgcgtcatgtacttagcttggataattactgtgatgaactcgcacacctctgtccttttctgcgaagaattttagctagactgggagttgtgactttaggcctgcatcatcgtctcatcttatagaatcattgtcaatagacgtagcagatctgttcataggtatgcagttagtgactcaatctatatgtttcttaaccaggtaccagcggaaattatgggtcatttttgcgcaacctgcttcaggataatcccatgataacgtatgtattaattatagccttttatgtttcgtttatttcgtcattgcatattttgcacgccaacatgggattgagcatattggctatgcttttgtaacaaacttagggaggaattggtccgtggatatatgagcaactcggaacttgagattgctgtgcatgccattggaagccgctatcctaatatctccaggatatacaggtacattatgttgtgatactttgcttcttggcgatgcgagtatatcatggagtttctcaacagcattcaagaccctcaatatttttaaccatgccaaatcacatcactggtgaaactgaacatcgattaaaatcacatgaaaagaaaacctataaatttccaaaactctgagaattatgagatacaaggaacttcaaagttatgttaaaattgcaaagtttaaccagattaggattttaacctgacatttcaccatcaaagtatggtattatggtgtaatcaattctttgctgtcaatggtccatacaatctgcactgataggtagttagggtaaagataagatatcttttagagaaaagcaatcataaaagtgctaagttcaaaaccatcagcccactcataaaattctatggtgttctatttgtggcatgcgagagatctgtgagcagataattgagtagtatataataaagaactgaatcttctagttggatactgtcactctgtcagttacactgatggactgtagcttgttatggaacttcaaatttatattgaattcatctcaagtttttcttaaaagtgttatctctcacttttatgtcctgtatgctcatacattcaaactttgcttacctattatttattctctctttgagggattgcacgatcatgttatcagcattggaaagagtgtgaatggtgtcacattggtatgtaactcgagtattttttatttttgttatgctttagttaatgttaaatttgtataagagaacttttatggttcttgtagtgggtgattgaaatatcagacaagcctgggcaaaaggaagctgaaccagcattcaaggtttgtggttctgtttcatgaagagtttcctacattggtgttcccttttcaatttgtatatgcaatgaactcaatggatgaaattctatgccactccactctgataacaattatcctcatcggcttatctagtgttttgtaggcacctttgacagaaaattatattcacacatgtggaatatcttcaatgtcaatgtaatgtctttactccatttaatttatttgactcccgtggggctatagccatttctttcttaattctttaggacttatccccatattgcaactgaaagataagctatagcagaactgtacaagtggttccccacaaccaccaccacaaaagttctttaaaggagaaatcagtgtcctggtaccagcagtgtgacatgctagggaaaaaaaaacacatactaattggagccattagttgtgcctcaagatacttgccactctccatgtctagaccaattctggtggagaggaagattcagtaaggaagatacatctgttgcgttctttccatagtaaccagagatccagaacaccagaattaccagaacactgaaaactttttgaaactgcctgcaacctctttccttgccttcaaccacgaggttcacctgacatcttcccccacagttggcactaggaaatcaatgcagcccaatcacgcactcggagctacattggtcaagtgtaggatggtacgagtaccagagcagaggtgtgacagtataatgcgtaataacaattattcatataactttctttaaataataacctttagcatttattcttactacactataaatctgtaaataaatatctaggttatctatttcgtcagtggttctgattatatatctgtgaattttgatgtattttttgtacaaacttgcagtatgttggtaatgtccatggtgatgaacctgttggaagggaggttcttataaagcttgcaaattggctgtgtgataactatttgaaggatcccttggtaagcaagattctcacattgttatctgctcttaaattcgatgtttgtctggctcaactatggttttacgcaatatatttccatctgttttactgaaattgatagaaatatatggtaagctcaaaaacttaccagttaaactaatatctgtaggcaactcttattgtgaaaaacatgcatcttcatatacttccaacgatgaaccctgatggatttgctcttagaagacgtggtaatgcaaacaatgttgacctcaacagagattttcctgaccaagtcagtgatgcattattttcttcttatggaatatttggattccttttgttctttacctacttgagccttttaattatattgttaatgctggcagtttttcaccaacaacgatgaaattaactacagacaacctgaaactagagctattatgaactgggtaaaacaagaacacttcactgcctccgctagtttgcatggggtaattattctttccctagcacttctatgcaaaaatattaaattagtcatgtaattatcttcccagttatctttctgtgatcaaagcaaatttcagtaaatgatgaggcacctcatcaggttccttttctggtttataatcttgctcatctcatgggaatgtcctccctttttttttgtctttttgttagttattacaagcaagggaactattttgctgctatattgagttacctatgttgcttttaattttaggtgctatctttaccagtattcttactgaaaatgctagggtgtttatgctctctctgctgtttatggtttggatgttattatctgtagttattgatactggtaatgtcatatatttgacaattcttactttgttggataatattgctttctaaaagcaagcaaatgggtttgaattagaccttgtagtccacaaactactttggtataactattagtttcactgaggcattcttcacttagtcttcaagcgttaaacatcattgttttaagttttaacacataaaataaaaacagtaacatatgggagggaaaattatcttgtttaataataatagaaaatctttgtagttcaggaaatattttattgatttattagtttctctgggctgcattcatataatcttcgaatattaacataatttgttttaattttaaccagaataaaaataataacagaccagggggagagaaggttctttttttttaaaaaaaaaatctactgaattgcaagcatgatggttgcaacttgcaagaaggaaatctcgtgcacagcttgtaagattagtttatttgaaatcatgagttatttatcctaccagcccatctactactctactaattgttaatggtgcaatgcatggagtttacagatttgttcacatgttcaaatgacccttattaattgcattgattatttttggtggcagttcatttcaaagttcaaactagtgcctgggattcatccattgccctttgatttgaattttgcagggtgctcttgttgcaaattatccatgggatgggtctagagatcaaaggtgttaccttgtttctattatttacattcagttcaagtattccaattattagttttgtgtaaattttgtacatcataaaaatatctagaaacaatcttttgatcaaggacttcccacgcatttattagtgtatgattcaaaggttgtatggttatgtatttttctcgacttattgctaatgctagtattacaaatttgatgtttgcaaatagtttcatagagtttggagtgcatgtgggtacctttgcttgttctaatgcgacattgtcttgactctttatgctgttgactggtttttcttctttacaagatcattcagatatcttagcatcatggtagttgagaaagacatccgtgatacatgcttactttgaaactttgtcattctcacaaggattgtcattcttacagcaaacagtattatggatgtcctgatgataagacattccggtacatggcatcagtttatagtcaatcgcactataacatgtctttgagcaaagaatttaaaggagggattacaaatggagcattctggtataaaactagttttgtattattgctccttatcattttttttatttcatatcaaacattttgttgctgctacttttcatgctaactagcaatctatgcttttttgtgttgaggtatccaatctatggtgggatgcaagactggaactatatacatggaggttgctttgagttaaccctggaaattagtgacgtaaaatggccaaaggcagctgaggtatttttctttttttttgcatctagttatctgcctatcaatttccagataacttgataatcactttgttgtgttatttcttccaaattcttctatagcttcctgtcatatgggaacagaataggatgagtatgcttaatcttgctgcaagccttgtgaaggtaagacatttccacaggattcatttttttcactggaaaggttaattactgtacttctcgaaatgaaatggtgccagttggttttcggattgagggctcgaggttctcgtaggagggtactggtaatggccaaagttgaaaattttttcatgttggatttctcctgaaacaaagtggttcagtgtagtttttgttggtgccattctggcacatgatcaagttcaaccaggttgtcttggtgtttcatcttttcacactttggtgacctcacaccacgacttgaactctgcactagcaagctggccctttctgttgctgttagacacaacattgttagtaatgtatgccatctctagcttcagtcaacatatttcttggttcaaagatttgaagagattaatgcttgccaagtctatttgatgggagttattgggataggttttctcctagtacttgttaaagttgagaattaagagttaagtcaattaggattacatgcagtcagtgcagttcccatcttttgtctgtaacacagtacagggtaccctatctttttctattttttatttggttttacaaaaggggaatttgagttggaggagcagagaattcttagattgtcagagttatgaccctgctaaggtttataactttatacaggtatatgattgagatgctccattggtatgtgttatcaaggagtaaaagttaaaccaagaggggtgttagtttgtaaccatgtcattgtcagacttatgaaacaagacctttgagtaaccagcactatcctgtactaacgggagatatcatttgaagtttgctcctttgtgtcgttgtctataagaaataactgaaattgctaccttgtccatcatatatggctattgtttcagacgggagttcatggaaggatatttgcggcagatacaggtcatcctataccaggctccctgacgataaagggtatcggttctgaggttagtttattttggcagcgttaaccaataatgatgtgaacagtattggtggcctttggatctgcactgtaaattgattgttggtcaaaatatttttagaacggataaactggtaatatcctaatatcctaagtaacgagtacaacgaaatttattgcataacgttcaggcttatcatttgatagacctaatacttaccgttttcttgcttttagataagggctagcaggacttatggcgattaccatcgaatgcttgcacctggtgagaactatgaaggtagggtttcttctatggacaacatcaatacttatgtatacgattatacagccttttcctcaaaaacattattgaaaatgcctggcaagtgggtacacagctgaaatttctgataatcaccaaccaatcatatttaccactgaccattagctagtgaaggcaaaatttatcctccagttggagctttggctatgaagtgaaccatttgctacccgcatagttaactgtattgatatcatagcatgttttgatgggtgtttctaaaactggatcaatgaatgatctatggtgttaattttttttgatgatcttgtcagtcatggcatctatggagggcttccgaacaaaagctacacgtattgtggtggaggagaaggctgtgagcttggacttcatcttagatcgagatggagctaatggacaagtggtccgtaatgacttaggttgcccatgtgacgacgacaagttgtttcatgtgcagggagctcgcctcgagctgtatctatttgttttgctcattatcatcgcactgtatgttctcttcaagagaaaaacaacatcgaaattcacgattcacagacattcaccgaaacggccaattgctgtataagatttagaaaattttgcgagtcgatacaaatctgtagctgacccaatagtgatgtaatttcttcagtccaatgtaacttcagtttgtactgctacaacattttgagcttaattaatactccctctttccctaaatgtttgacaccgttgacttttttaaatatgtttgaccgttcgttttatttaaaaacttttgtgatatgtgtaaaactatatgtatacataaaagtatatttaataataaatcaaataatagaaaaagaattaacaattacttaaattttttgaataagacgaacggtcaaacatttttaaaaaagtcaacggcgtcaaacattttgggatggaggtagtatagtggaacactcacgatgtactccacgcccaagcagcattacccacaaccacacatttgtcagatggcttacaaatctataacatgaattaatgcaaaacttataattatcaagtggatagcaaccaacacccccaaaaaaaaaatcaaaccttttttgagaatataaattgtatataacatagcactaatgaaaactcagtttgtttactggatcttgtctgcgtgtgtgtgaactgaacatagtcaacatgcaacgcacaaagcttgaaaaatatgaaaactcgacttgttgaaaattcataggaaacttaaaaatatgaaaactcaactttctgaaaattcattgataagcggtaccacctaagttgactacaactgtgtcgtgtttgttctcctgagctgattatatacaataatacaaatggtctgtctctagtatttctcaggaggtgtgccccagaatcagtttcattcatactccattcataagccatagtacaaagttcagacacgtacacacaaccagtcgttcatacattggagtacacggtacagacacagcatgcccgtgcacacacacactaccttcatctctaaacacacagacacaaccctctaataccctctaatctgagtaaactacagtagtgaataaatcatggtatacaaaggcacaacatactccagatatcacgtatgccgcatacacaaaaatcttggtcgccacgttgagacaagcgaaaacggataccttcacctcaatcagataataataagtgaaggcagcgagaacaaccgaaactagagacatagcgacggcagcaaacatgaggatacgaagcttcaacctcaagcgcaggttgagggtcgacagctctccggcggctttgagtcggtagcggacgaggcagatgaatatcgcagagataaacatcgcgaccaccatgaagtgctgaaggattgctaccttttggaacacagacaagataaaaaaggaactcgatcaggtgagcaacgacaatgcagacatggaagagaacggagatgaagaacgagagctaactaattaaccaaaccacctgctctctgtgctgtgttcactctccctctgcttgcttgagctcttgtgacttgtgcttgagagatgagacgctctcactgatggcagagcaggcatgagtaccgagtagtgagaggagatagtagcatggaaagaggtggccgggtaacagctactagctcaactagttaatttgtgtccaggatacttgctagggtggcgattgtgataaatggggtgtctacattcaggattcaggggtgttaagttttagcgtgtcacatcagatattatataggatgtcacatacatattcggacactaataaaaaaactaattccaaaatctatcggtaaaccgtgagatgaatttattaaacctaattaatccatcattagcaaacgtttactgtagcaccacattgtaaaatcatggagcaattaggcttaaagatttgtctcgtaaattagtcgtaatctatgcaattagttattttttagcatatatttaaaacttcatgcaggtgttcaagcgtttgatatgacaatgtgtaaaattttggaggtgggatctaaacaggcccaaatacggagtacgaagctcacctgaaactgtgtagatgtgcaaaacgacaaataaaaacaatgatcaagctggaaaaatgcagttacgaagaagttgttcagattgtagctaaaataaatcttactaaattttggacatgctaaaattttggcaatttgtcaattgacaagttttggttggatttattatgtatttaccacagttcggtaaaaactaaattgatgcacatatttagtagctttacttttaaaaaagtatggtttaaaatgacatctacctaaacaattctgaacacatttacatttaaaattgtttacatgtgtaattgagtaaaacgacaagcaaaaaaaagcatacgtaatatccagggagagcacatgaaaaaatgcgtacatattttttagatatgtgatacaaataaagtttttacggctaaactctaataaattaccattagaagatatgcgtaatttgttctagatattttatatgacatttattagctagttgatgtgtacacagaacacgttatctacgaaaaaaattgaaaaacatatcttttcttcaccagttttagagaaatatatacggttacgaaggattagcgtgagtatccgttatcacatagggaagcgaattcgtagcgagttcatcacgcgcggcgagttcgcagccctaacgaaccaaattgcgtgctgcagccgtggcttcaatcaattaattactcactttatatccaacgtttgtttcactttatatccgacgtttgttttgttcgtcttatttaaaatttttttaattagtattataattgttactagattataataatatatgaatagtattttatatatgatttttttattttttataaatttcttaaataatatggacagtcaattgttagacacggatgtccacgactgcatttaaaatggaaagtaggaagtaactaattagcgttattagcgcttaattaattagtttatatttttttaattagcatcgttagcgattaatttatcattaaatcattattagtcagcagtttcgctgctcagccaggcgaactccccgcacgaaagcgcgcgtcaccacgagaccgcttctttgatctgagacgggtatatttttatcaattcgtttcaaacgtatgtattcctaatttcctataaaccgattaaagaattgtatcttttcaaaaaaaaaattccgttatctacaaccacaaacatttgttcaatatttgagggataatgttaatgtataactgttcatggattggaaaaataattttctccctaagcatgcatttaggctgattgtgcaacctggaaggatcgaacctagggcaatgtttagttcccttcaaacttctaaaaattccgtcacatcaaatgtttagacacatgcatagagcattaaatgtggggaaaaaattaattgtacagtttacatgtaaattgcgagacgaatcttttaagcctaattacatcatgattttgacaatgtgatgctacaataaacatttgctaattatgacggattaattaggcttaataaattcgtctcgcagtttacggatgaatctgtaatttgttttgttattagtctatatttaatacttcaaatgtgtgcccgtatatacttaaaaagattttagcacacgaactaaacacggccattgtcgtattcataaagaccataaccaatttgcaaaacacataagtacagccaattaaaccctcagccaggaatctttgaacacccctgcgcacgcggagaagcagcccagaagctaacgaacgaagtataatgatccaccaagcttggccatctttgtgtcgtatcgatgaacaagaaagcatctaacaaacctgtcaaccactgtacatatatcatttgaattaatatatgggtgaaattaagttttaacacaagatggtattagtatcagcgaacgattactattttctaaataataaattgttcgtactctggattattgcaaaagcataatataagtgactctaggagtatattgtacaacttttaactaacgaaataaagaaaacatataatataaaaaagtatatgggtgaaagttttaatttgagattgtattaggagtatcaatgaacgattgagggcttctttattgcaggaattttagagagagaaaaaataatggattcgattactaatcactcatttggattggaagaaaagtacataggagaatttgaaaattatttgtattttttattttcattttatcttgagaagtctaagacaaatcgaggcatgtgatttcaaattattataaatttaacactcatcaagcaaaaaaaaatattttatacacaaatagtaatgatcttgtgtttcatcctattcctatatttcaaaagatgtgtgtcctattttcttatgtgctttttaatattatatttttttcacatgtaattttattttattcctatgttttttaatttctgcatctttttaactactcctttaaaagcctggagagagtaactgtcgagtaaatttatgtaggtagatcttcctttgaattcgatgtaagatactgtaatgatcacagggactccgttgtactccatcacatcttttctgttctgcatcacttcactgaagttggaagttctgcagcacttcacagggacagctttgaattcaacgctatggactgggagtagcgtcttgtttgcttagagcaaatataatagtgagctataagaagcttaaatgctgaggtggatggaagaagagaggagagagatgagaagcgggctgtaagtttacagcctgcttagtcacaggaaccaagaaaattgtgagacagacatgtggaccatatatttgtagtgaagagttaaccactatataaatacatagatagtatataagtaagtagctggctgtattattatccttgctcttatactgtagcggagcagtagtactacttattattcctacttctatacttctatgggaccactggaaagggacgaagagaagattgtcggtgagaaaaagagaagatagagaagatcaagaattaagaatacgcaaatgcactcttttttttcccttctcagaacacatcattgtactctgtgaaaaattgtacagtacattctgcaggcaaaaatatggccttcttgtcagcatttgcctttgtttgctttcaacaaggtctactaccttaacttctctacctcatcactattaattgtacagtgcatactatacatagttgcgtgtatatcttctctccacacccatcaatacgatggatttgcttcccagaatctcccgtttcttctgcaagaattgatactactacctgcctgttgctccattgaagttgattgaactcatcaatcctccaaccgatttgctccccagatttcctgcatgttccttctgcaagagttgatgatatactgtatactctagtgattactaggtgtgcacattgatgtcctactctcagcttctcgcgtgcattaaataaagtgagatgatgactatgcactgatataaataatccttgtagcttaggcaatgcttgcaattaaccaacaacatatatgtgcgatagatcaaaattaacaagactacagcttagctttatttaacaggaaacattacattaattactatgttagatcaaaagctactagcagggttgaattaactaggattatttgatcaacatgaatccttgattattttttaaagaccaaattaattaagaccttgaaattaaggcctggcttttatctactgggtgctcagagaaattaagcacaaggccatattaaactgacccgatcgaaacacattcacactaaactctcaggtagaaaccaaatcgatcagcacttgacggaatagtaacacacattcttcacacaagagctagccattgtctgattttttagataaagaattgtagattgtctgatagtcaagaaaaaagaaattaagaccaagatcaagaatacattcttcacacaacagctagtcatattctgatcagttaagaagaaagaaggatcgagataaagaatacaggcaatgattaaacaacagatcaatccaacgtactatcgatgaaatacaacatcatccagtgatccaacaactgaagctaagctagatagcaactacgagtacgaggtgagtaggacccttcttctcccgctcgccggccggattctaccgatcgaagagattataggggaggaggaaatacaacatgcatgtgcctagcttacatcacagagctaccatcaccggcagaagaagcaacgccgctttgctgatgctgccgctgccggccgtcgcggcggcgacgtggaagtcacgcggctctctgttgataggcagcgaagccgaagccggtggctgcgtcgtcgtcatcttggcaggggccggcgaagcagaagccggcggctgcgtcgtcgtcatcttggcaggggccggcgaaggcgcgtggtgcaagccgcgcggctccctgttgatggggagcgaagcagccggcgttggggtcgtcgcgacgccggggagacgacccgccgccgtcgtggccgccgcggaaagcacccctaggaagatgacaagaagagctgcaagattaacaccacgcatcctagctgcctttgagcttttgagggaggaagagcagagcagtgatgtaggagtatcacaatatcactagcagtgaactgaggagagatttggatactctccctacgtgtgtatatattggaaaattaaggaacttttctacatacggcaaccaataataatgtgttttttttctaaactgtactgatccataaacactaatccttacccctggattgtcttttattatagtttgggtaacatagtactacctcctgaattttgtgctaaaacctatgtgattttattagaagggtttatttcagttaatcttttattagtggaagttgggaatttatcccaacatcttatttatttttttctctttttacttactctgcatcgtacctccaagatttaacagagttgttgttcttggtctgcaatatatggttgggttagcacatccaaaaatttcctacacacataaactctcaacttttttttaaactaccaaatttccttaaatttctccccaattctaacaactaaacacagcctaaatctaacaaatagtacatggcttgcacagttgcactgctactgccctgagcaaaagtgtgcggcggcacgtggggtggggaataatggcagatgacgtctaggtcagtgggagaggccagtggatacatgatgtggatgcaatatatatggacctttcgatccaatggttcaaaaagatctagcacaatgtttactaccaaattttatggcatcatttgtttaggtttaggctgttaaggtgaattttcggtgtttgtagcttgtaaaccgatggcttagagtcctagctctagtctacacgtgcgaaaagaaagtacaacataacttttcgacttaataatgcaagaatagcttatatttatttttgaaaaagaaaaagtccaaccaatagtaggtactaggggccatgtatggcccgatatctgaattaactagttggcaccccgcgccttaccgcgggatttgctagttttatcgtcaaataaaatataaaataaatgttttaaaataattacatataacacacacactctctctctctctctctctatatatatatatatatatatatatatatatatatatatatatatatatatatatatatatatatatatatatatatatatatgataatgtgacttcatatatagcctctgctattataatataattcatgttttattttttttaaacgtcattgtgtattcttgtgatatatgagagttattttcatgcacaatctgaatatcgtcatatttaggtagtctgcacctctttgctttatctcaaccttgttttgaaaataggtttgggttactgtatgttatccaattgtttataaaaaacaaaacttacaccttatgaaataatttaatttgtatttgaaaaaatgagttaagtttgcattatcttttaggacttggaggaaaaaaaacatagtattatgtgcagaatggataacaatgtcatgcatgatcatgagttaaaaagaggtgactgaatgagtaatcaatgattatattagatggatgtggatccaatggctgataactctttactaatgcgatccaatgacttaaaattattgatgatgtagcttcttacatgccttgttttatagaagtaaatgcctcttagtggctaccaattatataggaagataggatttgagatccattaggatgaacattagtctacacagcgatttgccgtgggaaatactgagcaattctcaatatatttttttcaacaatcaagtaaggagtaaaaaggaaaaaaaatatgaaacatcagggttttatcagtatttaccatgaaacaaacaaatgatatccatgttttgatgtgaaagatattgataagtatatgttaaatattataaaaatgatagataaatttgttaaaatattgtgtaaatgatgtgaaggatgatgattggatatgtttgcatgttgatttgcagaattaaataaattgtagatgatgttgcatgcttgcatgaggttaaatgtgcaattattgctagtgggtgataatatggcatggttgtatgttaagctttagagtgggatataactttatactttcatagattcatacaagatcgatccaactctttatgggacaaatcttcttttggttcgcccctacaaatagtaggtaatttggaaatttgggtttgtagagtagtaattaaggtatgtcgcagtagagccctccaggacctccataggcgacgttgtaccctggcttgtcggcgccgaagcccagcggctgggcaccgtagcagccaggcgtggtgacgacggtccgatccaccgagtcctggaagagctgcccgacggcgctgatcccgaggtacttcatgatggtggcggcgaagcgagcgccgccgcacgccggcaatgccgctgcccatcggcgcgcgtcgtcgtgtggttccccccggccctcgtgtccaccaccctcccccccatctccacatacgacccctctgggaaccccgtgtcgaacgcgtcgtccgtgtagtagccaatctcctgatccatcaccgccacccaccacaccaacttggtgtcatcctgcatgcatttgtagtatatatggaattacaaattaaagccaaaacaaaaaaaataaactttcaaactaaattttgaagttaatcttaagatatattcaacgtagtttttttatattaacttttaaatcactaaaaacacatatataaaagttttacttataaattatttttttattctctaataagttgttttggtttattagggaatatatgagtaaccgacgatgccgtaagtctaaaattgtaatttgaactatgtgacagaaaaattggaagtttgaaagggattaaacacactctaaggttattccggttttcgcctctcccaatgaaaacgctggaattttgcgggacgggcgcagcagaccccgtcggcacaccgacgacgcagtcgtgcgcaggctagctcggctgtcatgaactcacttctctccgattcgatttactcaagtagcgaagaaatcagcggatagaagtttcgtgaggaagaagaagagcagagctagaggaagaagaaggagaaggaagaaggggagagtttgaaatattggggaatagtttgtacaacttctttcatgtcccttttctctcgaccctgccgatcttatatagcaatgagctattagatctcactctctgacccgtggcccggcaaacatcaccgggtgcactcactctgagggaatttacttgtgggcctcctcgcccgagtggatcgcctgatttggatgtcttgagcttctggatcgcacggtgatgacgacgccgtgacattcttccccccttgagctgaagcttgtccccaagcttctgcagatggaaaacgacggcgaagctcatgaggattctcccaggtacaaatggcagcatcatcacccgaccactgcaccaggacttgttccaccatcttggcacctttgcgaatgaaatgacgctccagcacatgaataggttggggcggatcagctatcgtcggacgaagcacaggcagaggcgcatgaacttgttcaccaggggccaatgccttcttgagttgagagacatgtataactggatggatcaaactggtagcaggaagagccagtttgtacgccacttcgcccacacgatccaacacctgaaacggaccataaaacctgaaagataacttgcaattagcgcgggtgaccactgattgttggacaaacggttgaagtttcagataaacccagtcgccaacagcaaaagagcgctcagagcgacacttgtcctcttgtgatttcattctggtctgagcgcgtaacaaatggctgcggattaaagattgcatctgctcccgttcatgtaaccagtccaacagatcctccgactgacaggcagatgtagcagacagaccaaaatagcgaggctcgtgcccatacaatacctcaaatggtgtagtacccaaagcagaatggaatgatgtattgtaccaatactcagccagagcgagccaccgactccattgagaaggacaagcgtgaacaaagcaatgaagataggtttgaagacattgattgacatgctccgtttgtccatccgtttgcgggtgataagaactcatacgcaattgtgtgccagccaaacgaaagagagtagtccacaatgtgcttgtaaagatacgatcatgatcagagatgagcgactgaggtaatccatgaagtcggtgaatatgttgcatgtaagcttcagccacatccaaagccgtgaaaggatgactcaagggaacaaaatggctgtatttggaaaatttgtcaaccacaacaaggatgcaattgaaagtggcagacctgggaagtccctcaatgaaatctagagacacaatctgccatgcatgtgcaggaacagggagtggttggagcatactagggtatttaacatgtttaggcttggcttgttgacaaactgtgcaggactgaatatattgagtaatggaagcacgaagtcgaggccaagcaaacagatgttgaacgcgctggtaagttacttgaatactggaatggccacccactgccgaggagtgtaaattggcaagaattttgtgctatagagaagtgttattgccaatccatatgcgattcttataatacagtaccccatccttgagagaaaaatcgggcaccgctccagaattgatacacagggtctgaattttacaacaagcatcagtatcctgctgataaccatcaaccacttcctgtatccaggccggtaaagccactgataaagctaacagttcaacttgttgcccaagaggataacgggacaacgcatcggcaactcgattgtcactacctttcttgtagatgatttgataccacaatcccaaaagtttcgtgagtgctttgtgttgccagggtgtggtgagacgctgattatctaagaaagccaagctgcggtggtctgtcttaatgaaaaactcagcatgttgtaaataagggcgccaatgatcgacagccatcataattgcaagactctttttcccataggtggataatcccaaatgtcgtggccccaaggctttgcttaagaatgtaattgggtgattgttttgcataagtacagcacccatccctttgtcagaagcatcagtctctaccacaaaaggaatactgaaatcgggcattgctaagacaggagcagtcactaatgcatgcttgatagcctgaaaggcctgatctgtggctgatgtccatagataaagttgtcccttctttaacaaagaagttaatggtttactcagaattccataattaagcacaaacttgcggtaataacctgccaaacccaaaaaacttcttaactccttgacagaagatggaaccggccaagactgaacaacaacaatcttgtcagaatctgtggagacaccattaggactgataatatgtcccaagtaagccagcttttgttgagcaaaagaacatttgctctttttgactttaagctgatgtttatgtaagatctgaaacacagtctgtagatggatcaaatgttcctccatagttcgactgtatatgagtatgtcatccacaaagacaagcacacacttcctgagcaatgtagatagaatattattcatcacactctgaaatgtggcaggagcgcttgtcaaaccaaaaggaatcactcgaaactcaaagtgaccatggtgggtttgaaaggcagttttatgttcatcctctatatgcattccgatttgatgatacccggcacgtaggtcaagcttggtaaaccattgagcccctgctaactcatcaagtaactcatctattattggtaatggatacttgttcttgactgtgatagcattcaaatggcgataatccacacaaaatctccacgaaccatctttctttttaaccaataacaccggagatgagaaaggactagagctaggttgaattatacctttagatagcatttcctgaacttggctttcgatctcatctttttgtgagggagtgtaccgataaggtctgacattaaccggcatggctccaggaatcaacggtattgtgtgatcaaatgggcgctgtggtggcaagccctcaggctcatcaaagagggaaacattgtcagttaacaacttttgtacagccgcaggtataacttcagtctgaacatcttcagtaataaagcaaaactgaacaagatttgccactgccatcttcttatccaactctttcagctaacaagcagaaataagagtacactgttcagtgtcagaaactattccctgcaataagatctgttgtccatctttgttcaccatcaaagtccttgtggaccaatcaactgtcatagggctgtgctgcatcaaccagtccattcccaagatcacatcataatttccgagagccaacaccttaaattcagtacaaaacatatgcccttggctaacccattcacaatcctgaatcacagactgacagtgcaataatgctccatcggccactttcacttgcaccttggtaggtagccaccataccccaactaggccagctgccaccttcttactgataaaactagccgtactacccgaatccacaagaatcaaaatatccttgccttgaatttgtcccagcattctcatggatccacgatgctcagagccctgcatagcatgtacagaaattgccattatctgttgttctgcagctgtgtcaagaactgaaccggtatcttcttcagattcaaacagcactgtgaaaagctcctgcacagcatgaagttgaactctgttggcacacttatgggtaggtgaccatttctcggcacaaatgtaacaaagaccctgagcgcaacgctgagccttaagtgcaccaatcttatcaacagaattagttcctcttttgatttcagtctccctcttgtcctcaaacttcaccccagaacctccagaacgtacaggtggagcaggtaatggataagcacccttgaaagctgtattgggtcgatgcagtattcccccttcaattttcttctgctcctttcctgaatttcctgaattgccatcagctgtctccaagacttcttcctgtaaacaagcaacagccaacgcagattcgagattttgtggacgctgaagcagaacaacatttctaatttccctttttaaaccctctgtaaacctatgggttaagtacttggtgctaacaaccggatcataaaccatcaattgattcatcaattcatcaaaacgctcataaaactcctagacagtgctggtttgcttaatgctatccatttgtctaatcaaggcctcatgccgatccctatcaaacttttcagaaacaacagcacaaaaatcttcccaaactggaaaacgcaaatgggctctagacgatttcaaccaagaggctgccctacccatgaagtagatgactgaaactctcacccacaaccctggaaaagtattattcacatcgaaataatgctcacacttcatgcgccaatcctggggatcagaaccatcaaattttggaaaatctaatttaggaactcaatgactatactaacgttccccctgttcaaaatcaaattcctctgatccccaactagcaccctcaaatttatgcgcaaaattgaaattccccttatgcgtgagattggaatcgaacgtacccttgcccggggcaaggttctgggtcagatgtacaccaggaacccttccccggagttgtgttgcagagtggtggccattggcccatttgcttctgcccttcgccatcacaggttgagatgttggtggcggggtaggcagcaacggcgccttcctttcctctgccgccgctggttgagatgttgggggcggagtgggcagcaacggcgccttcctttcctcgtccgtcgacggaactcaaggggaaagcgctgaagaggaagcttgattcattttgccgacgaggtccagctgctgacgaagatctcctacttccgcgcgcaaatcatggatcgccgattccacttgcggacgccatccgttgactcctgcatccagcttcgccaccacagcttgagtctccgcttgcttgttgttcaacgacaccagcgactcctggatctcggccaaaacttttccgaagtcgttgttctgcttctccatggcctccacatgcagctgcaacctagaggtgtagcgtggtttctccaggatgagtgctctaataccaaattgtcacgaactcacttctctccgattcgatttactcaagtagcgaagaagtcagcggatagaagtttcgtgaggaagaagaagagcagagctagaggaagaagaaggagaaggaagcagaggagagtttgaaatattggggaatagtttgtacaatttctttcatgtcccttttctctcgaccctgccgatcttatatagcaatgagctattagatctcactctctgacccgtggcccggcaaacatcaccgggtccactcactatgagggaatttacttgtgggcctcctcgcctgagtggatcgcctgatttggatgtcttgagcttctggatcgcacggtgatgacgacgccgtgacatcggccccttgtgctcgcgctggtatgcgtggctcctaccatgagcacttttcttggctgctgtttcactcgcgtgtgaatcgaggaaagaccggagcagagtaccaactacttttatgtaagtatttgaaatttttatgagctactccctccgtcccacaggattagggattttgagtttttgcttgcaacgtttgaccactcgtcttattcaataaagttgcttaattttttttattaaatttattattatatatttttattattacataagttattttaaaattattaaatggtatgaaatttgtcctttttggacactgggacatgggggccataacgtgtaaaacttgtgtaataaacacaccttttagaagatgacttagagtccagaacatgctgtttgggttataccacaacacaccctcatgcttgtagacagcttcagcactaagcacaagcatttatttttgaattgagacctttaattacttatgaaatgcttttgaggaatataaactgaccctacacgcttaatgcgcttcttcccttttttttgcttttctaacaaactttttttggcgagtaatattaccaccatagcacttgggccaaaacgtctttcttattgctgaccaactggaaccatgcaagatagcatttttaagtatttacaccaatgcaccagaacttttcatgaccggaattgaccttttg

SEQ ID NO: 3645 - DNA, 24013 bp, Oryza sativa
  unsure (1)..(24013): unsure at all n locations
tgagaggaagtaagtagagaacagagaaagatgacaagggagcaatggaaggacctaacaaagcaaacgcggagaaagagggcaagggagagaaaagcaaggaagagcagcggaaacaaaaggagaaaggaaaaggagaaaacggagggggaacaggagaaagggtaagagggaaggaaaaaggaagagggagcagaaaaagagggaaagggaagagccaaaagcgggaagggaggaagaacggggagaaaggaagaagagagagagacagaaagggaagaggaggggggaaaaagaggnagnncganngnnnnnnnnnnnnnannncngnnnnnncnnnnnnnnnnnnnnnnnnnncnnaatcccttatattatggaatggagggagtatataagtttactttgtgtaatttttatattttttacatgttataataattaatcgttcaaccatttaaagaagagactctgtttttaagtagaagagtggtaacaaccattggttgatctgaaatttttaaaaattttaggcgtattagagtcttttgatgtttatattggtacgtgtgagattagcgaaaaataaacttattttgaaatgggatagagtttgtgaaagtagggagtaatcgtgttgagagtagataaagtgagtaatagttgtatcgagatttagatgaagtagatgcatataatcttttgatgtttatattagtacgtgtgagatgagcgaaaaatgaacttattttaaaacggatacggtagaagacaggagcaccaaatttatttgacttactctgtggatgctaagcgtcacgccgtatctttcgcctccatgctgcgacagtgagtcgctccaggaggagcccagagcgaaggagctgttctgaagatggaaaccatcgcagtccaggttgaaacagttggtctgagctccactgtcgttctgcacatatatcatcagtcaattagttaattattaatctatctcagcccaccttaatccccatgtattagctatagtatatatcgatcatcagccgcgctgatgaagagtcgtcacttacggtgtaatatatgaacaatcttgataaagagtccccatataaagctggccaggcccgcattcagtgacatatatacgaacaaatatatatatccacagagaacatatatacattaatattctaatattatgtttgcaattataggtagtagtcgttataggcttccgttataaatctatgtgatacttaacatttagaaaggagatggtttggatttttttcccctaacttttttttaaaacatttagaacatattggtcgtgtgccttttgattttcattacagaaaaaaatatggtaattaccacgagtccaaccacaatctggttggcaagagtttttggtggatcagaacttggataaggcctgtaatccttgtcgagcgtgtagccgaccatgatgtagttcatggagaactcgcgaggctgcacgtctaccttccagtttggtacatctgcccgagcaccatggtacggcccatttctgccgtaagcaccagccacctgtacataattaatcaatcaattaattctaaaaaaatcaattaacgaacttaatttgcgctgtaatttaatcaaaaccgaaaatcataaaaatggcaaatcatatttgtgacagctagctgggtgtggataaattggataatggacataatgacaaccttaattactactcattcgttttaggttataaatcattttgactttggttaaaattaaactattttaagtttaactaaatttatagaaaaaaaatagtaacattttcaatgcaagacagatttattatgaaaatatatttaattattgatttaataaaactaatttggcattataaacatttatctataaaatgtagttaaatttgaagtagtttgactttgaccaaagtcaaaacgacttatgatatgagagggatgaagtattatttttggcaactcctaataaaaatatttttatattaattaattacctctaatgtgcctgatgagccggaccatccatcgttggagatggatggtttgtagtgtggatggccgaaggagaaggcacggcgagcgagctcgccgacggccgccggatcggaactgttccggccgggcagctccctcgcttccgccatgtctggtgaagctcttgatgcttcgccctggcttcattatctaggacaagaaaattaattaatagcatggattttattatatcttttcatgtcttgatcatgagtaaagaaagatcaatattttcttttcgtttttagagtaaggggagacctgaactttttggcggtcatgatcaggaagatgattcagtgccggccgctcgttgatgtccacgcagtcaatcacatcgccatcgtcgctctgattttggggaagaaaaacacacacacacacacaccagcagaccaaatatgaattcaaaacaggctagtcaaacatactcataaattgcacgcagaaaatctcagatgaataatatcataaaatctaaatttgaaaagttgtatacttccgcacaaccttcttttatacagtagagaaaggaaaaagcgcatgttggattgtgcacatttacatcgatcaactcaatatacacatttctcagaagaacatatatatcgacacaaaaatatttaaacccactggtcgattctcgattcgacatgaaataaaaattccgcaaaaaaaattatattatacctctatggttttgtgaaccaaagcccttgctccagtagtaaacaccacaagcagcacagcaagtctgaccaggaggacaggcgtcacagctgctgtgcttgtaggctccatggctttgatataatattcttctgactacggaagatacatgtcaatggttggacgcgagtgagaatttaccactatatataagcagtaacggcaacaaagaaatgcaatgtattgatgtatatacaattatacatggtatctatctattttactcactaattaagccacaactcacgcccgctgattcctatctattttattactagtattatgccaggtccctctgattcctatccattttataagtagttaatttgctccaaatatatatatagtacagtagtatatacttgtgttttttttacctggggcacgtgtaatacaatctagagattatttggaacttgggattttttatagtaattagtttaagactcataaagtttatgtaaatatcaaacattaaaaagtatccactactgaaaaaacgatttttttttacgagagccccctatgggttgcaaacgtaccgtaactggcgacatctgcaaaaatcaaccttcattatcgcatacgactccttaagagacctcatgttcagtcttgcggggggtgcgcacgactctaccgcgcgcgtcgttcgctgcccccctctccacgcgcgccacctgttcagtcttgcggggaggtgctgacgactagttgtgatttagccattccaggttgcatcggcatccatagccgaaggttgaagacggcggtgggctatacgaactgggtctgtagctctactaggctgggctggatcgaagagagacagtttgaacagagggaggcaacagactgggttgagactaaaaagaaggaaagaataggcggcccaaaaccaaggaccaattttcattaaccttttcaaactatctattaacttattaaaagaatagaaaaaggagcctctgtgttcgctctcacgacctagaaattctcatattaatcggagaaaaaaacagaatccatattgaaatacaatttagaaatagttgaaattcagaattaaaaatataaagaatattggaagaggagactagagtccatatagaaatacaatttataaataacttaaattcgaaattcaaaataaaaaaatattagaagaagagtatagagtccatatagaaatacaattaagaaataatagaaatttggaattaaaaataaggaatattagaagtagagtatagagtccatataggaatttaaaactaactaaaattcagaataaacataataaaattaaaagtagagtttagagtttgtataaatatacaatttacaaataactaaaattctaaattaaaaaatatgggaaaaagagtctaaagtcaatattggaatataatttagaagtaactgaaattcgaaattaaaaattaaagaatattgaaagatgtgtttagagtccacatagaaatacaattaaaaataataaaaatttagaattaaaaataaataatattggaagaagagcctagagtctatataaaaatacagtttacagataacgaaaattaggaattaaaaaaataaatatggaaagacgagtctagattccatatataggaatataatttacaaataactaaaatttgatattaaaaataattaataactaacatgtatataaaatacaatatgaatattacacattagtagtttcgtaaagttagtacaaaattgaaaattatgttgtcattttaatatatttgaaaaatacattgagaaaacatatatgctattatatgagaaaaaaatataatgatgctagcgcgcaatctgcacgggacaccatactagtataatgcatagtgaattcgctgctcagttcctattagcggttatattataaaaaaaaacgtttttatccgttacaactgcacatgcatattttcggtgcaataactaaaacgcccacaacgtacggttcgcctcccttgtcgctgtgagagtccattctgagcacagcgcccagcaggcagcaacagcatgcatgcataccccaagccgtgatatatatagcgctgcaccgctcctcgcctcgccgccggccggtggtgccatcgtccgcacgtacggcgtccgtcacccggctgggaggtctcacgaaattacgcacttccctgagaccttccccgcggtgacgcgtgcgtcgtcagccggcgagccggaccaccacaaataaaggcatacattgatacatatggatatatatacgacatcacatcacagcacaataatggcagcctcctccgtcacggggagccgccgcctctgcattctcttctacctcctcactgtcgtcgccaccgtggtcaccgcggcgtcggcgcacacggcgcacaacgccaccgccgacgaggagtactgggagaagcgcgccgaggaggcccgctcgttcaaccgcgccgcctacgtgagcgaccccgtcgccaccctgaaccgcttcaacgccgacgtgctccgcgccaccacgcgccgctcgctggccaggtacaccggcccgtgcatggcgaccaaccccatcgaccgctgctggcgctgccgcgacgactgggccaccgaccggaagcggctggcgcggtgcgtccgtgggttcggccacaggaccgtcggcggcgccgctggcaagatctacgtggtgaccgacgccagcgacgacgagatggtcatcccgaggaaagggacgctccggtacggcgtgatccaggaccggccgatgtggatcgtgttcgcgcgcgacatgatcatccagctccggcaggagctgatcgtgaaccacaacaagaccatcgacggccgtggcgcgcaggtgcacatcaccggcgcccagatcacgctccagggcgtccagcatgtgatcatccacaacgtccacatccaccactcggtgccgcacggcggcggcatgatccgcgactccaagcgccactacggcctccgcacgcgcagcgacggcgacggcatctccatcatgtcctcctccaacatctggatcgaccacgtctccatgtccaactgctccgacggcctcatcgacgccgtcagcggctccaccgccatcaccatctccaacggccacttcaccaagcacgaccacgtcatgctcttcggcgccagcaacagcgacgcccaggacgaggtgatgcagatcaccgtggcgttcaaccacttcggcaagggccttgtgccgcgctgcaggttcggattcttctttttattttaaagaattacacagtacaacgcacgcatactcactcctatgaatgcacgcacgtaaaccctacctctgtgaataggttcggattcttccacgtcgtcaacaacgactacacgcactggctcatgtacgccatcggtggcaacatgaacccgacgatcatcagccaggggaacaggttcatcgcgcccgacgacttgaacgccaaggaggtgaccaagagggagtacacgccgtacgacgagtacaaggagtgggtgtggaagtcgcagggcgacgtgatgatgaacggcgccttctttaacgagtccggcggccagaacgagcgcagctacgaccagctcgacttcatccctgccaagcacggcaagtacgtcggccagctcaccaagttcgccggcacgctcaactgccacgtcggcatgccatgctaattaactagacatatcagcaacgatatggaagaggacgagagaaagctaattaaccatgccttaatttgtatatatatgaaaatctgacaaatttgtacatgtgtaaaactttataattctcaaaagagaaaaaaaaacgtacattatatacgtatatccgtgctccgaatccgactcaaatggctacttaattacgcgtcctgcactgacacggactgcacaccttgtcgataaatagggaggcgtacgtggagcagagtgcgtacgtgctcatcatttgatcgatcatggcgtcgtcgtcgtcgtcgtcgtttgccatggacgacggagaagcttacctccgcgacatgacggcgatcaccgagttgctcgacggcgacatgacggcgatcaccgagtcgctcgacggcgacatgacggcgatcgccgagttgctagaccaggcccgttcctacagcttcgcggaccttcagtcacatgatccgccggcggcggcggcggcggccgtcaacgacgacgacgacaatgtatccgggctgatgatggcgatgatgaagacggtggatgcgccggccggcggcggcgacggcggcgactgcccgatatgcctgaacaacggcggcggcgaggagtggaaggagacggcgtgcgggcaccggttccacgcgcggtgcgtggcgaggtgggcgcgggtggggaggaaggggatgagctgcccgatgtgccggcgagacatgatgtcgccggcggtggacttgctggtgagggatatccgggccttgtacggcgacgaggagcttagtgatgtgcgcgagctgctcgaggacggtctccggcagctcgagattagcagctcgatcgccggcggtgcggaagaagcagcatatagagcttcccaggcttaattaggtctccattttgtggacatcatatgtgcatgtacatgatgtactccccccgtttcatcgtattatgagttgtcttgaatttcttcttatttaatcttcttttaagtttggctaaatttataataaaaatataatacaattacgaaataaatatattattaaaatagattcaaggtttgatttgatcaaattaatttgatgttttaaatgttattattttttctataaatttaatcaaacctaaaataattgtttaacacaatttatagtataaaatagagggagcattatttcatgttagtccctattatttagttctttttctagcctactaataaactttgacttacaataataaagaaaaggtctcctgcttgttctttttttttaacggaaaacaacataagagtgccttttcattgaatagagcaaaagaaaatacaatccctaggggtaaaaagaaaagaagttccatgtattctatacagagcagaagaaaatacaacccctaggggtaaaaagaaaaagagttccacgtattttatacactatacagagtgcgggacgaactcacgtaaccgctttgcccctgccaaagcttagaggctggcctcttctttgattttcgttagaaggaagctcgttgccatctctttatggtcaaagatcctccgatttttttctttccagatctcccagacaactaacagaatgagggatctaagtcccttcttcggaaggccgggcgtgtttgctgtgttctcccaccactgttggacgaagtgtgcttcctcccattggactgcttgttcttagaagtctctacggagaagatgttttcggttcgacatgctagttttaagaacttttgatgataatgatcacgatcatgatgcattaacacactagatccactgattgattcattttagtccgggtaacctccagtaaccagtctagaccgtgaaccttatgtttgagccttgtggacttgacttattcaaccttacccaattcagcctactaccttatttagcccaaactgagtccacaacagttcaccttctttactatagcaggcctaaatggaacataaatttttggacagaagggagcagtatctggcaatttgatcttgtaaactcctgctcaatttcagattaagatcccactctaagaaagcaaattattcaagaaggtataggtgcaaactgttttgaagaatggatatcatgacataagtttcaaaggaaatggtgcaattttgatctagattaaccatattttgttcagtttacacatgcagctatccagatcccagacacatacaccattgggaaagatggatattcagtattcttactgcatcttctgaagaacggacctaaaactactgcctcccgcataccccagggagttgcctgcatgcgagatcaatctcttcttccgtcatttcgatggtgtcatcactgtcatactgagcatcatctgatctaggcttgctctgatgcttcttgtcattatcatgcatgtgggcaaactcagcctgataaatctttttgcatttgattgctagctgggagagttgttctttcgataacgatccctcttttcttcttccatcaagttccgccagttcattgatgacatgggggacaaagctccactgctccgccactcccttgacatcctaaatacaaggttgaccatggtcaactgatagtaacaacaagtgtgaaaggaacattatgtttggtacattggtgttgattatctgaattgagttctcttaaggatcacaatggaagaataactagattataatgacaatttgactcagattaagattttggcatctcctaacaaggaattcaatcattttagattattgaaagttagcggctcagtccacagatcacttggatatatcagagtttttgtttattagtaatagataaagcaaacagttccctttaaataaggaaggatattgcattcttacattcccttgcttgagagattctatggcatcttgcaaacaagtgataaccccttcagcagctattgccttcaactcatttggttctggcttcagaaaagaagaaagaaagtcagatagaaaatcaagaataactctggctgtaaagagggctaagaaaggcagagaaactactaaaaaaaactaccagatatgctctacaaactagcatttgtcaactgatagcaagattatttgctgtcgttttgtcatcacacacaatacacatttgatttttatgagtccaccttaacagtcttaatctggagtaatttccattcacaccacctaaaacaacaaagaaatgccaaacagatacatgttttctctctctctagaaaatcattggacattgattagaagtgcagatgatctcatgacggcctgagggcatatgtcagtgcttgttgaattacttcagggaacatataacctgaacttagcagtaaaaatgtaactcaactttcaccaaactttttaaccctataaaatgctcaccttctcttcttggctctctaaccatgatattgtctgtgctaaatcattctttgcccattgttttatttttgttggagaaaattgcttactagtaacatctgaatgttttgcctgtaaataaagaaattattattagctgttggagaaagaagacatgaaaaagaagaagaagaaggtattcattgttacaaaagaagagcatgttgatatgctcccaggaacacatgctgcattcatcttattctatctagaaccatttctctgatttaggccaccttaacaaggtaaaaaaacagagcaaaaacatggacgtttggtgagagaagagtctgtaggcaaaaatattggacatgacttcctgtcgaaacgaagtgttgacagattttttttcagaaatatgtttttttaacagaagttgatagttctaaaaaattaacaaacgacttccctagcattaagcacatctaaagacatcacataattgaagtattcaggttttggctggaaatatgtttgatttaccagctagtcaatatctaattatacagtttactgtgaataagtccaactgttcaagcagccagctaatagttaccaagcataaattcaaatcatatgcgctccttgtggctatatcactagtttattttcaacatacctctatgcctgcagagggagatgtcttgatatgagatcgatcaacttgcttctgatgctctttatgtggcttcttctgatctacaacagaagatcaaaacatagttagaaaactatagcttatacatttgttaactacttcaaattcaagttgcgtgacaaatagaatattcaagtactccaaagcttccactattactcaactttcacaagttagtttataggcatcagtcagtgcttcattgagggaaagaagctggcccgctcatctcggtataaagctatgtctaataaatgagtatccctgaattactatgagtctccaatgtcatcatgtaggatattagagatgaggccaagttatgttgtatgacaggagccaaaggccttagtagtatttggccatagaatgtcgtagtacttttctatttctttggcaagcccttttttgtactaaaatttgtccttttccactctttcccttcttcttaacataatgatgcgcagctctcctgcacgttcgagaaaaaaatgttgcagctacaacatgtcctaaacctagattctttcaacttggagaggaaatatgatggatgcttagctttattttagaatatatttgtcatggaaatggccaaaacattagtaacatgaaggatagtagtttttttcttattgaattattatcataaacaacacaatataggcatgcagttagcacatatcactgaatttcaaaaggacccataagcataagaacttagaaataagacatatattaaggacaccacagcctaataataataagtgataaattaataaaatgatcattaactccatagaccaaagaaaaattccaaagatttaaagttttcatgttactccaaagattttcgtgaagcaaaacggaccacctaaatgaaataaacatcaaacataagggacactcagttatcaccttcgtcagattcaactagctctttattttttctccacggttttccaacatgcataaggtaaggctcaatatcaacaagttttctttggctgtgagattctaagatccagtcctgaaacaaggaaagagagcaattgtgattctctaagcaatcctaaattcaacttaattgatggctgccagcgcatggtattacaaggtaaattacgatttctgtcgatatgctaggtcaatcttttaagtttaccaaattgccaatgtataaaatagcatgatttcctgatatgtatttaatgttgccaacttgccgagagatttacatttaacatttttaggcataacatggacaaggcgatacaaattacttgctcagagacaaggaagaacatctgcaatctttatacgtggcattgctgaacagactggcttttaatggcacatggcttctcttgaacagaaacaaaacagtacaagctagtacccaaggcgccacagtgtacaaaaaagaatatactatattcctatttgcaatcctatgtttcagactgaaagaccaggtggaggcaatggaactattgcgatggaagatgcaagttaacatgatctgtatgtgactttgtgttctttcttggcattctaatttctaaatggaattttggtcagttggtcatattgcagagcagtggttaactattcagaagttaaaagtgcatcaatctagaactcatggcatcaagtaggaagaactttttgctgcagtaaagaatcaatgaaaataaaggtaatattctgtcaactctgtcgtgcactgtattagtatatatggtagcatgcatagtaattctagtttttaggataagtgaaatatcagtgtccttctgatataaattatataactatattaaagaaagctaacaagaacggctaaaataaggatccaccttcgagacaatggttccattgttcgattcgacttgtcgaaacttgggggtattggcaaatgcacaaacgagaagtgtgcaatctgatgtccaatcgggtcgatactcggctcccatatccaatgcttgggagcgcaatgtgcctctttcagggttcacaaaccctgaaagtacaaagaccaccccatcctgcccaaaacaaacacatggaatcgcctcagccatacatacatacatcaagaacaacatatattcggttcagttgtgattagaccgccagagggtttagataataagtaccaaaagtttggagaaatccgatcctttctgcaccttctcgtgggtggccatgtgcttcttcttgcctggattttcctccccgtctttcgaacccatccaagaagggagattcctcttggatgactttcctctcccgttgttaggatctgagctcgattcaggcatactgactacgaacctgaccaagaactcactgttcagaacaattcaacacggaagaaactctggttaaaatccactccgaacacgcacagaaccaaatcaaggacaccaagattcttacagaaaagagaggggcgattcacctcttcaccccttctttgccgctccaatctcgtccaccattgaatcgcgtcttgcgaagttgggaagaacaaggagagggttttaagtcgcaaaaacaataaaagaaaagaggaaaaagaatataatatgggccaggccttagttcacgtgggcccacatcgcggcccaacagctggggcccaaaagttggtaatcgtacccgtacgttaacctttttgcaaaaagggacttaattaataattctcaggggctaatttgaaatggagtaataacaaaaataaataaaattacgcacaaaaccccctcctcatcttggtgtttagtttagtcctttccttcctcccaccctcctcgtcgctcccccgccgagctcgcgatcggattcgcttcgcctccgcctccgcctccgcgtcgccgcgccgccgttgccgcggcggatctctagggtttagccccccccgcgcggcccggctcccccgctctgcccacgccgttgccgccaccatggtacgtacgcggatctgaactttggccagcgcgctctcgctgttccgatcaatccgctcgcccgttttttttttttgtgtgtgttgggaagtaattgggtgtggtttggggagagatctgatcaaatgttgttttctgcttgtgcttcctgcagccgctcaggttggagatcaaggtgcgccactggctcgggctcggcgagcccgattccgctagatctcggtttgttgctgtctcagttggtggttagttttgtgctgattttgtggttgttttgtctttgggatggtgtgattagaggaagtttgcgcaacggtcggagagggtcaagtcggtggatctgcaccccacggagccatggcaagtgacctgcatttctgagggttttagcacattttagcctgatttgagccgttcgtactaccattttgatgtgcttttgcttcattatttgattattaagctgtttttgcattggtgtaggatcctgtcgagtctttactccgggagcgtgtgcatctgggactatcagtcgcaggtaagagttctagttgcattttaggttcattgtttccccattaagcaagactaagactcaactacttttgaagtaaatatgaatattcaaaactgtactcatgctaattgaccgaagcatgattgtgcataaaattagggcttctgtttctataatctatatggtttcttattagttttgcatgtcttgagctcaaattttgctttacaacttaatcacatgacggatgaaggggtatatgctaagtagttttgtcattcatccttaaatcatgctttccagttagtacaaatcactatgggaggaacatagaagcatttctcaccacattattacatcttcacacttatgttatactcccactgaagtttaatgccatctgtggctaactgatccattatatgtaatatatattatttttggtggctgcaaagcctcagtgccttattccaatgtaatatgttatttttggtggccgtcaaagctttggtgccttactccaatgtaacatgtaagccttttacaattttgcattgacctataggatgatcggttgatgcctagtcttatatcatgaccatcattgtttggatttgaaccacatagaattgactctgcatttcaaatcagcgtattccatcacatgctcctgcaatcctgcataatctatacttagcgttccatttgattattaacatgttttccttggtgtatgtttgcagacaatggtgaagtcatttgaagtttcagaattgccaggtactcatctgcttatgttcacatgaaatgaaaatctgtcatagaggttgaattgatgctaacttgtatctgatcttaatttcagtgcggtcagcaaaatttatttcacggaaacaatgggttgtagctggtgcagacgatatgttcattcgtgtctacaactacaacacgatggacaaagttaaggtttttgaggctcatactgattatattagatgtgttgcagtccatccaacacttccatatgtgctttcatcatctgatgacatgttgataaaattgtgggactgggataaagggtggatgtgcactcaaatctttgagggacattcacactacgtgatgcaagttactttcaatccaaaggatactaacacttttgcaagtgcatctcttgaccgaactacaaaggtctgtttcacaatctcttatgcagtggatgttattcacaatatatggctttttatgaggtgatttgtgcactaatggttctaaaactgaaacaacagatatggagtttgggttctccggatccaaatttcacactcgatggacatcaaaagggtgtgaactgtgttgactacttcactggtggtgacaggccctatttgatcactggttctgatgactccactgcaaaggttttttttttctatccacttttgagtgttccaagtatccacgattctgtgcagtcctaagatggtgtggtcatggtgaaccaggtctgggattaccaaacgaagagctgtgttcagacacttgaaggacatacacacaacatttctgctgtttgtttccatcctgagcttcctataatcattactggatctgaagatggcacagttcgcatatggcattcgacaacttacaggttgctttcacagtttcacttgtgtttttgcttgttgatgtggactgtttcctagttctcattgtttgctattcaagtgctctctacgaaagaaacaacttgtaatttcctggttctcatttctggattctggatattttgctttttctcttggcaacctctcaagtcctgggttcaaaatttgatccaaaagtttttacatattttcttagaggaaattttccccaatatagctttttggtataattatctcataactcttaaacatattatgcatgggctattcttacatagaaaagctccaaatctatgttagacattggaaaagagggtagctgacagtgtaatctatgtaccattcggtctgtttttgtcattaatttatctgttcctttttcttatggtctggaatatttgttagttgttggcagctcactacttaatacttatgtcagttatgattgccacaatgttgaggtgttcttattttttaatttattttgtagacttgagaacacgctaaactatggtcttgaacgagtctgggctgttggatacatgaagggttcaagaaggtaaacagaagatcctttgcattctgcttttgtgttgcattgtaatcaattgcttttactactgttctgcgtcactcctcctttcaattttttaacaccattcgacattttatgatatgtaggatggtaattggttatgatgagggaactataatgataaaaatgggacgtgaagtacctgtggcaagcatggataccagtggaaaaatcatttgggcaaaacataacgagatacagactgtgaacatcaaaactgttggtgcaggctttgaggtcagttggcctgtttgcaaacagaatcgatcaatcaaacagagaagctgatctcatgccctactatgttttcttattcaggttacagatggggaaagattgccattggctgttaaagaattaggaagttgtgatctttacccacaggtatttttgaatgtcacaactcacaacgctctttatattttactcctgatactgttagcagtgctgcagtaacctatgtgtttgaacttctgcataaatagcatccattaatctcacatcagcatatatagtggttatcatccatgcctgcagcttgtgaattgtgatgacttgtaaatggttatgctaataagcttagtgaaagaacatatggaacttgtagttcaataggtgacattgtccaattagtgttaattgctttgattgatagttttcacacaaccactacctctattttgtgttccttgtgattccttgatgtgatattagactgagatggctacaacatttcttttctttctactaggtaatgttagttgtttgtcatatcttgaatagtattcaatcttactatgtgtcatctttttgtttggtcagagcttaaagcataaccccaatggaagatttgtcgtagtttgtggagatggtgaattcataatttatactgcattggcttggaggaataggtcatttggatctgcattggagtttgtttggtcatcagaaggagagtatgctatcagggaaagtacatcaagaataaagattttcagtaaatcatttcaggtttggcccacattgattgtagcctttccttttatgaatttgatcagtaaaactgtagtgtttcatttcttcaatcaccactctggagaatgcaccatcttcacctgtttatcactttgcctttaaccgtgaatttacaccttgcaatattcaattgagatgtctaatgtactattgtttggctaactattgagttaacttttatttaatcaataaaggtttctggttaacacgagcgttcattcaatcaaaagttttatgttgtgcattttaatgtctgttcatgattcatcaatcatcatgtttggtgaaaggaaattacatactgatttaggtttgcatctcattggacctagtcacctagatgacagtttctttttcttacactatatatcttacttcctgacaatctgttgtcattcagccaatcagcctacatgaatactccatttatgtttagctataacattgatctagaaacaatttaagcgtaggttgatttaattagttactatgttctaaggaccttttattaatgaatttggcaaagaattgcacatcatattctgttggcatttatcaatattgtatcttctggtttgaatgatccaatatgcaggagaagaaaactattcgccctacattttcagctgaacgtatttttggtggaatattattggcgatgtgttccagtgatttcatttgcttttatgactgggctgactgtagactaatacgccgcattgatgtgaatgtcaaagtgagtcaaatattatctattgatatttatagattgatacttttaacgaatttcatactgaaataactagttttgtcactgtatttttagaacctttattgggctgatagcggtgacctagttgcaatagcaagtgatacatcattctacatactgaagtacaacgtaagttattgtattatctaaatgttcattatgttatttcttttctcctcttgaatgtgttattgcgtgaaagttctttttttaccatggcatgaagttatgtttgtaatttgtgttcctacagagagatgtcgttgcgtcttatctagaatctggaaaacctgtggatgaggaaggcgttgaagatgcttttgagctgcttcatgaggttaatgagcgagtgcggacagggatctgggttggagactgctttatttataacaattcatcatggcgcctgaactattgtgttggtggcgaggtatatattgtgtgctccatgcaagaatttttattttgttaatgtattttctattgtagtattttgtgcactacaaatttatcccgttgtacatttacaggtcaccacgatgtatcacttggatcgccctatgtacttgttgggatatctagcgaatcaaagccgagtttatcttattgacaaggaattcaagtgtgttttcttgataatactgcctgcttattgtctggtgttgaattcttgaactaacatatttttcttgttgcagtgtcatggggtacacattacttcttagtttgattgagtacaagacacttgtgatgcgtggggatattgaacgtgcaaatgatattttaccatccataccaaaggcgcaatataataagttagttgctgacttttgatccaaaacaatgagtttcttttattttggtacctgtttctctttgaacctgttgatttggtttcttaataattttgttccttttttaaaagtaacaaaacaatgatagatggaagcgtgaaaatacatttatatgctaaattacaattacatttcaatagctatcatgatgtgccttattgaatgactgttatgtagcacatcacacctaaaatagattcaactgttaggagtattggcatctagttttttgaaacaaaaatacatatattgtttctactctatcttcattgtagtcgtgtaaaggagtactgattaatggaagtgccaaataacaaaatcataaaaaatttcctagcagtgcattttgtcctgttgtgttttgatggtttcttactcctcccattacttttcatatggcagtgttgctcatttcttggagtcaagaggtatgctggaggaagcacttgagatagctactgatgctgattacaggtttgacctagctgtgcaacttggaaaattagaagttgcaaaggtacagaacatgttgtattgtgtttttgttccacattattgaaataatgttctgaaaggtcttccatgctgtgaagttcattgctaataaacagaatggattctggacattttctgtgcaggctatcgcgatggaagcgcaaagtgaatctaagtggaagcagttgggtgaactggctatgtccacaggcaaggttagttcataaatcttgtgaaagacttttggtatatgctttcaaaagtaatgacagtgccatagtatctaggtgcttgttgtcaaggtgctagattacctggagtgcattattgagttcgaggttttgtcctctttagacttagaggaaaaaccaaactagacatgcttttggaaatcagctgagacttgtcctttatcctttcacgatctagtttctgtgcatagaaatatggaaatggcaatagttgacactactacactagttcatattgacatcatttgatgacaattaatgcaaatcatttatattctgtttgttaccttgttttctgactttaaatcatttcacaacttcaacagctagatatggcggaagagtgccttgtgcaagcgaaggacttaagtggcctgttgctactatattcatctcttggagatgctgagggaatcgagaagcttgcttctcaagcaaaggagcatggcaaaaacaatgttgctttcctctgtctctttatgcttggtaaattggaagattgcatacaattgctgatagacaggtacatgtacatcctgtttgctgttatgaactccccattgtagtaaatcatttttcaaagctaaacctcatctatgtattatacagcaatcgtatacctgaagctgcgttaatggcacgttcttatcttcccagcaaagtttctgagatagtagcaatatggagaaatgacctcagtaaagtaatttcttaatcttctgctcttatctttgcattgaaaagtgtgcttccatccagaaaacattttctgttattgttctggttttatctattcatatgttccttctgtacaggttaatccaaaagctgcagagtctctggcagatccttctgagtatccaaatttatttgaagactggcaggttgcacttactgtagaaaagaatgttgcttctcggaggtaaaaattaccagagaagctgctttttttattattaccatgtaacgctaccaattcttttggaagaaactattgtataaacaaacctggtacaatgataaggtctctttcttcagggtccattatcctcctgctgatgagtacttgaaccatgctgaaaagtcagacatgactcttgtggaagctttcaaaaggatgcaggtcattgaagatgaggaaacagaagatgcactagatgaaaatggagagcccgatgaagaggtattgcgtgtggagtgtgcattttgctatccatgttcaacttattatgaaatttttcaactttcctttctagtgttgatgaccgtgtcactcaaccattgttccgtttatcctttctccttgattaaatgtctgtagtgctatattcatcatcatgttctgaaaataataacataggattcctcataggttttggaagagaacaaagtggaggagagcacagatgaagctgtcgaagttgatgctgatgagcctgaagagaccgttcttgtaaatgggaaagagggtgaggaacagtggggtacgaacaatgaaggaacttcgtcagcctaaaagaattgtttggcaagtgtaaaaacccaaattttgtctgcggtgattcactagctttgcccccaaattataggactgttgaacctttctagtacttcagtttttgaaaaagtaaatctgacccctttggaattatagaccattaccaacagttagcaaattgaaatatagatatgcattatgagatgagttctattattatattttttttaaaaaaaaatattctgtatgttctgctgttttatttgctcctatatagcgtatattggctgctaagacgctaagacaaggatattcatccatccaccatttgggcctgatatgtagggtcaagcttatagctagcttatttttttgttcttaaaccagtttttttattctaattattgaactgaatttattcttttcttttctccttgcagtgctaactgaacatgagtaaggaccaaggatgctgtgccgttttgcattggtgatgctgtgccgtttgagctttgatcttatcatatccttcaactgaactccaaactcaagacatggaagcatgcttgtccaatggtatcaatccagaccggcttcttttttgctgcaatataggtgattctttcgtcctgcaacattttcatacccactcttcacgtcctgaaatcagtgggtttgggtgcagagctggttgtaacgaagggttttcttaataatttctatagagatgtgtagtatatgccacattaccatagccatcgcatgtcttctaggagatcaaagttttcgttggccatccactgtaatttcatgttattggacaaagtttacatgtagcatatgattgtggtgttaaaagctttccgtgtataattctctgttggtgctttgccgttgaacactgctgttgaaaatgctgattccttggaagagttaatctatcatttccatcaagtgtatagagaagagaatactgtttcactcgttttgttttactcttttttttttgttggctcacaccatcatgctaggatgaagagtgctttgtgtctacaaagctaggttttagcttgtaaaattttcaatggagctaaacaagttgatttccgcatcctatggtgcaatctgacgaaattaatccgaaaagcaaatgagcctggagccacccttgattaatttggtcaataattgggcaccatccaccaccttgggtattgcgtttcaccactctagtctctagcaacggaaaagaaaatgggcaccaaagcctaatcaaactgaagattcttccctaccatgagagtttccataacgacgacggcactggtaaagaaatgccatggccacatgggatgaatctttaggctgttagtatacattcctagttttatttgactatttgttgtattgaagatcgaagggacctcagttgactctggaactgatcataggaagtgatgggctctcttgtggagtttgtcaaccatggaaagtagttacatcattttcaccattatgtatggttcattccttccctgtatgattgctatagctatgtagccaatatcttatctttcttcttttgaaaagaggaaatttaattaggagttgttttctacgacaaatatgattttactcacaaaggacgtactagtaggtgtgtacttgtggtgtactgagtgatggtgtgcatgtgcatttcttttttaaaaaagaagtcttattgcacccaaatcccaaccaagtacaattatatatggcaggtagttcctcttttgatatgtgagcaacagtatgtgctcatctatatgatttttaagatgattttaatggtggtggtaacgaatatgtcacccacctactatcattctatttttttcatattaccctttcaatttcttagtattacataacaactagtaaatttaaatggatagtcacatataaaataaattaaggttagtcttccctatagaaaaatgtagacaacaaatttcatggaaactatgcttttatttattttagaaaaatgttatgacattttttcttttatccatagccaagtacgtgtatttacgtagttatgaagaaaagaaaggcatgcaaccagtgtttacaaaaccaacaaaaatcagtcggttttcatgaaaataagacttctcgggcttgttcgagaacacaaactgcccagtttcctggtcaaactattttttacaaattttgactggatttttaacggtagtcaatactccaacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgggctnctgtccactctgcaaatcaattnnaacat

SEQ ID NO: 3646 - DNA, 908 bp, Oryza sativa
cgtgattgatatcagatgctcagtgacacattacgcaactcaagcgagcatgctcacttagtaggcaccctaggctgtacactttatgcctgcggcttggatgttgcgtggcatcgacagcggctaacattttgtcaccgggagcagatatcattaggattggcagatcgatcaaaaccatacaattatggcgaaataaatccatattaatttcatgaatcatcatcatcatccagggctctgctgcacaacatggaatggaagtgggttaaatgctcctgatgcctcacaaacctagctaacctatatgttttatacttctaattaacgtgaaaaaaatagaaaaaaaacaacaacccgtttaaatcaaatgctagatgtgcaattttttgcgagtgagggatgcgcgcgcgcgcgcacatatatatatatatatatatatatatatatatatatatatatatatatatatatatatatatatatatatatataatattgtattatacattctcttgttttatagatgaacccttttcaatgggaaattgtatctttttcactagaaccaaccaccaaagaagtacatttgtatggttaacaaacataactccggggccccacttacattacaatatatatttcttgcacgcatgatcgagcactatatatatatttatatataggagacacaaagggtcctacactataatgtgcactcaagcagatatcaatagtgcttcagaaagttctccatgcggcgaaattaagacatatacaacagtgtgtttgtctacattttactcgtgtcaaaacatggagatgttggtttgggaactatatgatggccccccatttaaggataaccccgatcaacatttagttctaatacaatatatatgtataag

SEQ ID NO: 3647 - DNA, 56835 bp, Oryza sativa
  unsure (1)..(56835): unsure at all n locations
ggaataagaaggatctcggtgcgggtcgcagggtgtccagtgttaacggggaatcagcgtgcgccgaggtagagttgacctgcagggtgctgctatctaggtatgagagagagcgtgggcttttgtgcgcgaaagggagacaaccgtctggggggaaggcgccggaagcgcggtttagtgggataaagttggggagagtggcggacggggatatagagttggaggtgcatctgtataggggtgtgggcctatagagagatatacagacaggcacctatatatatgtatatatatatatatatatatatatatatatatatatatatatatgcacatatatatatatatatatatatatatatatatatatatatatatatatatatatatatatatatatatatatataatattgtattatacattctcttgttttatagatgaacccttttcaatgggaaattgtatctttttcactagaaccaaccaccaaagaagtccatttctatggttaacaaacataactccggtgccccacttacattacaatatatatttcttgcacgcatgatcgagcactatatatatatttatatatagtagacacaaagggtcctacactataatgtgcactcaagcagatatcaatagtgcttcagaaagttctccatgcggtgaaattaagacatatacaacagtgtgtttgtactacattctactcgtgtcaaaaacatggagatgttgttttgggaactaatatgcatggccaccaatttaaagtataaccccgatcaacaattagtttctattacaatatatatgtatatatacaacctaaaggagttattatattataaaagtattattcaacacggcactatcacagaacagcttatcagtgccggttcaagataactcgatactgatgatggttttccgtcccaaaatacaagcttgcgccatgcatatgttctcttggcactgatggggagatatcagtaccgggtcttacaaccattcggcactaattgtttggcaacatatcaatgcggagtgttgctattaatcggcactgatgagtaacgcatcagtgtcgggtcttgccagttggagcgtgataactaattttggtaggaaaaacatcagtgccgggtttttaagagtactcggcactaatgccactcacatcagtgtcaggtattcttatgatccagcattgatgatctcaaccatattatttttgtttatttaggatatatgaacttaaccttttcatacgtactcggattgcaacaaaacatatatgggaattgtagctctcaacgagatctatgattttgtagttgacaaatttttcatttgaattcttttaaatattcaaatccataatttaaatctcggtaaggatggctcaaaaggaaaaaaaaatattcatttgctaacaagattgatgtgtaggtgagttggtaaagataggtgcatgagaggagaggtttttaggttcgaatctacaccatgacaagaattatatttgagttgaagaaatagtggttgcaccttcatatatacatagctatacgcttcttgacgtcaattcttgtttgtaggattatttacacttgcatcctatttgtgggtgtgtccaatgtctcacttcacagtccatctctcagtcgtgccgaacaatgtctcactgcacacagtccatctcagtcgtgccgaacacatataatgtactcaatcatgctaaagtgaaattgttgcaacataatgtttgcacaagacttcaacagagagatgaacgttgctaagcactcctgtcgtctcacattcctataggagaaatgtgcatgatatggagaaattcttttctctgaggaaatccttgtctcttttctttgcggggtgtatggatgactcatttgatatactttcagctagaaatcttatgttgttgagttttgaattttgctgcgccctcttacgccaaagaaaagatcgattctttttttttgttgcattgttgttcttgtgtttgtgaatttggagtagtcgctacacaccatatatattgcaagattgccaaacattttgatttcaagggcctacatttaatagattgagattataaaatgttccatgcgactcccatgatatcctggacaaatactcattgttaatatatctaattgcttcgtataccaaatagaggaatttttatggtccagcaggcagtttcagtaccaaatctcgtccattggattgaagggatctaacggtgtttggcatggaagggcatcactgtaatttagcattagacaagcgattgaatcggcttgagtatcatgaaagaaaccctacgtcgttttctctcgatctgaaatcatgtcagcgctgctcctgggagggaggttgatttgctcttggtttgtacttccacggtggcgcttccttcgtcgctacaatcgttatcgttgatttcatcgccaccgcgttcatcactggagcggtcttgctgttgttgctgttgcactcctcgctaaagcgctcatcgacaccgcaatgctcgctgccagcaacaaacaaagttgggggaagtttcgatataacttatctgtggggcacgaaggatggtgagaagatgaaatccccgaaggtattcaattgggcagagatcaggaaggagtagatgaagacaaatgtgtcattggattggattcatgaggtatgatatattctttcattcaatgagaggacgaatatggagagacgaccgcgcgtggcgctagctgggagagaggatgagtagggagaaaaacactacgacaccacacaaggataagacgacacaagtgcgttccgaaagcatgcccatcctacctagcttgatcggacggtcagatttgatttgttacaacgagatataggtacctcaagataccacttgttggatcaaaacaaatttctttagggaaagattgtccccagattcatttatttggacagaagagtaagtttagtattattaaataatttgcaactatatagcttaactacgaagctaacggcccggcgagaaataactaggaagctaacaagttggacaatacagttgatcaaacgtgaaaccagaaaatttttacttgtacaaacatgcgatgattaatcttggtgatgaacaattgtcaaaggtaagtatttattgaaaatgcagtgaacagtgttttctgactgtcggtgaacagtgtgttggcactgggagcctgtcaaactaagcaatgcgcaccaattagatcggaggtgtccaggtagcccgacggtcaaaccggcagactctgggagggagtcagttttgggttgttttcgtgaaatttctagattgtttcatatttatgactactaaatcatttctatacatatgtgatattgtttgtgtgctgatatgagtcaagttggtgctaacttgtactcggacatagagtttcattgttgttcatgtgcatgtgttgcttgaggccgtgggagtatagctggtgatggattgggactaggcttgtgaaaagttaaggtctagacaatcaatgacatgatgcgggatgctcaggctagacaacatgcacgtggaggtgaaagttttcatatgacatatacctggtgttgtgtgcgtttagaaagagtcaaaatttggattgcagtacaagtttggaaacattagagtgcggagttgtatggggatgctctttccctggtttgataggtttcctatatatgtgatcaatattcctagttgtagttggattcgtaactaggggcaaccacgttgtgggcacaaatagaagaggggttgattctaaaagatttcgactttctaggagatgagtgttagggtttgcttcaagatttcaatcctagttcgtgaggagagatgagtccattagatgtattttgtaaacacatattgatgcaataaagttttgtcgatacatgtttttctgggttccgacacggtcagactgttaggattatgccggtctaaccggcggcgagcaaccggtcagaccggctgtggcgagaaggcagtaggcaaggaggtggcaatttgaccggctagactacattggtcagactggcggcaaagtgcggtcataccgttgtacgtatggcggtcagaccggctacgccaaggatttcatcaggttagagggtaatttttttaattctatggaaagatctaatacgaatgttatacaagggtaatgattatataaatagaaagtatagaaattttttgttgaactaatatacacattttaggaggaaatattatacgtagaaaatttaacattttttataaaaaacactactagaaaaataatttattgccacgaaaaaaattgtagcatcaatgctaaaattgttgcaatagatacatgttgccacaatcttaaaatcgttgctagccgtggtaataaatagcgtggtaataggttattgcaacgatttttatttagttgcaataaattttgttattgccataaaatgtatgtggcaaaaaatatatattgcaacacttcatatcgttgcaataaataactattgccaccactctatgtgtggcattagttctacgtaccaaattaaatatttcaatattaatttatcatcctaactattttcttttgatatcttgtcatggctaggattcgaacccaagatctctccttcacgcgcgctctccatgaccaactcacctacgcatcaattttgtttaaaaatacatataattccatttgagactgcttaactgagatttgaatcatgaatttgagtatttaaaagatttcaaatgaaaaatttaaattgtagatctcatcgagaggtataaatttcatataaaatttgtcctaatccgtgtccatatgaaaagaataagctaaattatgagatgataaattttttattgcaacgtatttgttgatcatggcaatagaaaatagtgaaagtaccatgtattgtgcaaattgccacaaaaattaaatttgtggcgatagaacatgtttttttgcaatagcaatatttttatggcgatagctcatttcctattgcaacaaaaatactgaataaaacaacgattgtaaatcattgcaacaaagtatagttatttgccacagaaaaattatcattgcgatagtacaatatattgccccaaattattttcgttgcaattaattggtggcaatagctcaattatcttgtagtgaaaatgaatgtatatcatttttaaggatggtaaatataatcattactcttgtataacattcgtattagatgatatgtaaacacaacaaatatgctataggtagcataaataaaatcaaacatatactcttttcaataaataaaatattttaaaattttgatgatataaaaataatcttgtcgtggaaaaacctaatgcaacgcactcatgaatataatagttttatacaagtgtctacacttccaataatatgctgcaaatatttctatattccttccacgcctaagagaaaaattgaccatatcttagctattaaacggtcaactaacaacatggctataaatgtgatcaaaataaaaattcaagggcatacaagggagtgaataaaacttacgggtatataagggatcagctaaagttctagggacatgtaagtaattttctcttaaatattttgttcacatagttagggaatatggccagaaacaagcaacaattaattaggtcctcagtgctaattggtttttagaattaacttgcaagcacctcaaaaaacacaactgcaattaatcttttgaattgtgtgtgttgatccctatgtagctaaacatgaaatcacataaataacctatgaaacttagagtggagacgatactaaatggcaacttcagtggaattaggaatgaaaagtagcaaatgtaatatataattaaaaaaacataatgggctattaataacttctctagtaatagaaaattttggcctacttcttcaactgtccaatgctgaaaatgtttctttgattttggtgatttcagcataaacatcttggattaatggacgatctccaggtgactccagagagcattgtagaccaattttcagcatctgtgtgatacatctctccattatgctcatttcatcaacgtcattatctaaatcatggttccttccttcatgtgtataccgtggaatgatactggcctctaaaatctcaacaacattatgtggatatgcacagtccactaatttgtgaatgtttagcccatccttgaacatgtcatcagttggatgctttcctgtgagcatttctagcagaataactccatagctatagacatcgcctgcagttgatatttggcaacccatcccatattctgcattcaatattaacagaattgttttaaaaatattctaatttgctaagctggcttcaagagacagtatatgaagtaagtattcagtccttaaaataacaaggttagtagcgaaagcaagaattcacatgtgaagaaaacaagcttaaatttcttggatgatagtcgtatatgtatttctgaataagatacgcctaaattagtcaatatgaagaatatatagaagcatgaatgttcacctggtgcaatatatccaactgaccctcttggtcctgctatgcttgataaactgttaagccctgctgaagaatggttacagataaagtcactaacatgagcaaccatgtcctcatccaaaagtacattacttggcttcaaatcacagtgaacaagcggaggtgtgcaccagttatggagataatccaaggcagcagcaatgtccgttgctatctgtataattgatcctagacctaatggtcttctttgtcgatgtttttgtacttttggatgaagccaactttctaggttaccattagccatgtactccaaaattagagctttaaactcttttcccattggatcgaaggaggaacatagactaatcacatgcatgagatttcggtgccgagtgttccttagcacctcgcattcagccaagaagttatttgatgctccgatttcgtcaagtttgaataccttaatggcaactggctctgcatcaattttgaatctacctatgtagaccaccccaaatgccccggaaccaaccaagttgtctgatgaaaattcattggtagctttggcaatctcagcatatgtgaacttccactccttacaagactgatcaatttgctttcccaggttatttcgcttcttgtaaagaaatgtggcaacacatatcattaggaatgtagcagcactagcaagtgggacaactattgggatgatataggatttcttgtttgttttggatgatgttgatgtgcaaagtggtaattgcagcattgaagaccctgtgcataattccctattcccttgtacgaacaccttacttgaattgctaaatacaccatatgtaggaaccattccctcgagattgttgaaggataagttgaggagctgcaaagagctgaatgtctcaaaaaattttgggatttcaccagacaagttattctgtgagagatccatctcattgatgcctcttaaactcgtgaaggagtccgggatactcccatttagaaaattcacttctaattgtagggactccaagtgaaggcactcaccaagtgtatgcggaatctctccagataattggttgttggaaatgttaatagagtcaaggttaattaaactaccaatcttagatgggatgggtccactaaatccattgtaagacaaatctaggccttttgaaagtgaggagatcgacaagagctcgggtggaatgattccattgaaggtattacatgagaggttcagcattaccaaatttttgcaccttcctatgcttgaaggtatggccccactaaagttgttctcttggagataaagctcacctaatttttcaagttttccaattgattgtgggatttccccagaaagattattgcgatgtaaccctaggacaaacaagtttacaaggttacaaagtgtttcaggaatgtcccctgagattaagttttctgctagatgaagaacagtgaggttattgaggtttcctatctctgaaggtatggtccctgcaattctgttgttggtcatatataacgtttgcaagcttcctgggagattgccaatggaactaggtaagattccatgaatcctgttgttatccaaatatattgccaccagtttggtagagtttatttttgaggacaaggatgtccagtctacagattcaaataggttggcaccaaggtccaactgggtcaagttttgcaaagcccagaaagaaggaacaacaccagtgaatgtgttatcacggacctctagcacttgaaggttcaaggcattaactaaagaggttggcagtgtgtcggtgacatgggaccgggagtatcactactaaaggcttggacaggagcaatcacccacgaggcctgacccccttgggggggtcgggcccgagggtgacgtggccgccccccctctttgtctccccgaggggtcagaccgcttccgtttcagccctgagggctgaggcgccccgaccccttgcaggtttggcgccgcatgagtgggttaggtgagcgcagcggggctcacctaaccgcatttattgcgattaggacaagcgcgtcacgccgcatgtaacgcagtgcagcgcgctcgtttatccggtctgtgatcagtcgcagaccagatcgtgggttaggtggcgacaggcggtctgacacacgcctcgccccgtcctgtcaggatgagcgcatccaagcactcgtccctagccggagccggcgtgttacctcctggagatggcacgttggtcccggtcagacatatgctaggcttcatcccaaccattacaagcaaggtgttgtatgaagaagggcaaacatgcagattgctaaactgacgcgtggtggacaagaatgaccgacatgaccggactgatactggtcatgtcatcagcagacagccatgatcccacgacgcgcctacttccgacgaaagtggaggtaggtatgggccgtcccatcagaagatgattcggtgggcaaccatgcaaatctccgtcgattcatgaagagaagggaagtcaaattggtaaaaagagaggcaagtccccacacaaaaaagagaggtggtgcatgtggtatccttgagatataaaaggaggaccttgcccactgatgagggggattcggatggggagagctagattgagaaaaaggggagagctagattgagaaaaaggggagagaatatttagagtttgagctctctcgctctcgagctctttgtaagcttcttcatacacagatccaccaaaaacacaggagtagggtattacgcttctcagcggcccgaacctgtatacatcgcccgtgtcttgagtgtttccactctcgcgaaccttccacagaccaagagcttagaacttcacccagggcccccggccgaaccggcaaaggggggcctgcgcggtctcccggtgaggagccccacgctccgtcatctggcgcgtcagatagggggctttgcgtgtgtttttctaagctctcgtattctttcgtgggcgccaagcttttcctgttcagcccaatggccgagcaagcaaacgcgcccaacctttctccgagcatcagcggagacgacggggagccaaacccacgccgtcgagctcgtactccaccgccccctccacgccaaagtcctaggcgggaggaggcgctcaagagggtcgaaggatccgcgacttcgacatccacgggtgatggagaagggcggcgagatggggagcgtcgcatcctcgtctacggtgacggcagcacgccccagggcacgctccaagctgcgggcgcgctcctacgtcacccgcccgtcgtccctgacccggagtctccagcccaacgttggctggacgacgttgccaaattggtcatgacggcgcggcagcgcctagatgctggtggacggacctccgccacaaagacctctggtactgctgccaccggctccgcgtcgtcaagacgaagggcgcggcgagcggcggccgctgttcgccattcggccgccactccttcgtcaacgcctccgacccgggaagatccgcgtggggggccggacgtccgcaccagcatcgagcgccggcgtaatggccgacgtgctgcccacgcaacggagggcgcctcctcgtccagagtgtcacctcaacacggacgcggggatcagccctccgtgcccctggttggtggtgtcggctgtagagcctttgtggcgagtcttcggaatgtccgttggcccccaaggttccggcccaccatcgccgaaaaatatgacgggagcgtcaaccccgccgagtttctccaggtctacacgaccgggatcgaggccgctgggggtgacgacagggtcatggcgaatttccttcccatggccctgaaggggcaggcgcggggttggctaatgaacttgccacccgcatctgtccactcttgggaggatttgtgccaacagttcactatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaaaatcgcctccaaagagccccagactaccgcggagctttttcagctcgcggaccgagtggctcgtaaggaggaggcatggacccggaacccctccggttccggtgtggcagcttcggccgcccccggatccgctgctcagacagggcgacgtgacaggaggaggaagaagaggtcagcccattccgacaacgagggtcatgtcctcgccgtcgagggcgcttcgcgggccacccgaaaggggaggcctgcgagcgacaaaaagaagaaggccagcgctcctagcagggagcgcccaaccggcaagtggtgcaccgtccacaacacctcccttcacgacctcgcggactgccgcgcagtcaaaagtttggctgagcggacgaggaagtgggaggaggagaggaggcaggagcgccgtgagggcaagtccccggcggttccttccggcaatcggcgaagtgaggccaagcagaaggcccccgccgaggacatcgatgatggcgatgatgacctaggtttccaagagcctggggccactattgccactgtcgatgggggagcgtgtgctcacgtttctcgccggagcctcaaggccatgaagcgagagcttctggccgcgacccctactcatgaggcgacgcgccgggcgcgatggtcggaggttgccctcaccttcgaccagaccgaccaccccctgtgcgttgcccggggaggacagatcgcaatggtggtttcccccactatttgcaacgtgaagctaaggcgtgtcctcattgatgggggagcagccctcaacatcctttcccccgcagcctttgatgctatcaaggccccggggatggtgctccggccgtcccagccgattatcggtgtgacgccgggtcacacttggccgttaggtcatattgacctcccagtcaccttcggtggatccgccaatttccgcacggagctggtgagctttgatgtggcggacctcagtctgccctacaacgcggtcctagggaggcccgcgttggtgaagttcatggcggcggtccactatgcctacctccagatgaagatgccgggccatggcgacctcaaagtcgcgctcgcttgtatggagcagcgcgcggaccacctcgccgctgcgtccaagcccgagggtggcgacgaaaggcttagcacctctgtccccgccgccccgaggcagcggatgatcacatgcgacgaggtcccggtcaaggaggttgccctgggcgacggcccgtccaagaccacacgggtcggtggtcttctggatagcaaataggaagacgcgctcgtctccttcctgcgggcaaacgctgacgtcttcgcatggagaccggcggacatgcccggggtccccagggaggtgattgagcaccgtctcgccgtgcggccgggcgcaaggccagtccggcagaaagtgcggcggcaggccccggaacgtcaagccttcatccgcgaggaggtggcgcgacttctggaggccggattcatccgcgaggtcatccatccggagtggatggcgaacccggtcgtcgttcccaaggcgaacggcaagcttcggatgtgcatcgactacaccgaccttaacaaggcatgtcctaaggacccttaccccctgcctcgcatagatcagattgtcgactccactgcggagtgcgaccttttgtgttttttagatgcatactctggttaccatcagattcgcatggctagggaggatgaggaaaaaactgcgttcattacccccataggaacttattgttatacgacaatgcccttcgggttaaataatgcaggtcctacttttcagcgtactactcgaatttctttgggtaaccaaataggacgtaatgttgaggcttatgtcgatgacttggttgtaaagacgcgcaaccaagagaccttactctcggatctagcggaaacttttgagagtctccgctccgcccgcatgaaactgaatcccgataagtgcgtgttcggtgtacctgcgggcaagcttctcgggttcttggtctctgcccgaggcatcgaggccaaccccgagaagatacgagctatagagcggatgcgccccccagcaaacttagggatgtgcaatgcgtcaccggttgtatggccgccctaagtcgattcatatcgaggctgggagagaaggcgctacccttatttaagctcctcaagcgctccgggccgtttacttggacggaggaagctgaacgtgccctcactcaattgaaggcgtatctcagctctcccccagttctggtcgcccctgagccaaatgagcccttgctactctacttagcggcgacaccgcaagtagttagtgcagcattggttgtggagcgcgatgaggaaaatcctcattccgcgcatccccaccctgtgctggcttggcccgggagagagcagggaggagaggcccccgagccaaacggtggcccaaggcccccgacgaccggagctggttctctgcccgcttgtcagacggtgccaggtgcccccgacccccaggatggcccggcggccactgcgggaaggccgcacctatcatcctctgaccccgaggctaaccctgtgctgactcgacccgggagagagcagggagaagaggcccccgagccgaacggtggcttaaggcccctgacgatcggagttggcctctcgcccgtttgtccgacgacgccaggagcccccgacccctaggacagccccgaggccactgtgggaaggccgcccctgtcgtcctccgaccccgaggtcgtcggcacagaagacaagtgcgccccgcgaggccacttggacgaagaacgcccctgggatgcggcccctggcgaagaggatcggccccaccgaaaggtgcagcggcccgtttacttcgttagtgaggccctccgggacgccaagacccgataccctcaggcccagaagatgctttacgctattctgatggcttcgaggaaactgcgccattattttcaggcgcatcgggtaaccgtggttacgtcttaccccctcggtcaaatcttgcataatcgagagggtacaggacgggtggtaaaatgggcaatcgaactttctgagtttgatttgcactttgaaccacgccatgctatcaagagccaggcccttgccgattttgtggcagagtggaccccagcacccgagcccgtctcaatccccgaggctagctccgacccctcgcagctgcctcacaccgcccattgggtgatgcagttcgacggctccctgtctcttcagggcgtcggtgcgggggtcacgttgacctcgccgagcagagacgtcctcagatacttggttcgccttgactttcgggcgaccaataatatggcagagtacgagggactccttgcgggactcagggtggcagctggactggggatccgccgcctccttgtgttaggcgactcccagctggtcgttaaccaggtctgtaaggagtaccggtgctctgacccgcagatggacgcttacgtgcgccaggtacggcgtaaggagcgctattttgacgggatagagcttcggcacgtgcccagacgggataacatggttgccgacgaactctcacggctcgcttcctcgcgagcccagaccccaccgggcgcctttgaagaaaggcttgcccagccgtcggcgcgacctgaccccttaggggagacggacgcgcctgaccggcccccgaggcccgtcggagtccaggcctcgggacccgaggggagcgttcccagctcccttagattgattgcttggatcactgagatccaagcatacctcacagataagactctacccgaggatcgcgaagggagtgaacgcgtccagcgcatttccaaacgctacgtgctggtagaagggaccctctatcggcgcgcggctaatggaatcctcctgaagtgcattcctcgggaacaaggcgttgagcttctcaacgatatccatgaaggcgaatgcggagcccactccgcctcgcgcaccttggttggtaaaggctttcgtcaagttttctattggccgaccgctctcaatgatgcagtggatctggtccggcggtgtagagcgtgtcaattccacgccaagcgaatcaatcagccggcccaggccctgcagaacatacctctttcatggccatttgctgtctgggggctcgatatcctgggaccgtttaggcgggccctgggtgggtttgagtacctgtatgtcgcaatcgacaaattcactaagtggcccgaggcttatccggtcatcaagattgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacctgcccaccccagaagcaatggccaagtggagcgcgccaatgcagaaatcctcagagcccttaaaaccaagaccttcaacatcctcaagaagcacggcaattcgtggatcgaggagttgccagcggtgctctgggcaaaccaaaccacaccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgattacttagaggagcgaaggcggcgcgcggccctccgagccgcgcgctaccaacagagcctgcggcgctaccatcagcgccacgtctgggcccgatcactctgcgtcgacgacctcgtcctacgccgcgtccaaacgcgtgctggattgagcaagctctcaccaatgtgggagggtccgtatcgagtgatcggcgtcccccggccaggctccgttcggctggccacgggctacggcacagagctgcctaacccatggaacatcgaacaccttcgtcgcttctacccctaaggaggatcaggtgtcaggtttcgggctcgggccaaccccgcacccccctcgggcgtgcagggttggccgggggctaccacatatgcatactcttatttctcttatatctgtatttcaataaaagcattttcaatctcctaaaggctgtatctgtactgttgtttccttttgaagaatcttaacttgaaataggtcactcgtgctcaatcctgccctcggaggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctagacacgtggatctccccaggcactagccccgacccgtgccttttgaggactgggacctgggcacgagcccttaatcaagctaagacacaaaaggaccacgtcacatatcatcctcatctcatacacatagcaaaatgaaattgacacaaaaaatttcttcatttttgattgcagattaagttaatttatacaaaaaagaggaccgaaggccttagaaaaaagaaaagaagaaaactgaagattggcaggggcctaggggctcaatccgacgcgcccgggtcgccagcctcgtcgccattgccgcccactccgccgtcatcgtcctcctcgtcggagttgagggcaaacgcaagccgaggggccgaaccctcgaagctctggacgatgtggtcggcagcgtcccggacctgtgcgcgcgcgccgtcctcggtccagggagggaactcgtccagcgctgtccatggagagaagtcgggattcctgacctggtagctcgccagtacaagctccaccgctccttgggcgaggtccctcgaggataacttgatcgtcctctcgagctcctcggggagacgttgaagagttccggccatctccgagaggcgctgggcgaggcccccctggttggcggcgtacttcacagtccgcccgccccagaggcccacctgccggccggcgcgatctagatgggagacggcgtcccgaagcatgccgggccctacctcgcctgccaagcggagggcctcgacctccccggcggacgagtctagcgcgccctgcagatcggcgatggtgtgttcggcagctgcgaggcgggcggctaagtcgctttcgcccgcggccgccccgccgctgcgcgccctcgcgtccagctccttcgcccgcgcctcgagctcagcggcccgctggttcagtacggccctctcggcgcgggcaccttctagattacggcgcgcctgctcctcctgcgctgcctcgcggagggacaggctttccgccagccgttgcgacgcggcctcggccccctcgagagctcgctcccgcttagtgagcgcgtcctcgcggaggcggagtgcggactcttcttcggcgcaggcggcctcgtgctccgccagcgttgcctcccggatggcaacggcggcctcgcggtccgccaggtccctctccacggcgcaggcacgctcttccagcgccatggcgcgggcctcaagggtttcttcgcgccgccgggatgccacctcggtctccgctgcccgccgttctcgggcagcggcagcgtcaaggaccccttgggcggcgtcgagcttcttccctagctctgcctcccagctcccgtattgaaggcggagggtgtcctgcgcctcgttcatcacggcggtggcgatgagggcagccccccgctcctcctccatctccttggcgatctccgccagcaccttcttacgggcttcaagctccgagacgtgccggcggtgagccttacggcccacctccaccatggcctccaccgagcgtcgcccctcttcgacacgcgcccacgcggcgtcgagctccgcccgctctgcttgcagggcctccacctgggcacttaacccgtccaacaccgtggtgttggcggcggccaaggcctgcagaaggggctccgcgctcagtggggcaacagaaggtatggggaaaagccgcctcggagaggatgccgcgcggctcggcccaccgatgaacgtgccggactcggggatgtcctccggacctggttggtcctgagcgtcgcccgagggggtgggcccaagcgatacgcccgcggcctcgtcgccagctgccccggaagtcgtcgcctgagcgtcgcccaagggagagggcccaagcgacgcgcccgcggcctcgtcgcgagctgcctcggaagtcgccatcgcctcgtcctggcgagcccgggcggcctcctcccgagcggcttcctcggcctggcgagctcgggcggcctcctcccaagcggtttcttcagcctggcgagcccgggcggcctcccgagcggcctcctcggcttcccgtaggcgatctgcggcttctcgccggtcagattcccgcctccgggcctctgcggccgccggatcctcgacttcgggctggccggccttggaatggtgggaggaacgcgacggggtctcactaaaacagaagaaagatcagaagacaaacaaaatgggtgactgaaaactcgcgttgagaggatgaatacagccatgatgggcgtgggacaaacctgcgagggggtcggttaaacgaccaccttggaggggaaatgaggtttccccgagatggttctgtctcccccatcttgcggagccacttcttctttcgctccccctcgggctgcgacgtcggcgtggctccctccgggcgcctgctgttggcacgcgccgccccgccccctcggggaggagatgggggaggggatcctccctgcttcctcttcccccgggcgtcggcagggcggctgctccccgggcccccgtcgcggggcccagaagcacgaccccctctcggggtagattgttcccccctgcggctcccgcccgcgccctcgtggcctcgaggagcccgctcctccgacgccccgatcgcctgcataatggtcaggatggaggcgcggtctggatcgctacagagggggaggactccttggggaatgagggatgcctccacggagctgagattcagcacccgttggactactatcttgaagtcctcaggagcccagtcccatctgactccctgatgggtcctcatgtagtcttcggacccggtgtactcccaagcgccccgggcgcgtcgctggagcggcgcgatccgacgacgaaggtagtcgccgtacaccatggcccctgtgagcccctgggatcgcaggcccgccaggcggtcgaggacggcgtcatagccatctcccagatcaaccggagcccgccagctggaggcctgcgccgggggctggctcggaagtcggaggcgcgcttcgtctgcgaggggggtgtagaaccagtcgctcttccagtcatcccacttcttgcggaggacgcaggggatgtagcggttcagcaccggcccccgcggctggaagtagcagccaccaaccaccgacggcggcgacaccgactggacggtgaagaaccaccggaacagccgaagggatgggcgcactccgatgaacatctcgcacaagtgcgcgaagatggccaatgtcattaccgcattgggggtgaggtgcgccatctggagatcgtaaaactccagaacatccatgaagaaagaagaaaatggcggaaccagccctgccattgcaaaagggaggaagaagacggaccgccccgggtagtctggcgccgggtgtccctcgcccagcatgactatctcccggccggtggcaggttccggcatgaagcggcgcggcagcccggcctgcctcttgctcacaatgcgggaaggcggcagcacgctaccgtcaagcagagcagagccccgtgccatgacgccggaggaggaaatgattgagagcgagcgcgtgtggcgaaggtggggcacaggaaagaaggagttagggcgcaagtaggcgaagacaaggggaataatggcgaaaggaaggaagcaaatcttttcctcgatgtctttatacccttgccaacgctgtgcccggctcctcgcttctcgcgcccactatttcgctccctcgtttctcgcgcccacgcttccactaatcccattcgcccgcttgcggcgcatgaggtggatatgcggttgtggcagtcgagatagatcatatcgtgcgcgcgttaattacgctcgccgaccaaagcgccatcgccatatctccaggcaaaacgaaccggctcgtcccgattcgtgcaatacttgagtaatgtggcagtcttgaaggggccgctcattattcacagtcaagtcaccgttgccggagtgcgtgatttgagaccgctggatttctgcccaactgtggagatcggtcccacctgtcaccagacttttggaagtggcgtcacacctgaccgcttccctcgaagagagcgatcgccctggcataacgccgggggctactgtcggtgacatgggaccaggagtatcactactaaaggcttggacaggagcaatcacccacgaggcctgacccccttgggggggtcgggtccgagggtgacgtggccgccccccctctttgtctccccgaggggtcagaccgcttccgtttcggccctgagggctgaggcgccccgaccccttgcaggtttggcgccgcatgagtgggttaggtgagcgcagcgggactcacctaaccgcatttattgcgattaggacaagcgcgtcacgccgcatgtaacgcagtgcagcgcgctcgtttatccggtctgtgatcagtcgcagaccagatcgtgggttaggtggcgacaggcggtctgacacacgcctcgccccgtcctgtcaggatgagcgcatccaagcactcgtccctagccggagccggcgtgttacctcctggagatggcacgttggtcccggtcagacatatgctaggcttcatcccaaacattacaagcaaggtgttgtatgaagaagggcaaacatgcagattgctaaactgacgcgtggtggacaagaatgaccgacatgaccggactgatactggtcatgtcatcagcagacagccatgatcccacgacgcgcctacttccgacgaaagtggaggtagatatgggccgtcccatcagaagatgattcggagggcaaccatgcaaatctccgtcgattcatgaagagaagggaagtcaaattggtaaaaagagaggcaagtccccacacaaaaaagagaggtggtgcatgtggtatccccttgagatataaaaggaggaccttgcccactgatgagggggattcggatggggagagctagattgagaaaaaggggagagctagattgagaaaaaggggagagaatatttagagtttgagctctctcgctctcgagctctttgtaagcttcttcatacacagatccaccaaaaacacaggagtagggtattacgcttctcagcggcccgaacctgtatacatcgcccgtgtcttgagtgtttccactctcgcgaaccttccacagaccaagagcttagaacttcacccagggcccccggccgaaccggcaaaggggggcctgcgcggtctcccggtgaggagccccacgctccgtcacagtggaccatcaaaatgatttccttctaggatcaatgtttcaatgtttggtagagtgtatccaatgttggttggaattctcccaaaaaggttgtttacccctaggccaagataagtcaaagtcgagattgtgtaaagagatggtggaactgtgccggtcaaattgttataagccaagtctaattcttgtaaatatggaattttggttatgctatctgggatatttccttgtaggttgttttgagcaactaacaaggaagatagggaactcagatttcccaatgcagctggaatacctccaaagattgtgttgtttgtaaggatgacatgcagaatcggtgcggatatcagtggggcagaggggattgaccatctaatgaagttattacttgagagatctaaggaaagaagagatgagctgttgaagagggcagaagggattaccccaccaagtttattttgtgacaggtcaaggtatctgagtgatgagcaattcgctaagataggtggaatactaccagttaggctgttatatgcaaggacaaccatggacaatgatgttctacttcccaaagatctaggaatactacccacaagcttgttattagcaagcaaaagatatttaagattaggcagtgaaccgatcccaggagggattgttccattgaggttgttatggctgagagcaatttcttgaagaagtgaacaattagcaaggtttgatgggatctcaccttcgatgttgttgctccacatgtcaatgacctcaaggtgggtacacgatgatatggtatccggaatcatccctgtgatggaattcatgcctaggtttaggttcctgagctgggttaagcggccaatctcaggaggtatgtggccactgatttggttatccggcatgtaaattgttgtaaggaagctcaggtcggcaatgcaagggggtatttggccagtgaggctcagtgatttaaggcgaagagcgacgacgcgagctgcaccctggttgctgcatgtcaccccatgccaatcacagaatgcaagtgactcttttctccatgagtccagggctcccaaaggatcagagaactgtgatctgagacaaaggagggcttgccggtcggcttctgatgtgttatgggttctggatggtgctaatgaacttacacaaggacatgagctgacgatgaggatgataagtatcagaacaggttgtgccaataatgctttctgggctgctgctgctacaggcatcttgctctcccttttgctagctatagcagattccttacagattttggtttgatgaaactggaacatgctggcatttatatagagcacaagcctagtgaccactatgagcgtgtgagagggggcagacaagaatttgagtgggtgatgcagaagagaatcaatccctggttatattggtcaccagtgacgacacaactttgtttgtttggactaaaatttctctgtaaactgtgggtgtgttcagctcatatactttgactgtttccataaagcaacttttagaggcattttgaagtggcaggttgatgtcattgtcagcgtagagtcataatccaccacaatgcaacgcgctcttgattcagtacacaggtcagtcaaaaattcactatgtggtatatatatcacttagatggatagttattaggccacccgtcatatgtttagttgtctactccccgtatgtgatcattggcatccttcgtacgtttggttgtttactacttctatgtttatagaagaaatcccttatatttatagtgctcattagtacaaaataattgatatagatttttctgcccgatatgtcctaaagtttcataaaagatgtgtgaaagataggggttttcgtacagaaaaatttttatgtagtagtgagatgtataaaaatttttagtataaatttgatagtacctgttaataccggagttaccaaatattacgggggaaactcttgataccttattaagtacggtataatcactctaaatatttgggttgaagggagtagtagtacagttagtcgccgactattacatgcccttttttagaatgacgacgaagaaaatagttaagctgccaagtcgccgtaactgtttaattagtgcacggaaaacgaacgccacaaattaaagccaaagaatccaccagttgaccctgagtttggccggctgaaaaatacatccatcatataaacaagtgactcgaaacatccctggtattggcacaatggcactgaactgcagcatgttgtggttttgcccatctctgtcgatgccctggacttcaaaaatttacagtccacacttatgctagctaagtgtatgtgcgtgtgtatatatatatataaatatatatatatatatcctctaatcgactttgtcctgcacttgtgcttcgttattctgaaagctgaatcacaacaaatttcctagacaaattaaattagctagctataattaattgagatgaacacgacaagtttcttgctccagattctgctgctgctagcgatggtgattcttatggcaatggcaatggagcctgctgctccagagacaatggcgcgacgatctcccggtaagttttatttgattttctcatgctgcacaggccacggaatctgaaattatttgtacgaggtttgctccagttcaacaaaaagtatctcgaggtatcggtatctcacgataccaaatcgtttccgatcgttggatctagctaagaaaaatggtcattattagatctaacgattgaaaacaggaaacgatttggcaccgtaaggtatcggtattttgaggtacttttggttgttatgaagcaaatctctattcgtatgcatgttttttggctgtgttcttccctcaagattcatgacctcatctatctcgttttttgtgcctacgctttctaaactactaaacggtacgttttttttaagtttctatatgaaagttgctgtaaaaatcatattaatctatttctcaatttttttttaaactaacacttaattaattatatgttaattcgtcacttcgttttgtgtgcaaagcagagcatcttgctgccatgtgttcattcatgtagagcaattttggaactttttcatttgtcaaaaacttttggcccacttgctttgcattgcttcatgtctgcgtcattaattttagcagcatgcatgtagatctatgtatttatcataatttaagaattgaagtgattgattattggtctctgaaactattttgattttgggatttctgtgcaggaaacgtgaatgctaatcacgacccgtccaaacaatctggttctgcagtgcaccccctcaatacaccatgcaactacccaggacaagctggttgccctcattgatagttcgtgctactcagaaaaagatgaaattaaataacagattacaacaataagcgccaatacatgagcgtctggttatcgacctcgatgtgtccaattaaaccttgtactcgacctgattttcacctaatgaacgagtgctttccgctacatattttccctattttttatggttgctacaaatgcatggatgcatattacacacatgtcgatcagatcgcgcgaatgatgagaaataatttcgtgcaaaaattaaatacgggaatgcggcaattctcgtcaaaccatgcaagacctatcaaattttgtttgaagaaatcatttgggtgtggaaaatctctctcaaggtgatcctccattctgtgcaaccatacaggtgaaattcgtagtcgatggagagaagaaagacaacaagatcaggccgcgcagacgtacgatcagtgaggaatgatggcagtgcgacggcagccaccattcgttgctctcctcagcagggttagcatgcaatgcattcccgatgcctcacatgtccatctacgaattttttttttaataatggaatgaaacatttcggcctttgctcatcagagctacagctaatgttgatctacgaataaataccgaaaaagatttatcactgttagagtatatcaccatatgtaacaaacgtgtgattaagatcaggttcggccggcaatctagaggatatagctagctgtgtttgttaggataatgccagctgatcttatctaatcatacgtatatatatgtactcccatgcaccgtttgaggtgcttaattaacacgcagccgtcgaccctagcgtgaagggcgacgttcctatccatcgtgttttcccacatggtatcaaagcgctgaagttagatcccatctgccatggctagctcctcctcttgcacctcctccacaacaaatcccttgttcggcttccatgtctctgagaagttgaacaagcagaattatcagctatggtgtgcgcaagtgctgactatgattcgcggagcacgccttgaggggcacctgaacggcaagaccgtcgctcctatcagctatggtgtgcgcaagtgctgactgcgatttgcggagcacgccttgaggggcacctaaacggcaagaccgtcgctcctaccacccagatcgaagctgaatagaagaaagaagatgacaaggcgaaggccaagatcaagatcgacaacccagcgtatgaagagtggtttgctgcggaccaacaggttctcggcttcctcttttcatcgctgtcaagagagatactatcccaggttgccacggcaaccacggcggcagaagcatggacgatgatccaatgagatgttcaactccaggacacgcgcacgttctctcaatgtgctgttgtccctcaccagcactaggaaaggaactcagacaatctctgagtacttcgccaagatgaactcacggcgtcaggaaaacaatgcgatgctgaagaactaactgcttttattttgaatggattagatgatgattatgattctgttgtatcggctctagcagccaaaactgaacctattactctgtcagagacatatgcacaacttctgaattttgagaacaggctgaacctacggtgagaaggcaatctgacggccaacgcagcaggacgtggtcgcggcaacactccaagtaaccgcggcggcagtggcgtcggccgcggcaacggtgctcgtggtggcttcaatggtgctggtgccaactccggccgtggaggccgggtcatggacaacagcagcactccggcaacgacactcggcctgtgtgccaggtgtgctacaagcgcgggcacgttgctgcagattgttggcacaggtacgacgatacctatgtgccagacgagcgtcatctcgctgcagccgcctcctacgcctatggtgtcgactccaactggtacatggactcgggggcaacagatcacatcaccaacgagctggacaagctcaccgtctgcgacaaatacaagggaaatgatcaagtgcacacggccaatggagcaggtatgaaaatcgagcacatcggtcactctttagtgcacacccccatgcgcaatcttattctcaaaaatgttttacatgttccacaagctacaaaaaatcttgtttctgcatctaaacttgcctatgataattctgtattcgttgaacttcatggaaaacattttttggttaaggatcaggctacgagggaaacaaagcttgagggaaggcgacacaagggtctctatccacttccatctccatctcctccaaaggcagtctatggtgtggcaccatcttttgcaacatggcacagtcggctagggcatccatcgagtccaatagtgtctaaagttattagtacaaataatctaccttgtcatgacaaggctagcaaagagtctgtgtgtgatgcatgtcagatggccaagagtcatcaacttccttataataaatctactagtgtctcgcaatttcctttggagcttatttcatctgatgtttggggacctgcccccatttctgttggtagaaataaatattatgtgagttttgtggatgattatagcaagtttacctgggtgtatctccttaaagcaaaatcagatgtttttcgggtctttcatgaatttcaagcccttgttgatagaatgtttagtcaaaaaattattaccatgcaaactgattggggtggcgaatatgagaaactccattccttttttcgacaaataggcatctctcatcacatttcatgtccacatactcaccaacaaaacggggcagtagaacgaaaacatcgtcatatagtagaagtgggtttatctcttcttgcacatgcatctatgccactaaaatactgggatgaagccttcctagccgccacatacattattaatcgagtcccaagcaaagtcatttcttttgaaacacctctagaacgcttgttccataaaaagcctgattatcctgctcttagaacctttgggtgcgcctgctggcctcatttgcgtccctataataatcataaactccaatttcggtccaagcaatgtgtgttcctcagctatagccagctccataaaggctttaagtgccttgatatctcctctgggagagtatatgtttcacgagatgtgatttttgatgaaacagtgtttcccttttcacaattaaaatcaaatgcaggcgcccaactaagagcagaaatagccttgcttccatctgatcttgtagcgcatgatcaagggggagagcaacagagtgatcatgtacttgattttcctaatgccactaatggtttggatgattcttccagcagtacagatttttgtggtacagatgaacgcgtggacctaacacattcggcaacggcatcggatggagtgaatggagcgggaaactccactccgggatcggtgcctgacgtgaccagggagacagcgcaggcgccggaacagcagcaacatggcgaggatgctcaaccccactcagccagcgagacgtttccaagcagctgcacttcatcggctagacctgtaccacaccagaccgtgcctgcactgggtcatgatctgaccggtactagtgctgacacttccactgatggcgttgctgtgcaggacatcgagcaaggagctgaaggcgagctcgacttaaacagacccagaacaaggctacaaggaggcatcagaaaacctaaggtgtataccgatgacactgtaaggtactcctgcttcacctctacaggtgagccctggaggataaacactggaaggatgcaatggatgcagagtatacagccttaatgaaaaataaaacatggcatctcgttcctcgataggaaggtaaaaatattattgattgcaaatgggtatataaggttaagagaaaagctgatggaagtctagacaggtataaggctagattggtagcaaaaggttttaaacaacggtatggtatagataacgaagatacttttaaccctgttattaaagctgctactatcagaactgtcttgtctatagctgtgtccaggggttggagtctacaacaactggatgttcagaatgccttcctacatggagttctagaggaggaggtgtacatgaggcagccacctgggtatgaaaattcctctaaaccagattttatttgtaagttggataaagccttgtatggtctaaaacaagcaccaagggcttggtatgcaaggctaagtggaaaattgcaacaattaggctttaagccatctaaagcagacacatctctgttctacttcaacaaaggcaatgtaaccatgtttatcctgatatatgtggatgatattatagtagccagttccaccaaggatgcagtgccagctcttctacatgatctaaaggaggattttgctttgaaagacctaggagagcttcactattttcttggcattgaggtcaataaggtaaacaatggtttaatattgacacaaggtaaatatatatctgatttgttgaaaagaacaaatatggcagattgtaaaccagtaaatacacctctatcaactacagaaaagttgtctctacatgaaggtgatttactaggacccaatgatgctactcagtatagaagcatagtaggggctttgcagtatttaactctgactaggccagatatatcattctctgttaataaggtctgttagtttcttcatgctcctacaacagttcactgaacagcagttaaaagaatcttgaggtacctaaaatatacgtcaagtttgggtattaaatttaatagatcagtgtttactcttgttagtgcctttacagatgcagattgggctggttgtcttgatgatcgacgatctacaggaggatttgctgtatatcttggctccaaccttgtgtcatggagtgcaaggaaacaagctacagtttcaaggtccagtacagaagcagaatacaaggcattagcaaatgctacagctgaggtaatgtggattcagaggctgctaaatcaacttggcattcaagcaccaaggtcagcgaaaatttggtgtgataatattggagccaagtgtttgtcagctaatccagtttttcatgctcgcactaaacatatagaggtggattatcactttgtcagagaacatgttctgaacaagctgcttgaggttgaatatatttcttccggtgatcaggtagctgatggattcactaaaccacttgcggtgaaacaattagaaatgtttagaaacaatctcaacttgagaagtttagattgagggggagtgttagagtatatcaccatatgtaacaaacgtgtgattaagatcaggttcggccggcaatctagaggatatagctagctgtgtttgttaggataatgccagctgatcttatctaatcatacgtatatatatgtactcccatgcaccgtttcaggtgcttaattaacacgcagctgtcgaccctagcgtgaagggtgacgttcctatccatcgtgttttcccacaatcaccataatatctaaggatttatcgagtacgcagctaggaaatcgagcagggcttctggatgatgtggctagcacgcgagggcccttttatagtcacaccttttgccattttcaatatgcttcagccttcagcaattactgatgggagaattggcactggtgggaactctggtaaggagaattgccattgtccatttgtttatatacagcccgttatgtactttgtattttcaatgttatggcatgttaaaaatgttattatccacaatgtggacacatctttaataccttttttcaccagcaaattaaatcagagtaaacatattacacatgacacccgtagaaaaattactgcttgctggaatgcagctagaaaagttcagcaagtaatgaattgacacaagtttttttactgttgctatgataatttgttaatcaagacctaacagtagcaacatgatccaggaggatagtaatttgacttgaaatgggaggttatataggatagtgaacttttgtttgaattggaaatgggaggggaagggaatgggaggacgcggagtgagaactggaaaaaaaacaaaaagaaaaggacagatccgagttatgaatattccctctgcttcaaattatagcaacatggtactggattggtatatattgagacaaaaggtaatagcatgcaatgccttatttgttagagtaaaattcaatttagcccggttcttattgccaatgtggcttatttatgaggcaaaattgctacatgacactcaaaatttgtgtaatttgctgatagacattgaaaaaacgtgtcacggctgaaagacatagtaaaaaactagtaatttactagaggacacttttggctgaattggattgataaattcttaataaagacgataatgtccctataagaccacatacttcaaacatgatgttagcgtaaaaaacttaaaaattatgcaactctaaatttgccatcacccaagtacatcacaagcatacattgtattccatcttcgttgcagtctcggctcaaaaagatttggactctagtggtattcttgtctttttaaagaatttctctctccaattgagctgaaagtgtcctgtcggcaacttaccggcttttcagagtgtctttcagccgtgacacgtttttacgatatctaccagcaaattacacaaaattacacaaaatttgagtgtcctgtaacaatttttgcctatttattagagtagatttacaaaacttgagccactgcgctaattcatttgcataggttggtactggttgctaggtgccaatccacagcaccaagagtccaagattcccatgttcggtttggtggaggccttggccatgagcagcggcgacctgacgttatcaggatcattgtcgcattgctgcaatatatataatcctcgttttgaagggaacctctccttttgctttcttgcagctagcagtgccgctcgagctgcagcaccaggtgacctgcgattttgcctcgattatttgctgccaatttttcactccgcatcgtcacgcggtctgaccggattcatcatcttctgtccgtcggtgttttcgtgcaatagggagtaaaggccgtgttttagttcgtgtgccaagtttttttaaagtatacggacacatatttaaagtattaaacgtagactaataataaaaaaaattacagattctgcttgtaaaccgcgagacaaatttattaagcctaattaatctatcattagcaaatatttactgtaacatcatatatcaaattatgatgtaattaggctcaaaagattcgtctcgtaatttatacgtaaactatgcaattggttttttttcgtctatatttatagctctacatatgtgtccaaatatttaatgtgtgtccaaatattttatgtgatggaatttttgaaagtttgaagggatctagacgctgccaaaatctggctgtgtgatgggcgtatggatgccagaggccgtcttggaggatgcgagcgctaagtctggtcaccggtgctacctgatgtgtgagcaaggagaggacgacgtactggagcgagatagctgcgaagatgcatggttgcaatacatggttagaaatcctggtccaaactgaaaacacaacacttgctatatatgcatcggtccaatatgaaaatctgatgacaaataagcatggcccaagatgaaatttactctatttattatatatgtttaattgtactatttgtcgcaagtatattttaaaaaatattgatggatggagctttcaaagtttaataaaatattgttaaaaatgttactaagtttcccaaaaaaaaaacgttactaagtttgagaggaatgactgatatatagaattagaggaagtactaacaaaattttgatctaaacattaagtatttaaatatttatatatgttcggagggagtagtacagttagagtctgtttagttgttgcctaacattgccataactcaatttgctatagatgtggcatggcaaacaatttgtggccacaagtgtggcaatgtttggctagaaaatgagtatacgacatgtaagcccatgaaacaaaaaagtgtggcttgccacaactgaaacaaacaaccaaacgctaagctaacaatctgtggcatgcttaacatgtggtgtggatgtgtggcaccaaaccaaacagccccttttcaccagcaactaaacaaaacaaaggaaaattttgttcccttttttattcctttgacaaaacaaagaaaattacgctgccaagtcgtggtaactgattaattagtacacgggaaacgaacgtcacaaaggaaaagaatcttccagtaggccctgcgggtggccagctgaataatagagccatgcatgcatgtaaacaagtgactcgaccttccctagtatatgacactgatcagaatgtaattactttgcatgatgcttttgcctaactctgtggatgccttgcacagtccacacttatgctagctaaagtgtatatatatcctctaatcgactagcatggtagatatataacccgcatgtatgcatctttgttgtaaacttgtgcacttgtgcttcctgctcctctgaaaattaattattcaatcagcacaagttttcctaggcaaattaattagctatctaactgattaagatgcatactactactactactacaagtttcttgctccaaactctacttctgctagtgctggtgattcttccgtccacaatggcggacattgcggattctactgctccaatcggttgccagagctgcttctgcgatgaagccgcaacaccgtcagcaaacgaagggcagatgcagttgtcgattcaggctgcaacaggcagacgagggcgtcctcctttcatcccccattgcgatggaaatcctcgtaagttcgttgcttcatgaatccatatgtatatatgtatctgttttctcatgccatgcatccgtgtacagcagtttcgaaactgtttttgttcgttaataattcttcttgttttatgtttaattagcgcgtggcacgtagaccaaggtatattcatttggcctgtttagtagggtttcaactcttaaatttaactcgaatagttaagtttggagtgaagttgtcgagcagcataaaccatctctacctgtttagttcattattttgtgaaagtactgtagcccatttcacaccattttggatagagcggaaactatttggttggactctagttctagaaaagattgggctggagctcaaactctaccaaacaaatcttgaagtataattctcagtgcatggacctttgcttgattttggagttcctgtgcaggaagggtgggtgatagctctgatccgtcccctctacctggttctgcagtgcaccctcccagtacaccttgcaactacccaggccaacttggttgccctcattgatatatagttcgtgctactcagaagatgctgaaagtaaatatcagacttattacaataaagcgctcatacatgtatgtttggtcatcgatctcgatgtgtgaaaccttgtacatccctgatttttcaccgaacaaacgagtgctttccgctacatattttgcctatttttgtgatactatgtgtacatgaatgaatgttaccatggaaattgtgagttgtgacacgacggatcacccaaataccgataaatcacgccaatcgaactatatttgtattatttagtatgaaaatctctagcttgtgttgtttctgttagattgatctctggccaccgagtcagagaattgcgcaatcacaccaacgtgctcctaacgttttgagtaccgattccctcggtctcgagcgcatgttgctctctctcgcgcgatgatcggacacgctatctacgtaacggacccgcccccgatcccctcaacgcacacacatataaagggaatgatatcccgttggtgacgatcgacttacggcatacccaaaaccaaactgtcagactatcgatcttaaggtgcgttggaggggaacgaagggcgaattccattgccactaccgcacagtgatggagatcttaaggtgcattgaaagggaatgaagggcgaattccatcaccattgctgcacattgatctccatcactggcggtctactaccagtacaccgacacatctaatggcttgatcaagatccgatcaataaaccaccaaattccgcataagaaattaggtgatcatgcatagcctaagtgcatgattttaatatttaattcattggtttgacaatccttttgtccttattgccatagttacaattttgcatcaagaccatttgatcactagtccgatctactatatagtatagggtagtatggtctaccgtaaagcaacttaaaaaacaaatatggtgtcaacatcatcttgtccttcatgatctatcattgcatggttcgacaattcttatctccttattgccatagctacgatgttccatcaagacctttgatcgcttttggttttcctccacttatacaatgtattataatgcaatgccgaaccttgtttgacaccttaaatttcgttggacgaacgcattagggtgtaagtgaaaaagctctcctatctcggtgatcgatctttcatgggaaaaaaagggagactctcgattatgtgctatcatacatgtgaaatatttagtcgatcaagggaaagaaatcaagagcaagccacggacacatgattagtagcaagcgatggcaccaatatcactgctgtaatccagcaagatagatagccacgtgattggatgcaatacagtcctgatgcctcgcatgtctatataaaattaaactctggaaacatttatcaccacaatatcaaggatataccgagtgtatcatcacatgatacaactttgagtaggaaatcagacatgactccgggttgatgtggctatatagcacgagggcccacttacagtcacaccctttcgttttttattgtttcagcaattggatacgcatttggcactgttcaagttaagctacgatatgacgaagtgaccaggtgagtgagaacgcataaatgcaactaggcgtgtgtgatgagaatgtgagacgcatatcaagcgtgcatgatgttattatctcctagttaatctcttggtaccaagtattgttactagatggtaccaagaatatgttagctcatcaactcacctttggagcggattagattctggtagtgacacttgcctgttttggcacagcttcagctccagcttcatcacctctagagtcggaacccaaccaaacagttttagctccatatctgaaatgggagcagagctgggtttaggaatctctataactctactccagactcaactcctaaagctaaatttaggagttaaagctctaccaaatagtcccgaaatcatacgtaaaaggcgtatgatggagtgatggatggaaatggaatcgatcgccagctagttcagtacaatcacacaagatccatcgcaattcccccgcaaaaaaaaaaaagatccatcgcaattcaggatcgtgccgcgccaccaaatttgttctccaagcccagtcgtccggcccactctttctgtatagtctatctggcccatactctatccagtccagttctatctggcccatattcgctttagacagccacacttgccttggatattcagagctcccctgtagcatcatgtgtctgctcggttctccaagtcaatccctcaaagttggctacttcacaattaatgacagtacagtgtgctgctctaatcacaaaataattctataaatatcaagaaccaatatgttcttgataccatgaaggtgcgcgagaatatctgacgaagaccagagctcaactttttggaggataaaatatgcctaatgcctcacatacctaatcaatatattatatacgtactctactaacatacaaaacatgaaatgaccgaccaacaaacacgtctcaatcgatcagatcctaggtaagcatgcatgtagttcttttgtgaggcagtcctaaatgtaagggctataacgtctgtgtgttatttctcttctgttatgtatggacctttttctatggggaagggtatcttttccacataacatcaagctaccaattaatgcagtaactacatatctatattaaagtaaataattactcctgtacccactggcaattagatgtcctggtgttctctcacgcatgatctagtattaccccttcgttattatagtgtagtaatcccttcgttattatagtgaagtaatttctttgttacaaaaggacagttgcttcataaagtcaaagccatatcaataattggctgtaccagtcacaacaggcagtaatgagatgtagcttaataattggttgtaccgtgcttgatagcaacgatgagcgcggtggtgcttgaacacaaggatgaagagtataatgcacggtttgcggtgctctataagcattttacattggtgttgtgtgggagatcaatcttatcttttgagataagaaagctcgcagtagaagtctcaatgataccatgaagtttccagcccttgctgaatttacacatacaacctctctctattggcttgcaccaaaaggccaatttgtgttgtaggcatgcaaacttggtgggccaaaagatcctgatacctcacaatcctagccgcctctggtataaaccaatgaaaaacattattctccttcaaagtgtttttatcatggaaaatcaaatttgctttactcgaggagtatgtaggtcacccacctagttatgtgcttggagagatagctgtctgttactctgtttcatggtttacctatatcagtcttgaaatgttgcaagtgaataggactgatcagcatccgccgtctgatcaatgatttgtggtgtagattatgcaggagtccttgcctcgtgaattaggggcctggaaatcctcacggcccaataggcttctacttatgcacctcttgtagtcatatggttggagtccggagaaaggagatggtatcattggcaatagatgcagaggcggaggaagaggttaactccagacgatttcacgaggctctgtggctgggatatgcctctgccgatggacacgaaggcaacgtcggatcccagttggtggatgccgtgttggtgccaccgatgcacctgcagataccgtcaaatcctagtatttttcttgcttccattgctacttttctgtggaggacactcggactttatattattgttgctaattgaaatgaacatatcaagttaagtggttcacttactctccccttggccgaatgcaaaagtcatgtggtctcttaggaggcccacctaaaaaaataaacttatttttgtaggcggatctattaaggggccacatgagaaaatgtatttttcttacgacccgtgaaacttccttcgaatataatttttgcaggcacgacctgttacaacctgcctataaccttcgtatagaaaaatcgtttctgtagtagtgtatactgcgtgcttcaggaaaagaaaaacccaccataattgaggcagatcctcggcggggaccctgccctaacgaagaagttggttatactcgatttttctatagatattgaggccacttaattttcgttaccaaagcttgagctgctatagaaacatgagttgacagtagaaaatcaattctactgtatgaacactgtcttaattttcatgcaacaaccaactataatttactcggctaaacttagtttagttagtggaaagcttgattgagcataaacgtattttactcatcaagccatacacaatcactggtggagaaaccatctttgatcggtcggcccaattccacaatagtctcggttccaataaaaaccgggactaaaaagcatctttagtcccggtttaaaagctgagggttaccaaccgggactaaagatcatttttacttccggttgaagaggttgtcaggtcgtgtcaggccctaattatttttagtcccggttggtataaacaaccgggactaaaaattaccccaagccgcgtgcaatgtttatctcttcgcgtgtccattgtctgaccctcctcctcagtcttatccttaacttttcttcccctccacttgttctcctcctcactcctcctcttcctcctccccttcctctctcccctgtcttcctggcggcagcaggcggtggccggcgcggagggccggcggcggataaggatgggttttgaaccggtgttaaggatgggttccccagcagtgataaaaactgccttagaaaaaaatattttaaagcttatctttcttcagctagtagtttttttttaacaggacttgtactaactgcctggtaaattgcttcaggataggttttctctcgtcgaaagatatatattcaaatactccctccatcccaaaataaatgcagttttccattgttcatattcaacatttgaccgttcattttatttaaaaattttatagaattagtatttttatttttattagatgataaaatatgaatagtattttatgtgtgactaatggtttttattttttttataaatttttttaaataagacagatagttaaacgttagacacagttatccacgactacacttatttttaggacggagatatatcgagctttgtcatggagttgtgcaaagcgaacatgcctctgttatgtcattgatgattgggaatcatgtccagcaacgccagctgatctgaccacttgtcagcctcatctcatccagtgctttgaaggcctttccagtactaaagcatttattacagtgcaggatactaccaagtagggctgtcaacgagccgagctcgtctacccaagctcgagccgagcctattgcaccttcgagcttttaggcaagctcggttcgagctcgttcgagctcgagctcggtgccgagctcaaccataagtagtataatatatattttaataataatatcttaataagtataattattttctagttaatcacactaataaaaagagtagaaaatgattaaaataaatatattgtgctaatacatgctaatttattgtgtaaatagatacaaatatatatatttatctattagtttattatattaataaggtgaacatgcaatataaactatacacagccaagctcgggtaggctcggtagaagctcgagctcggctcggtaaagctcacgagcttttgctcagactcgagttcggctcatttggagctcgagccgagctcgaatcgagcctaggacgagccaagctcgagctgctcgcgagccacgagcttgcttttttgacagccttactaccaagaagaacctagtctgccatataggttgaggttccgataaagatcccaccctcacggtgcaggtcatgctcaacacgatgcttccccgccagtctttttcagttagattccacaccccttctctcacttcactagctgctttttcagctttttggaggaagcaccccatgtccatgcatagcaccgagcgtccatgcaaagcaccgagggtccacactttttctcctccacgacatcacgcggtgacgaagccacgcgccagcatggagcaaggcctaatccttctcgtttggcaagatggcttgccgcgagaatccaacaaaatgctggcccttattgaatttaatctttaacgtcttcttttgttggcgatgcacccaaatatttatgtgagagacccattgtgtttttcggtgcattgatacctcctgatatctcacaagcctatatgttatacgcgcagtaacaaatgaaacatcaaacatttatttacaagattgtgagcatggtacaatggtagaaactagattattatctctcatgcagttgtgggtaggtgcaagcagaacttgtagtgcacaatatatggccggagcctagagagatctcttctctgcggtttacttatatgcaacttgtttttcatttagttgatgtatattgtcctggcttatatgtacgatgcacttaatcaaatggtgcaagtctatttaatgttttagattttcttctgacaatgtaaattggttgtaccacccacaacaagcagtaatgagatgttgcttaatatccgaagaagtggcagaggtgcttgacagcaatgatgagcacggcgttgcttgaccacaaggacgatgggaaacaaatcccctgattttgtgcagcctgcagttgtaccactgatatgtgggcccaggcacaactgcaaagtgcacaaggcctgaggagtctaacccaggatgatgaatagtaggatgcatgctttgcagtgctctagagtctagtggtgtaggtgtggtgtgggtgatcaatcttatatctcttttgagataagagggttcatagtacaagtggaatgcccttgccgaatttacacatgaacatcctctctcgagcatattgcaccgaaatccctatttctgatgtaggcatgtaaacttggtggacggaacgatcctgatgcctcacaatcctacccgcctccggtataaacaaatgaaaaacattatcccccttcaaagtgttttatcaaggaaaagcaaatttgctttactcgaggagtatgtaggttgcccacccagctgtgcatgctcttgtgaaccatcggagcgagcttagaagacctgtgtttgtaggtgccaccgttgcacatgcagataccctcaaatcctagtaattttcttgcttctgttgatgcttttccgattgcacatgcacccgatttgtgtggttttcgtgtgaaacgtttgcatatgctgattcgcttggtacgcttggtaatgccaatacgccgtgaagttgctactgctgaatttatacacatgaacagaatctcttgagcagcttgcacccaaatgcccatttctaacgttggcgtgtaaatatggtgggtggaacgctcccgatgcctcacaatcctacttgtttatgggatcaacaaattagaaaaaaacaccaccccttcaaaatatttttctcaatggaatgtgaatttgctttactcgaggagctagtacgatagaacacccaccaaattgtgcatgctcttttatccagtcttgaaatgctgcaagtgattgggagagatcaccgtacgccaatccgatcaacgatgtgcggcgcagattgcgcaggagttgtccttgccttattgcaaattagtagccgtcacctcctagtaaatctgggccgcagcttctggacctaaaagtcctcatggcccaatgggcgtctgctcatacacacaggcctgcatgtctcctcctcggtaacaaatgaaaacacactgttaattcatactaaatgggattttgcttggaaacctagctgaaacatttatttaactgatggtaagtatggtactatggtagaatctcgcatacaaatttgtaacttgtcagctctcccaaattctgagaaagcaggctggtcggactatactagaaagccatgcatctgtactagaaaggtagaggagtgctcactgatctctgtagatgatggacactctgagtcgctggactgaacatcgagcggatctaatttggaaggaaatcttcttgaatcgaacattccatggatattaatttctgtatggttcgaactactgtaggaggaacacaactcgatcaaatttcgtatgattggcttcgtctgctaattctggttcaacaagcatgcagtcctgctgttatgacacaacaaggtcttgctgttcgtgttgcacgaactatctacactctcctgatgtttgcgcttccataggatggtgctataatggtggcaaggtttagacgtgataaaaaaacatggaggtatatatgtttgggatattggagcctttcatggcaatgtaactagctaccatatccttctcctaagcacattaagaaaaatgactccctaaataataaaattctatattttttaaaaaaatattataattccatatcgttttttttccatcagatgtcaaaaaactatagaaagtagaatattttcacctggtacacctaagcattctagatcaattgttgtacaacgtcaatctgctcgcacattctttccggaaagtcggcgtgcttaaacactgctttcacatgatgcttcaaccatatatctgatcatgaaaaatgttgaggaagcctttgtaccaattactcctgatacctcacagtccaatacgcattagacatgtataaacgatatactaacaaacatatctatgcaggaacaagggacaactgctctgtttatggtaaagtgagatagatcactacctcacgtgagtttgagccttgagcctattcacctttgcggctcttatataagcatagacacacattgtatattgatggtaattaccttcgctatttttccttttaattaacaaacttggtaatacatcaaaagtgcatccgattgaatgatgtggtgtgggcaggtactacattttccatcattatttggtatatatgaatactagagatttcgtactaggacagcatcacaatttaagcatgtgtggtattgtagtactatcaaccacatgtgcatcttaaaaacctaaaggaaggactacatgtgcatcagtgtgtgggcaggattacaaaaggttttgagagttggtatctcagttaatgtgcactaccgtagaagtgatttttgccgggtggggcaaaaaccacaattgtcccggttcagcaattaaccgggactaaaaccatttttagtcccggttttttaggtgcaacggaaagatatgatgtttagtcccggttggtaacaccaaccgggactaaagatcatatttaagtcccggttgtgaatgtgtcagaagttgttactaatcgggacaaaagattaatattaatccatcagttctcattttttcacttgcagttgcatgatccgtaaatggcttattgacattggaactatcaaacatgacggaaatagctaatggcagataagaacgtctatgaatccagacatccagtagaacaaacttgtggcatgcatttggtttctatcagtgtatcatgcttctctagaaagctataggagcacggtgatctgtagttgatcgacatttcgggccactggtctgaacatcgagctataggctctgatttgctaggaaattaagactaataatatctgaattcaatattccctggatattaatctctagctgaatattgtttgaaccattttgaaggagcacaactcagtcaaatttcatacgaatgacttcgtataccagttccagttcaacaaacatgcacttatgcaacagagtcttgctgttcatgttccacgttctccctacgctcttccgctgttcctcgctgtgacaagaaagaggatggccattcgattggagggctgatcagaggaccatccatcaccggatgcaagcaacgcgaagttcactgtcactgcgatgcaaagcagaagacgaggccacaatcgctaggctgtagaggaaatctattcagtttgcataataggtgagtatacttccacactcagcccatcctcaaaacatggtgaacctcgcaagcttcagctgtgtgctgatcgcatgctgcacatctcgggtgcagtatctcttattgatgtatcctgataatgtctcctgatgctccatatgcctatgctcatgcagctgatatttgagagattgaatggcatatgcactgtttaggtttttatgggagtttttggtttgtgcaagtggagggggtcacttgataaaactttgtgacctatgagactgaggttctctcttacatatatgggcagttcttcttgattgaacgaatgtatagttggtacaaacgagctagattatttgcttcatattaacagggccggtcctgatatttccaaggcccagagcaaaataaaaatagagaccctcaatgggtataatatgtagattttttttttcttaatgattgtagatctaaccaacctaaaatacgatgatactacactagactacgtcagcttatacttattaaattattgtaactattgtggagaaaacattgcaaacacaatccaattgcctattaataattccatgactttgagaaaattgtgacagcatcaagtaattcatgctagcatttttataagaaaattcagtgataattgtaattgtacgtatcaacatgaatcaggatcaatctgtatttagtggtggttatatatattaaataccattaataataatctcaataaagaagagagagagagaggagaaaatgagtgggacggtgaataaataatctagtcttgggattaatcaagacgtggagcttggagatcaatctacgattctctgcttctattggtaatcaatacgtaaatgtagcctatgtaggtgcatggccggtcggggcccttgtcacggtgggcccagggccaccgcaccgctcgccctgccccagggccggcgctgcatattaaaatacagagcagcaagagaatggacttgtggcttcgcattattgttgataacacattaccgttattatttacatcctgattaaatggactgttcttggcaagggttgatatttaataaatttatggagaaagttaattctgtaccattaagaagaagcacacactcaaaataaacaccatcaattatatacttaaaatttttattaaacttcttcaaaacgctcttaagccgtcagttgatgctctaataaattaaataaaaacctagaaaatctgagaaaaaaacatatatccctcgattttcacttaaatcgacagttccaatactataaatagttagattagatttcttaaaacaaaccgaccaaattcttatatagtctttccttcccttcagtaggaaaacgtacaaatattgaaacattgaccttccttttcttatttttccacgtatatagttgagacaataataattattattattagcgataatattttttataaaatagttactttacaaacatttaatatattatcatatcactctttacaaactaatgcaaataaattggctctacaataatatttaaaaacaaagttgacacccattattttatattgtgtacacattatttcagactaattttaataaaaatatttgtccatcgatttttacttaaatcagtattaaaccatcataactatctttaaataaacaaagcctcgaaatcacaaagattttgagaaaaaacacacattccctcgatttttcagttgaattgatatatgaccattgtattagacttgaaaaatcttgctaatcaaccctcctgatcattccggctaatcactcctcctatctcgaatacgtatgtacttacttgttacaagtaaaaagaatacatacaaccgccaaaccctctcattggatatatatgattaaaaaggactaatcccaccttacctcattgggttccatttatcatatagcatggcattatgagttgctccgcatattgcatataaaccatgctaaggtagttggttgaaaagctatatttgttaccattaaatttaaattgtaggactgcatgttgatatgtgttttcttttcaaaaaatattatatagatcacacatataacaggaaagcgagatctatgatatgtctttgttaatttgtatgtgagtatgtgataaattacatcattgagactttccctgcatatataaatctggactcttagttgtaccaagtgctctctctacttgttaaattgtatctaagtatgtgataaattgcatcattgaggctttcccttacatatataaatttggagtcttggttgtactaaggccctgtttgttcagcttaagattatagtaatctagattattaaatcagattactctaagctggattataataagctgacatagaataagtggcagttgtttgtttctttggattattgaaagcatctaagggtagcgagtctttagccacttaataatttggaaaaagctcctccagaggagattattagattatactaatttggcttatagataataataatctagcataataatctacttgtttgtttgaggttactcctaataatctagattataataatcctaagctgaatcaagcagggcctaagtgctctctctactaattaatgtgtatctaagtatgtaataaattgcatcattgagactttcccgaatttagcccacaaacaacctaatctgaaattcactcatatggagatttgaactcaggaccttggagtgctactcaggtcactataaccactagactatatgctctttcgcgatctactgaacctacaacgtgcaaactataagcagctaatgtaattatgttaattatgacaataatcagtatgagacacccatagggctgagaggcatctggagaatgtgacaaccatttgcataggttcctagaacgagtgagctaagttgaagtcctagttatcattctgatcctcttaggtggtgcatgtgcatatcaaaggaagtataggctgtgttcgctggagccggttctcaaccggaatagtgcacacggaaaacggaacggtccattagcgcatgattaattaagtattagctaatttttttaaaatgtatcaatattaattttttaagcaactttcatacagaaacttttttaaaaaaaacgcaccgtttagcaatttgaaaagcgtgtgcgtgaaaaacgagggagataagttgtaaaacttggagtaagaacacagccgtagtcgctgtaggctcatctaatgtgggtatcgaggcaagcgctgaagagacttgttagtacttgtttctgctacttgaaactcgatcatatctgctaaattaaaattcgaatttaaatgggaacaatgcatatatatcaatttttctccctgtgttaattgatcgctacgattgtatatgtatagttttatccctagaaatgcaaataatagatttgtaaatacattatttgtacatcaaaatgttgttgagttcacatagctcaacctttttcccacttgcctgagacctcaatgtcaagatgctcctatcatatcaatggaatacctattatagcaactccgtttttagagtccgtcctcatgacaagtttaacctcacaaagtttagcaatgtattactcgtacatcccttcaagaatgcaatacctccgaccaatgtgtcgtgacagtggctcctgatgcttcacatgcctatgttcatgccctcgacatttgagagatcgaatggcatattacattgttttggttttcatgtgagttttcgcaattgttttgtgtacgtggtgaggatcacatgataggcctttcctatcaggcagtggcgctcttataggcaacttggttggtaggagcaagtcagcttaattggttctcaacaagatgcagggtacagatacatcaatctacatagcagcaagtgaatggacttgcggcttcacattattattgaaaacatgaatgattaattgaatactgtgcaggctaagagttgatattggtttaatttatcgaaaagtaattcagcatcgtcatgaagagacacatacattaaaacaaggagttacatcaatcaaaatgacggcggcatcttagcattgtggttacaagcaagtaagaaaatgatccattgaactctctgaagtcatggcttcatgggtatattctaactggataactgtatagagtatagacacagaaaaaatgatcatgaattacgtattacagacctaaaaattcatagaaaaagttatctaagtaacactgatatatatagaaagattttagaaaaatcgtactagtgatgtgtagagtttttagcaaaaaatttacttttggataatcaaacctccatcatgtgttgttgttaagctatattaattgctgaatttagagatgtggatacaatgaatgggaaacgacagtcatgtgggggcgattcttaggttggattcttttcccttctttccgaactcaccttcctctttttccttgtgaacgcttctcaaactactaaacggtgtgttttttaaaagttttctatatgaaaattgctttaaaaaaatcttaggctaatacttaattaatcacatggtaatgcgcaacaccattttctgtgcgggaaggtggagttacctcccgaactcagcctcaatgttgctatggttgagttctttcccttaacagagccaactctatttttctaacaaaaaaattagccgaatttcgcacgcagttaagcaaggctatttttggcccaatcctgccggtctgaccgcgaccgtcaaagcaacacaatcttgttcatcatctgaaaatcaatcatctccacaaccacttcaccaataatctccaaatatcaaaaccaataacatcaaatgccaattcttcatcacaaataacaatcaatcacactttgattttacatggttttgccatgccaaccttttactttgtttgtcctacctatcctttccacctcacttgccatcttctccttgtcatccataacaatgaggcgacacttggccactacccgttggattgaagcttgattgaagcaagtagttgtcgtcaagtttgctgaagcaggtcaaggacagcgaaatggttcaacatcaattaccagtcattttgaaggtggacaagtagcctcgcaattcagacgtagtttaggtctcggattgctagtttcaggttaccctctcttgctttctacacccacagatctagcacgagcatcaacactttgggtatcgatgtctagcactccagatgcttcgcatgcctatgttttcttccaacatggatgattggaatcatccgcacacccttcccactggtattgtttttgcataggtagatatgaatggattactggagttttgtgcacttcattaccacaggtcttatttatgtcagaatagagactgttgtaacaccccaggaaaccacgtacctagagtgccagaccaaaaacactcgaaaccactaactctcaaaattactagaaatttcggcagagtctcccctgtaaatacggacatccacgacaggcaattataagttaaactaataacaatatcattcccacaatacgatccatccttataatacatggggaagaaactattagaaatctaaaagattattacaagaccgaaccataatatagtttaagtatcattatggacctaggcaatatagtttgatagtgtgcagataaatgtgtatataagggtgctacttcccgcccatgcatgttggtctcaatatgtacctaaaaccaaataaaacacaagagtgagtataaaaatactcagcaattacaatatggaactagaaaacacatatagacatcattggcaataaagcatgaacagaaggctttctttctttgataggaaacacattttcaaacaccaagtcaaagaagatagtagtttccatccggggcaggcatgaattgaaatagtagtttctatcccggacaatagtgaatatatcctagcatttgccggcaaagccgagtaaacgtgatcagcaattacccacaggaacttgaataaagaaccaaatttcactcccatgactatgcatggtacttgaataattgaaaccagaatcaaagaaccaaattgaaaccatattgcacattcatggcaagcagggaacttgaattatttacccagaaccagaatccggaatattgaaacaagaataacgtcgtaaacataggataaacatgaaaacctaaatggcgtgaacaacgatatgaatataagcagtcacatgtcacatagaaatatatcggaaataaatagatagagccaactatccatcaatcacacacttagttcgtcatgcacttgcctccaatgaagggttggtatcatgcacgatctgaaggaccaccacctaatcacaaacaaaacctcagcaaacacattcaaacatgcatataaaacaatgaaaaaaggtgaacctactgccccatcccatcaaaacgcgataacaaggaacgccgcttgcactataaacaatattgttgcttcaaacctttatatcttgaaatatgaaaaggctatgaccataaataaatctacagaacaaggcctacaactcttatgtggaaattatatttttattatgccattaaaatggtctaatttgcgcttgaaagcaggcttcagaatctgtccagaatttcagactatccgcactaaaacaatcataactggagttttacttgcccaatcagggtgtactttactaatatgaaaagctaagaaaaacctctacaactttgtctataggcgtcttggctgattccactgtttagcccatccaaaaatagttcaatctactactatccagattatgacataaaacaacagttatactcaaaaattcgtatcatctaaaccacttgagataaaatcacgcccttggtcagaagatagatataaatattatctacaactttctagttatacactttcgcaaaaaatatcatttagatctccgaaacttcgaaaaaccgaaaaactgtaaatctgccaacgtgtagaacagccaaattcgaaccacaacaaacaaaactccttctctaaccttccttatccacgaattaaaccactaaaaccaccctagaacaactgatatgacaaggggaaagcctcacctagggtttctttagagaacttgtgaggagacaataggggagactgtgatccaagcttattgatccaagctatgaaagtggagatctagggagagcaatttgctgtagaggggagaaatgcgaacataggagaaggggaggaaggaggcgccgccagggagaggggtggtggcactatgatgggaggtgggagttggttcccctctttctaggttttaggggagaactaatgggctgggtttataggccttctcatgttggcccacttctaaagatatatttttttatttatttctgttaacatctttattttaacaagtcaacccaaactaaaaaaataaatatcttttaatatacggggtattacaactgtattaaatccgcaaccaatgctggtaaataggaataggacacattgtttttagatttggcaatggctctccgtgatatatttctttgaaacaaaataatttctgagaatgcgactagtgtgtatttgacggctgtgacgacgcgtgcatggttcatatatacagttgtcttataggcagcattcttcactagctgactataaataatccttagaggatatcaaaattaatggcgtgtgtgcaccaagaccaaaagtttgttgcaattttgttgacatttttctactcaatgatattggttattccactgtagacagctagcccaattaagaatgcctgcctcttgagggccgggagtaagtaacttacatatgaatagaaaattttggaaccctcattgcactcttaaaaagcactaaaagaagaactacaatgccaaatagtactgtttggaatagtttcaaaacgttgtgcgagacggttactcagttattgtgttagtggtgaatgggacgttaattcatcggttctcatgcttgcactagcacgatccactggactgagcatccaacggctcagatttgcatcgaaggtctacatgaattcaaacattccttggatatatattagtctctcgaatatggtccaaacaacaacaggagaaacacaattccatcaaatttcgcatgaatggatttgtctgaagattctagtcagacaagcatggagtcacagtgctctcaaatacagcacgatctttctgtttatgttgcatgttctctctatagtctcccgttgttaagtaattaacggaagcgagaaaagtaattaagggaagccatagtcaactacaggtctgagggcagatgtacagtatatctaccggtgtcaggtgacaccgatggtatcttacaaatacaatatgatcctctgtgtttttagccaatgacaccatcgattaaagctcactgaccccagcagactaactaatttactctagcccacgcactaacagctagtaaacaatatactccgtattttgttttagggaaagccagaacaattttgctgttgttagtattacacgtgcaacagttgcttaattcacttctcgtatagtatagttctgtttataaatggtggaattaacctagcccgttgatttacttagttttgacatgttaaacaattaataaactagctagatgaaatgttacattactttgtttttatttagtttatactttaacaatgtagaataattaggagtagaacaaataagagctttatggagaaacacccaagggtcttcctagcttcacaaggtggtgggctatacgaccggggttcgaagcctcaccccttctaatttctaattatttgatattaagtcattctctaatggttgtgtctttttaataagagctttatgtatatattaaagtttgcaaaaaaaatgtttctttatactcgagaagataccataagttacactctctttttttccattaatcaattacatcattggtatatcttaatttttgtgagaagaaaccacaaataattagctagaaagtatggtgtcgtctagtcttataaatgctagtaccgtaaagtatgtattacattatgaccccggtggctccaaatccttgatccgccccgtctgaccagaggaaccactgccagtgacggagccaggatttcaaagttaggtattcccatctaagcgctgagccgctggccgcccctgcccctcgcggctaccggccacccaaccggcttgaccgcctgagcttggcggagtgtcgggtgccggccgtcgtggcaatggcctccccctccgcggtagcacgggccagctcccgccgccggttgccgccttgcctcgtcgcgccgccgcctagggtttgcaaatagggagcggcgcgagggagccgagctatggagggatgggtcacggagggagagcgagagggcgccgtctggtagagtggtggctaagtgggtcaactgatgtctgatgggtcacgacaaagtgggtcgggttggtaggaggcattgcaagaggtcggttgggtcatgtttggatcgaagagttgaggatttaggtgcactaatatgtgtacatgtatatatattagaagtatgcttattttttcataaaaaaagttgggtattcccgggaatacccaggaaccaaggtagctccgcccctgaccactgccgcctgccgctgtgatgcgaagcaaccaagatgccagcatcgctaggctgtcagtagttgttcctcagttcggataacaggcgaccggaaatatttttagagtccatcctcatgaccaggttcacatcacaagtttcaacgatgtattactcgtccaaccttccaagagtgtaatacctctaaccaatgtgtcatgagaatggctcctgatgcttcacatgcttatgttcatgccctcgatatttgggaggtcgaatggcatattacattgttttggttttcatgggagtttttgcaattgctttgtgcaagcggtgaggatcaaatgatagaaccattgctatgaggcagtggtgctcttatatataggcaacttggttggtaggagctagtcagcttaattggttctcatcaagatgcaggtacttgggtacattgatccacgcagcaacaagtgaatacaccagtggcttcaccactcgggtatattgattgatgatattaaaaacaattaataccatcaatcaatatcacggcggcatcttagcattgtgatcacaagcatgtaagaaaatgatccgttagaactctatgaagtcatgagcatattctaactggataaatgtacagagagtatagacacagaaaattgcacatgaattaagtatatatatagacctaaaaattcttagaaatggttatctaagtagcactaatatagaaagtttttagaaaaaatcatattagtgatgtataaagtttgtagaaaaaacatacttttggataattgataacaccattagcgatttaaaacacaagtgttgttgttaagttatattaattattaaatttagagatgtggatacattgaatggggacagtcatgtgggcattggcgattctgtggttcagtccttttccataatagagccattggtgaaagtatgagagtgattaacagtagaatataacaaattttaataagaagtgattgatgggataattaatactctgtagagataattattttgggacaatttctaagtatctagaaatacaattattttagaaaagaaaaagtatctagataaattattttagacctggataaattattacttttttttctcacacgctatcctgctgcattttataccatcgatatatgatagcactatattgatgttgcggtcccaggcaagtgggaaaatgattgagctacgtgaactcaacaacaatttgatgtacaaataatgtatttacaaatctctttttttcatttataggcataaaactatatcatatacaatcatagcgattacaacattatataatccagatccatcacacagggaggaaaattgaaatgcattgttcctatttaaattcgaattttaatttagcagatatgatcatgtttcaagtagcagaaaggcagaaacatgtactaacaagtctcttcagtaggggtgtaagtgggcttgtccgtaaacccgtttatagacaaaattagtatctaacctgcggattggaccagcgggttacctattaatttgacttatttatgaattatcattaatttaacctaaaagtcaactcgcgggttggcccgcttgcatccatagtcttccatagtcttcagtacttgactcgatacccgcgttggatgagcctgcatcgacttcctccttcgccatgcaccgcagaggatcacacgatgcccatgtatgttctggaatgataactagggcttttactttgctaactcgtactaagaacctatgcaaatggttgtcacattctcctgattctctcagccctatgcgtgtctcatactgaatgatgccataattaacataagctgcttatgatttgcacgttgtaggttcagtagagagagcactacaaatgtttggatctcaaaaatttttggccaaacgttgcgtgtcttatactgaatgatgtcactcacgctgtaggtccaagactccaaatttatgggtgtgtttagatatctcaaatttttttttgcctaaaatatcacatcaaatgtttggacacatccatggaacattaaatgtgaaaaaaaaccaattgcacagtttgtatgtaaattgcgagaaaaattttttgagcttaattgcgccatgatttgaaaatgtcatgctacaataaacatttgctaatgacagattaaataggcttaataaattcatctcgcagtttacagtctaaatatataatttgttttattaaattcatccatggagcgccgccgccgctgccgccttcgtcggaccgcgggagaccgccgtgtccccttccggccgatttggcggaggggagggcacggcagctgccgcctccgccgggccgccggcaccctcgggagcccgccgccaccgccgggcaaccgcgggagaccttcacctcccctcccgccggatctggcggaggggagggcgcagcaaccgccacctccgccatgatgngctnctgtaccatgtgtgactcacttngnnccagtg

SEQ ID NO: 3648 - DNA, 18880 bp, Oryza sativa
  unsure (1)..(18880): unsure at all n locations
cccggttncgtgattgcgcttgattgaagctgttactagngggagggagtgcacaaggacgacgcgacgtgggtcagtgggtgggagtagataaggacaacataccgcgctcggctcatcggctcggctcgttttgtataggtgtaggtgtctgttttttaataaaccggcatctatagtattggtaccggtttttattaatgaaccgacacctatagtgacttaaagatgttggttcttatttttttccgcgtgcggaggcggaaaaggcctgtaggtgtcggttttaaaggaaccggcacgtataaggcccatccctttgagggttcttgtagtagtgaatgcaaactgcaatgtctaccgctattctatttcttgaacccaaactcaaacatatctatgggctttgacaccacatttttggatggatcctgcagctttcgagcttctgattagtcctaaactcaagaataagtgctttgaattcatttcctgatggatcaaaggttcagcataggctgattactcttataaaattccggtggtgaatgttttatttcattgcttcacattcagcaaaaaagtttgttggtgctccttttttttactcagtccctagcaaaaaaataagaacaaaaatttcaacaaagaagacaggctctcaatatgctgcatttggatgcaactaagacagagccactgcatcgcccattccaatccaaaactacttgtgactgtgagtaatgaagactctgccccctaggtagggatgtaagagggccaacccatgaatctacttatatactacctccatattttaatttatgacgccgttgatttttgtccaacgtttgaccattcgtcttaataaaaatttttatgtaattatcatttattttattgtgacttgattcattatcaaatgttctttaagcatgacataaatatttttatatttgcacaaaatttttgaatgaaacgaatggttaaacgttggtcaaaaagtcaacagcgtcatacattaaaatatggagggagtatcaaataaatggtaacccactggtttttatgtcatgactcaacttgccgcgccttaagatgcaagtgggttgatctataaacccatttacagatcccatttaggaacccgtggattaccaactaatcttgtctataaatgggttcgtgggttgacccgcttacacccctaccccctaaggagcctggcccttgcctctcgtatccgacggggacactaccgcggatcaactgcttcctctgatggatgcgcagggcagctatgcagcacgcagcagatgtcatgcgaaaatgagcaatagtcaccgacgcactaacattatgtgtacctttgcgtcgcaggtaactgcagcttcacaccacactctttggcctttgctagttgcctttgtgagtatgtgactactcgagcttaaacatcagggtagcagatcattgaagagatctagcaagatgcctatccatttccagcattcctgatgcttcacatgcatatgtttttctttttttccaacatggacaaatgggatcacgacatgcattattttctttctggtcacatacaagtttgatagggagggatatatatatcttgtaggcaattttctcaactaaatgactgaaaataatgagcttggtagtttttacagatgcatggaactgattctatgcatttattgctccagattgttccaacaaccacttaataaaattttgacaggagaatacataagtgattaattagtcgttaactttatccttgtttttggacaaaggggcatgatcactagctagcataaccacgtgctaatctttgtgaaatggccaattttgcttactgacacagccacatgtacaaaggccttcagctttcctttacagatttggttgataaaagagtagtacaatgactaattatgtttcaatttcaaaggtctcctgattcgaccacccttgccctctactatactacaatagagttcactggctgattaatgagcagcctcaacatccaaaaatgcatcttaagctggagtcgtcggtcgctgcaagatttctgatgctggcaagatgaatgaggatcaaaggtgaggatagtaaaactactcaacagatagtatccgaccaagttgatgatggaagagcacgcttacaattctatggttagagtcaagtctcacatctctagtttcagcttcatccctttcgtttgctacaccgaacgatcttgcgaaaacggcaccagtgtgtccatccatgtacaatactcccaatgcttcatatgcctatgttttatgtcagcttggaaagatggaatggtttgcacctttcttttctctggtcttgtttttttggataggtagatatatgtccgatccttttcggagtggaaatagccagaaagggattcaactaaaatccaaactaaatccaaggtgatccttgaattataaatacagcttggttacccttgaagatgaagggcacgattatgtccgatatccagtcaacgacattatgaattgcttcatgctacctctcaggacattgtaattgttcaaacatgagttaattaatgatttattaatttacagaaaataaactcagtcacaacgtgaaaccttgagaactgaaaaaaaaaacacaaatttaatagcatgtgtgtaacaggacactcgaagtcagttggaaattaaatgacttttctctactcaatgatattggcaatcctactgaagacatgttgatcaattcagatggctgagagaccaccaataatattgctgtcgatgtagctggttaactgatttcgtcggtcttgttcacaaaagggcatgatcagttgcaaaggcacacgctccatcgttgtcatacggtccattttgctgacaacaatagtagacatgattttcactgattcgatcgaacagaaagtagtacaattaattattgccattaagaagaacttctctcacttttctaagtctgatatgggcgtcctctagaacagactacccgagaacagagcaggagccgacgtgagaattgccgtaatccagaaagaccaatagaaaaaaaaaattcagcaaaacaaaccacacaaactttccagtcatattgccaatttattcattttttttaactgaacatgttgccaattattcaccaagcattttctttttcaccgatccttaagaggcatcgcgagatggtcaattatagctattcgtattttcgtagtgttaaattacacacaaaagtagaacatggttggttctcccatggtccaatggacgagctataggataagctgcacagatcgagctgctgaactcatatggacaaataaacgcactgaactccggattttttcaggggaaaaaggaatcatatatattaggctgcaggcagacggtcctctttgctgagctgggacagctcgtgcgcagcaacacgccatcatgccgatctcccctgcaccccgaaaagtatcggagtactgtcagtcgaccacatcgtttctccatacagcaagttgtttcatcgaagtttgttcctcagcattgatattcaagtcgttaaaacgcatatataaaaattatacctataaattattattattattttgcttatacgttgaataacgtattatccgtatttggtcaaatgatgggggcaagtgtgccggcaaacaaccgcagctgcatgggcttgtcgatgccgacgacaagcattattccgaagacaaaaaaaatcttgatgatcttccccacatagcaccaccgcatgtccttcttccgacgactgcttcggtcctcctcccgcgtgtgttgtgttgttctggattctggagtgcgcgagtatgtgaggatgtgagtgcttgagctcaaacatctgggcaacaaaattggttctctagtgggaaattcagattggtacagttaatatttggaggaaattgggtttatatatcaaagattacagattggtatagttaattctgatgcattgtgttgacaacataggcgtgcttcgtcatgatttaactaatattgcagtttggctcacaccaatttaattacaaattcatcatgatttatttcaaatcaaagagagataatctttactactataaactgaaagatgagtaccaaaactatcttacaagcttcagcaggcgaacttcagtagtatccatccatttcctcagtgattgatcagtgcatgatatttttctttgatggaaatgatctgataataaacatcattaattgtcggtcgatcttttggtgatgtctctgtgcacattaacccaagcttagccagctgtatggcacatgttagaatttcaggcacaacatgatttgagtcttcgccatcgtgatgttcggtgatagtaggttctaaaatatcattgatcttatgtggaaatgctgattccactaagctacgaaggttcatgccatccttaaacatctcatcggttgggcactttcctgtgatcatctctagaacaataattccataactgtatacatcaccctcagttgagaccttgcaccccaagccatactctgcaataaagattgagcaagttagtaaagcatttgttggtcgaaaaatggtactcgattccatggaatggtatacttgccatcacctccgtgatagataatgtggaggtagtagaaacgaacaaataagaatgaagtaagtccgtacctggagcaatatatccaattgatcctctcagtccagcagtgcttgatgaattgtttaggcttataatgttgttatgaagaaactttgtaagtccaaagtcactaagacatgcaaccatttcatcatctaaaaggacattgcttggtttcagatcgcaatgaaccataggaggagagcatcgattgtgaagatagtctaaagccacggcaatgtctacggcgattcttattcttaaacccaaactcaaatgttttgtaggatttcgaccgagcacttttggatggatccagctttcaaggtttccattaatcctatattccaaaataagtgctttgtattcatttcctgatggatcaaatgtcgagcataggttgatcactcttataagattccggtggcgaatgtttttcaaggcctcacattccgcaaaaaagtttttcggtgctccattttggtcaagtctaaatactttgattgcaacattgcaagctccaaacttcaattgaccttttatgagaatttttacagtccaacaattggtacctccaggtactggtactgctaggtaccaaactaaatccaaccattaaatcagcaggggcatgatgggaaaaaaagaaaggaagcttcgactctgatgcgttagtgttcgtgaacttcttgtcaccaccgtcctagaatcttcgccactgcattagtgctcttccacggcaccggctccggtggcacctcctggccgccagcgccgccgcagcattgggcgttcttccaccctattccttgatccgtcgtcgccgtcgattaactgctaattactctgagcggtgccgaccaacatggagggatgaagccgtaaatctatgtatcgtcagataaactttatttgacttgatttgctaaccagtttaaatctagccttcaaatgtaattaatccctacgccaaagactgaaagtgatctgaatacaatgaatccattgtggagctgtgccgtgcaagttggagattagtgctctgaatccatgtacagagcgcttcatccatctatgagaggacaccatgattgaaaaaggacgagaggggaaaatcaagggagatggtaccgccatggacggccagggaaaaataaagaggaaaaaataatcaaggaagatggttccgaatcaagcagatggatctgtatcgctggcaagagagaagcgctgtgcggcgaggatgctggcagctgctcctcgagctcctgcatgccgtcgagtcgaggaggggtggggatggtgacgctgtgtcgtcgcgaggctggaaccagcgtcctcgggggcggcacgactggatctggaacctcccaggcttggggcagccggatctagtccccagttcctgctctgattccttctcgccttcggtggtgagtggttatgcccttgcctccggcaaaaaataccagagagatcccgactatgctaaacacgaaattccacttttaccctttggactagtagtaccaggcggggtgagcggtggtaccgcgaggtactcgtctctcgacagtcgtccgatcgtgttagatcgacggtctaaatttggtaccgccttagtcttgttggacggtaaaaaatctcttatacaccactccaaatgttcccgaaccaacaagattccttgaagagaaaccatttgttgcgttgtacaaatcgttgtatgagagtttattaaaatgcctgatcgaatcattgatgatgattttcttccgcccagttctgttcttctgaaggatgatggcaacacaagccaatgtgactataacgatggaagtgattggaattcctacactaagattataggatgtcttgttccttttagatgaaagttccttgcaaagtggtaattgtagcattggagaaattgcacacaactttttgtttccttggacgaacacattgcttgaattagcaaacacgcctcctctagggacaggtccctcaagattattgaaagatagattgagagtgtgtaaagatccaaaatactcaaaaaagtctgggatttcaccagacaagttgtttcgggaaagatccatctcattgatcccttttaagtgggcaaaagatcctgggatgctcccttgtaggaaatttccctccaagtggactgattctaattcaaggcactcaccaagactagttggaatctcaccagataattgattattggagatattaagtgaattaagattagttaatccaccaatctctagtggtatgtgtccagtgatttgattctaggacatgtctaagccttccgaaagtgtagaaatggaaaagagttctggtggaattctcccatacaatttatttcttgatatatttagtttagttaaagttgtgcatcttgccaaactagaaggtatttgccccgtcaaatcattttcttgaagataaagtttagtaagttgccttagttttccaattgattgagggattactccggaaaacttgttgtaagataagcttaggatcgacaagttttggagatttacaattgtatcaggaatttggccagaaagcaagttattatccattagaaagatcgtgagactagttagtttttctatctccgaaggtatgctaccagtcaattggttttgatttagaatcaatacctttaggccttctgaaaggttggtgatggaacttggtattattccttgcagcttgttcctatccaaccacaaatttgttagttgagtgcagtttgtcagcgaagacatgaaagaccaatctccagcctcaagcttattgccacctaaatctaggtaagtcaagtcagacaaggatcctagagaagggataacaccggtgaaagagtttctgcgaaaatatattacttggagattcaaagcattggctaacgaagaaggaattggtccttcaaaccttcaaatattatacttgtgagtcctggaagggtgtagccaatgttcgtcggaagtatcccaacaagacgattggcgccaaagtttagataggtaagactcgagattgtgtaaagtcctggtggaacgatgcccgataagttgttatgacttagatctagtatttgcaacttagaaagattacttaggctctttggaatggtcccatctaatttgtttccggaaagcatcagtgtagacagtgaaggaatgttaccaagtgtgataggaattttaccggagaggaggttttcagttaaactaaggtatcggagtgacgaaagagcttgggagaatggaggaatggatccagaaagaccatttgatgacagatctatgtaagacgtggtagtgctattgaacaaagaaggtggtatctccccacttaggctattattttggagattcacccatataagtggtttgttactccctaaaagttgtgggatggtgccagtgagctgattgtgtggaatgaacagtgcagaaaggttggaaagcaaaccgatatctggggggatgtttccacgaatattgttggtgccaagaataatttgctgaagaaatgaacattgaccaatacttggagggatcttactttcaatggagttgctaaacaggtcgacaatttcaaggagggaacatgatgatatagtctccggtagctcaccagtgagggaattcatgcttagattgaggtatctaagatgtgttaattaaccggccaatctcaggggagatgtggccattgagttgggtgccaggcatgtgaattctggagatgaaactgaggttagcaagacaaggaaatattgggccggtgatgttctgtgactcaagatccaacgcaacgactcgagatggattcttgacactacatgtaaccccattccaaatgcatattgcagaagattcatttctccaagaggctaatgctcctgaggggtcatggagctgggacttgaagcagagaagggcctcccggtcagcattggaatcgttgtggagttgagctgacacagaagaaggaaggcagcataggctctggaaatggaagcagactactagaataagaagtagcggtggcatcactaatggcttgtgaagtagtgatggaagagacaccatcttttcttgctctagcttgattaatttgtaagccacaacgtgcgatggggcaactatatatagcacacacagtttgagtcagtcagagatcgttcagccgtctgtgtctgacgtccaatctgggaaacctgtagtaatccaaccatgtaagcagacgatgtttctagcagtcttcaggtctatcatatacccattacttaggtggtgtttgaatttcccgaagacaaaaataaagatgaagattaagtatttcacacaaaacgaggcggtaataatgtgtaattaattgagttttaattattaccaacataaaaatagattaatctgatattttagaacaactttcatatagaaagttttcgcacaaaacacattattagtagttcgaaaagatcgccataaatatccaaaactttatcctctctttacaggggattcgatcgccgccgggcagcgttcggaactatgagtttccatcctctcctctctcatttttgcaaaaaaacaataaaaagaatatagattaaagttgttttgaaaaaacatgttaatctatttttttgttttttaaattaatacagtattaatcatgtactactaagttacctcattttatgtgaagggcaaattaataagttacaatccatgaggtgattcgaatgtagcctaaatgtatatatatgcaaggcaaatttggttacagtaaatcgtgacttcgcggttttagctgtagaacaccgcgtgaagtgatttttggaagaagacactctcaaaagttggatatttgctggtggacatcccactcattaaaataataatttccggttgaagagtaaaaagaaataatgtgaaatatcaaacttgcccttgacccagatgctctcttatactctcttctgtttctatcatttgctctgtccctagctggaaggaggggatagagagagaagagagagagggagagatgacatgtgggtccattggtacttttgatgtttcacgtgatttctctttcctctttaaccggaaattgttattttaaagggtgcggtgtctaccagcaaatattcaacttttaagagtgtctttctccaaaagttactttgtgcggtgtcctataactaaaaccacgaagtcacgatgttctatagtaaaatttaccatatatgtagtatctcgctatgcggatgatgtagtatttttttctccgaaacgattaagttaaactcttttgttaaaaaaatccaatctaactagggctcaattcacagctgttatgttatgatgtgcttatttcaaaaaatgttgagaaaattataacatatagcaatctagaaccagatttaatcaatacagtgttacgaatttaaacaggagtgtgtccgaaggtctgcaccaccatatccatcacctcgtgttggtgtggtggaaggtatgcagtactgctaattgacatgtaggccccacatatcctcgggcccacataacaatgagcattctatatatgtagtactgcagaggatttggattggtgaaaggtttctttctctaaccaaactctagaggaagtgaacgacaactttttactccctatgttttaaaattcattgatatatagataatgaaatgtgatttatttggaacagaaatggtagcatagattttataaattgatgatttgttgatatgtagatagtgaacacggtgcatctgggccccaggaccagaaagttagttgcaaattcactgtcatttcattaaattatcttggccattccaccgaagacttggtatactgaagagcggccacttgagggagcaccaacgctattgcgcttcagggtcaggtgagtcgctggctaactaattttctcagtcttgttggagcacctgcagggatcacctagtggacgcacatgctcgatcttgttactccctccgtttcaaattgtttgacaccattgactttttaagtacgtgtttgaccattcgtcatattcaaaaaatttaaataattatttattcttttcatatcatttgattcattgttaaatatactttcatgtacacatatagttttacatatttcacaattttttttaataagacgaacggttaaacatgtgctaaaaagtcaatggtgtcaaatattttgaaatggagggagtaataattagtagccaaaattttctcagcccaagaatatatacctaatgagctgtttgatagaacggaataatattactcggttttgatggtacgaaaggagagtttaagttgactattcactactggagaactgatctttgttgggtcggcttaaaaccacattagtctcatttccaataaaaaccgggattaaaaatcatatttttccggttaaaaagcccaacgcacttttataatctttagtccagattggtgttattaaccgggaataaaaatcatttttacttccggttcaaaaaagcgtccagctccttactatctttagaactaaaattcaacacgtagtatataatccctcgtacttatcctttagatcgcaaactcttcctcctcattttttaactacatcctcctccctttcctcctctcttctctctctccctctctcctctcctctccttttctttttctcgctgctctctcttatcatctccttctctttttttcttgcagcgaacgacggcggtggcctgcgcggcgggcggcggcgcgaggcgactgcgacggcgcgacggtggattttgttgatttattatttgtgaacgtgaatttgttgatttgtgatgtctttggatttgtatatttgtcatgtgaattgtgaatgtggatgtggatgattttgtgatgtttatgtggatgttgatgattttattgttgagtttggttaaaaatcaatatggaaaaaaaacaatgaaaaaaaagaaaaaaaattagtcatggttagtgttatcaaccgggactgaagatgattgtgcctcgtgggagtagctaccatctttagcctcgggtatttcaaccgggactaaagataggcatctttagtcccggattcgcggtctcggttgcataccaaggaataaaggaggttgcgaaccgagagtgtagatgcattctctagtagtgaatctaacgcaaactcgacatttataagggtcgtaggacttttctcatcctatacagtaacttttctaactttaatctccaaacacgtgtttttcttccactgccaagaaacccttggtgctcctatcttgattgggctcctctcagagcaagtgttatggtagatgtgactaatatatccaaatttattcatatcatttactcataaattaagaggcaacacatacaatacgtcacctctaatacacacaaataccaatgtatctagtactctcacatcatttttgaaatttgtgtgaaggttagctcttgattaaggggtggttcatcatctctcctccacctcatcacctaatataatgtaacatttttaggggtagcatatgaagtattatagtgcgtgccctcaagcgggcatttgtagggttttcatgatgagtctatgttagttgggtgtgttggtttctaaactaggtgttcggtttttttctaaggagcgttatgagttaatttcatactgatccacatgtcctagtgcgctttggagtttggttaatttctgcgacaacaaatcttaactagaggggtagcgcgccgttggcgcgccgccgtcaagtaagcagtttaggaaaataacgaacatttgtatagtagttggagcaagtttgtacattaaagatttaaaatagagcggacatgtgtatggtagcatgtgaaggtttgtattttaaagatgtaggaagcgaaggaaaacacactgaaagaaggccatcagaaaagaagggagcgtaaagcggcaggtgtcggttaggacatcacacataagcatattagtaagcagtgataatttgcactgcatatatacaatagattttagtgctgataataagtggccagggtgcataggtaattagggtagcatagtggtgggaagggatgcatgcagttttgctgcatgaaaacatatgggataattcagtgctgacaaaagggcaactctactatagcacagctgataaaggtggcatttaaaggacatctattgttatcttgacgttgggtgccttgtagaagtgaaagatgcaaactgaatggagatgaatggcattggttgctgcaaaagttgcccatcctctctttaggttgcaacgatcgtccgatgatttatgcaggagcatggtgactgaatcactgcctgctgcttcaacctgaacgaagatagtttttttgcgtcccatgagtggctgaatgtaggtcactgaatattccttggtaaagtactgcaattggaactgcatgttatttttttagggaatgcatgaatagaccaatgtttgtctagtgtaagtatacttaccagtctatcttgcttcatgaatgtattgttcatagtcacaatatagaacttgctggaacgctggaggaactgcccgatgatgctgatgtagtttttaatgtcaggtgtgactgctgtattccttgcacaaaaaaacagagatcgtcgaagctatgtgtggtttcgcctgtgagcacacattgtttataagattgctatgtttaattggaaagaagtcatgaaataggtaaatatggctataaattctgttagtagacaattaattatatcatgattgttgatatgctaatagtgactcggatttgttctctgtactggtaggcttgtgtgataaaatctctgtggccagaatgcggatactgatgtggtgattttagaaggaaaagaactgagttatatgtgaacagatgaaaggcttacctgaattgtcggagctggaaggaatgtcagtcatcgactctgtccttgaatctgacgaagtctctgaaagatggtgttgaaatatgtcattagtgtgattggctatagatttgtacatataggtatatatcatggagcacaggattgtagacaaatatttgtgcacctttgtttgatgtgtgtgaaatgagcatggaagcatgcttgctggtaggcatgtcattgatagtgattcctgtcgatctctttggtgctgtcttgatttgtttcttggatgaagggatcatgggcagcttgctatcttttttcttgtcaaagagaaggacatttatctttgatggagtaagaacttgaaagcgaatgtattgaccagacagtaagccagtacggtgaacaaaggttttccacccttttgagatgaagaatgatcctgcaattttttctagttcgacggtcattggtggtgcgtgcggtgaaagcaatgttacagtctgtccatggtgtgcatggcagcctcgagcaatattgttcggcagccgctgttgtgaggcacaatgttagttaagaacatgaaagaaggtcaataggaaaagaaagcgttgctgttcttacaaaacgagtgcgttgtagcgaagtgaacttcaatataggtgatgtatgggtaggcatgattgaaaaacctgaaatgtatggtaggtggatgtcagaagataaaacagagcaatagaaggattaataggataacatctacattgtaaggtcaagaactgtagatctaatgaaaagggctctgtaattttggaaaggaaggaaacatattagtatcgattacacacagtataaatagagagaaaattaaacatgttagcttatgacagggcagcattaatgttaatgtggcgagttctacacaaggctgccattgttgctagtttttgttgagcaaaggacattggtagggtggaagagcagcatggctatattagggctgaaggagtttggatctggcatgggagatctattttgtagtaagaaaaaaaaaccagtggtgttgtctagatgttgtttgttggtggggaagcagaaatgctgtgtatttggaaggtgcagagagagtgaaagagggatgatagtggtaggaggaagaactaacctccaaagtggcgctcagctggcggtgggagtagaatcgaccttggttgatggcgattttttttgctctttggccggtcgctttgtcttctctgtgctagggctagggtggttgaagaaggcaagaagaagggataaggtttgtctgacaaaaaggaagcgtcgagagcatcgcatgggctttgtgggccttcgtacggagaggaagtaaatacatgggctttttggacctctgttttgtctgcacatacttatattagtggctttggagcattggctgagctgctctttgttgtagtgccgtagggaaagttcggttgagagcggcggcggcggctttttcctctgatgcatttgcgcagatctgaagggattgtgctgaccgcgcttgctttgtgcgcggtgagtatcgacgaagttgtgcgaggtgggacggcttggtagaaagaaaggaaagcgcacaggtgagtacgatctttcagattcggtttgtctgccattgctgttgaccatgaggtttgttttgttggtaagattgtttgcaatgtttggttagtccgtgctggagttagacgcgagaggatgtgcctggcttggccgagtgagagcgtagaaatgtgtagcagaacatttactattgtttgtgataattcgttaaggtctgggctgatgatagtaggaagcaaatgctaaggtacatagcaatctatatggaagaggtgcatttgttagttcctacgaaaaaagtcactgtctttctgccagtagaacaaattaggtgtgtagggagtaatacttggtgtattgtttgcaatgatagcatgtttattttaggaagaggcaagatgtagtttgctataatcaatactttatgctttgtctagctcataagaaatgaagaaaaacttaaaggacaatgtcttccattctgtaagattggaatgcaatatttttggttgtttgggcttgttatgagactgatcatctgtagatgtgtttgtgtgtgttttctgcaataactcttctagttggatatgtcatgtagggaggcatcagttatctgcctggcaatggacaatattagcaggatggagagtgctcctgctgttagcgctgacatggagtggtgtgatgaatttggtctaggcagtgaagaatggacaacaaaggttgaaattaagatcagaaatgtcgctgagcatgtgtgtcacccggaaaaaatggaaagattagtatcgtctttctgtgatgtacaaacatatagttttgatgcaatgaaaaaggagtattatatttgtggatttgctcgtagcattgaatcaatcccaaagtataaatacttgaagataaagtatgggacagagaatggagtctggattaagtttttcatgcttaatctagaggctataccgtacgttgatccagaaaaagatgttgtggctaatggtaaattcattgtatgattgtaaatttattatattggacaattgactttttttctatctatgatgttagtactaatctgtcatacatacagagaaggatcctgaactgtatgaagatccagatgttgtgagagaagcctttgaaagtcaagttaggctgcaacgcattgcaggtatgaatttggtctgcggcgtttaaatgcatgtcggaactacatatggaaactaaaagtaacacctgttttgttgtatgctgtataagatggtgaggaaagcagtatttcggccgatggctctttgtgcatgagcattgactctgactggagcctgaagtatggtgggcgttgaatagaacaacagggacatcagaaagatcggttgtctatgaaagatgccaggaagccaactatttagtttattgtatatgatgtgctatataatatacaatgtagcttcgtagcttttgtgttgagtattagtatgctgtgccgtaacatgttagcatgtattacagcgtgctgtatgtaacatatgggttgtttgattggttagactgccgtgtgggactgttgtgttggatatatgcatacgtcattgtaagatactaaagtttgtagcttttgtgcacgatattagtatgggttgtttgtagctggagttatttcatggcctacgctctcttgtgtggctggaatctatctgtgtatcataatgttgcaaggctaaccgttgtgctatgttaatatcacttaggtatgtctgtgtgaactgcattgtcactctgcattagcacacgaatatgaaatctgttcgtatcttgcatgagaaactatatactggtcagggaagagaatgatgattgttctagattatatttcctggtctgtctgattttattcattagctagttgctaaccaatagagggtgctggcagcaaggccaaaagggttcgatgtgccgtgtaggatccagaagacatggtcgttaatcagaatggaaaccatgccattctgctggtaggcaggagaaaaggagtgttttttgatggtagctatatagacaaggttaataagagagaacgcttaggtagattatagggataaccatgtctttgtagcagcagtctagaacacacaacagtagcagaagcaaacataggcagcatttccctacgataacgaccatggacgaaagccatgaacaaaagaacttgattcttagcctaaataaaggaaggaggctccttctgcgctgtatccaggttgatggcctatgtacacataagcaaaagccttgctacccaactgcatgtggagctgttatttgctgcatacaagatggaaaagtttgggggtcaggactgtgtttccatattggatttgcaggtaaataatgtgtgttgtgagtggtaacctacacctgtgtgtctactaaggagcatccttgaagagcttcttagcacttggatgtaggagcgcaagtttttccctgttgaggtataaggacatgttagtaataatggaaaaagggagtgaaatatagatgcaagcaacttttatgtaagaaccttttcttggctgtggctgtagtagctgatgttgccgctgtttgcggaatgtcctctgcatgtttagctgtttgttttgccttgtagaacaaagaatgtttaggtggttaggtctaagcttaaaggaaagaaaagcaggaataccttggactcaggagaattagtgacaacagttgtttcaggagcatgctttggatgtttgacctcatcctgcgcacaacgattggccttgcaagattattgtatggggtgaaaacctaaatagggtgccaggaagaacaatatgggcaggaaaggtaatgacaagtgttgtaccttaataacagtgtcaacattggtgctaaaaggctgcatgtggcacattgaaccaacgatgttttttttctctggtgttaaaaaacttggtttgctggttggtgtgctctgtgtgggagtaccaataggtgactttgttggggttgaagtgctgtgcccttgctggacgagctgttgtgattcagagcttgtttggctttgctggggccctgtttggacagaactgctggagcttgcggatgcaatagctgatggttcctgggaagaacccggtggcataagcagcagtggctcatttgaagggccagaggaaacaatgctgttaacctggagagattcttggcttcttttgacagtatcacgtgtaaagctgacattccatgtaaatgtgctatcaacaagcgctgcgatctcagctggaatgtaatcactatctggtggattgtcctcaatggtgntgnggtnatgagccagtagatcatcaatnnnnctcctggggggggggggnnggaggtaaagatattatataccacatgattatcgaattagacctgatctcngacnttacgaggttagaccgaagtatggctacatagtagnttagattaataatantacactccgacgcactc

SEQ ID NO: 3649 - DNA, 8753 bp, Oryza sativa
  unsure (1)..(8753): unsure at all n locations
ccggattgatgactgtctaccagttgtacagnagctcatcacatgtgtatattaatgtgtgcagcacaattagtaagcatggaaaaatctggaatgaggtgtggtatgaaccttggatctggtattcctatgttagaacagcttgagcatttgtagctagaaccgtatggcttagaagttctatagcataatcggcatgaattgtaccaccaggaattttcgctgcatatcctcctaacagtgacattgacaatgaaacgtgtactctgaaaaagcaaagaacagaaatgatatcactattattgaaagtgagaaaatgtgcagcgatgtattgaacaaaaaactggcaaggaggtaccctgtttttgtgaggattgagggcaagtatttcttgaatagttttttcctctgcagtgtcctggttgtaacctgttgctgggttatcaacccagctgattggacgaaagtttgcactgaagctacatagttatatcacgttgaaagttaactaactgtttcacaaggagtgagaacacatcatggcaatggattataaacatgagttcaagtaggcagcctcacctctctttgagttctagcacttcaggaatatcaaggtttagataccatttgcacggcgaactaccagtcactgtaagacctgtatagcatgaaccaaataaaagcatagcgttagatggctagaataaacaacatagaagtgaaaatgcgtagtgaaaacgaacctaatcctgtgtaatctttgacaagtgtcccaacaaagacaataacttgggcctgagtttggccagcattgtatacactattagcgtcaaaagcatcagccctttctccccagagtgtaacaggcattgttgaattgctattgtttttccatgaatagaaaaaaggaaacagtgtgagtgtaatttaagaaagcagcagcgtactaagaatctatgcatgcatcaaaggaaaaggtaaaaattgcaattaaacatagggatattcagtctgagcaaagacaccttgcatcacatatctgtattgttctttttaagctatcagcattccttgacttcggccgcacaacggttggcgaaccaacctcagtgatgacacccatgacatctggttgcatgccatataagcctaattaatgatgagatagtatggattattgatacaacaaatatagctgtgtagaagaatctcattaccaacatagaagatggtcttgtccactaaattggggatatcactgaatggtgtcaatgaaaaagttatgccagggaaatcagcagcgggctcaatgtattcttcaaatgttgtccatttactgaacacaatcattaggctattgtcgactggcctgtatgtcctattcgcatacctcacagtaaaggagtcaatatagtaaaccttttgttccttaagcaaaggcctcaggctgtcaattgcaggtggataaatctgagcgtgaatgctgtttccctgcatttttaaagtaaataatgttatcaagagagttggcactatagcctaataggcatcgatgaataaatgtcatagtcacatcattaccatctgatcgagcagcacaagatcagtgtggaaaatattgccactgccgttgagatcgcagaaatcccataacctagaaactcttgcaaggatccttgtgtttaagtctccacaggacagctgtgaaatgagcacatgtgccatcttggacctgcaatgagcatagaactattttagaatgggtaaaatggttggataagatataacagtcaaaagattgcttggcaggatactatacatgacaaaaggcaatatactatgtaccatacacatagtctatagtacttgaggctgaaagacatttattccaaaatatatgtacaaatttgggtattactgtggtaaaaaatttcaagcatcaagcggcggagcctgcaatagtaacacatgcacattactctgctgaaaatacaacgaagtgatgaaaagcaaaaaaaaaagatataacgtgcgggaaatcaccgcttggactgtagcgctgagcacttcagagtaaactatattttttgtctgtgtaccacatgatccatcatcattttcaattaatatttttagccctgatcggcttgttactcttgaaatagcaacgtataattgcccatgtgtgaagacaggcttcctaagatatacgccaacccgctggagtgtttgaccttggcttttattgatggtcattgaatagcaaactcgaacagggaactgccttctctgcagtgtaaaaggccatttcatctttgtggtgccaagtgtgattcgaggtatgtaaacagtttcaccaatgtttgatccagtcagtactatacactgtaaaattctgtctcctaaaactgtgactaatagccttgttccattgcataacccaattgattgattaagatttcgtagcagcattacaacaacaccttctttaagaacaagtttatgcgttggaaagttagtagcatttattgaattcagaaactctagggggtataacagatcgaaatctggaatttgctcagagctttttgatatggtatcacaacttaggtatactctagaatctcctggcactaaaccaataatataatcgtttatttcatcaaccgttgtattagtaggacaaacaattgcacgagaagccagatattcaatgtctctgtagcacgtaaggaaatctgagtaaacctcatgaacaatagcagctattttgtcaccgctagtcataacaagtaaatcatcgggaattgtgatccatgcaggataattctcaccttcctttgctgtcataggtaaagtgccattgcctatagctaaaacccattgactaaaatcatgcaattcttttttttgattgtctggtaacattggattgagtaatctcatgtttatattcaggctgagtagcgctacatgtttccatagttctgagttcgtgatagatgcattgattatagcctgacgggatcctttaggaataactgggagtatttgtttgaaatcaccacctaggacaataggctttcctccaaaaggtataatagaatttgaagggcatgtctctgataaaatatctcgtagcgttcgatctaatgcttcaaagcatcgcctatgtgtcattggagcctcatcccatatgatcaatgcagtttcagctaaaagctcagcaagcattgtgcctcgttttatattacagatgcttgtttcatcaatgtcgattggtattttaaaccgagaatgagctgtcctacctctaggcaataggagagatgctacccctgatgaagcgacagcaagaacaatcttgttttgtgatctaagttttgcaattattgtattccagagaaatgtcttgccagttccaccatgaccagacacaaaaaagaaaccaggttcattagcgatagcacgagaacaaatagtgttaaaaacagttatctggtcattattcaactgctgtacgaaagagtctgcatgcatagcaagcataagtgggtcaattgtgatttcttcatcgattaatctattagtaccaagaacatgtggaacagatgatggatgtggcaggttaaaatctttgatattaccaccgctatttgcaaatacagcaataagctcatgtagtagcatgttaagcaagtggtcatgtggaatcacacagtgtggattgtcaagggccttttttagcctgttatgtatgtcatcagtcatgtatagccagtatttatcaaacaatgaacgaacatcaccaacagaacagtaaagaaggactgtcacaaaaagttgtctaagctgcgctgaagacgcagtcactatggcctcatcaaaaaggagatgccattcattatctccttcaagaagccctcgtgcctcacatgcctctctatacgtgccataaacaacaccatcgtatgtgcgaacatcagcatagctttgagcacctttgacaatcattaacaacatcctaagatagtaaagctcgcctgcagttggatgcacataataaattctgccaattttaggagcaggtgttcgctcgtgccaagttttagatgatggctcccatgtccattccttaggaaactcacagtatgtcaatgaatgggccttagaattttttttgttagtttcaaaccattcagtaagcatagaccgttttgcaccaggactctcaaggactgcccgtaggtcagctcccttctcgtatctcacaaagtttttcccaggcagatggacaaccaatcgctcaacaggtggcactctataatgtatatcaaattcaaataatcgatgaagtgcctcacaggttgagagaaatcttgcatccatgtattctaatatttcattgcgtggagcaaggtcatgatttggtgatgcattttgtgtttttcctgttgtttcaaaatagatcctagctcggtcatggccttttgtaatatatttaaataaatactttatcaaatttgatttgttacaccactcaacatttatgtgtgcctcatattttttcagtaaagccatgttgtagggtacaactgatctattgtctaaaaggatcccattcttcatgatagatcgtccatcatttcttcgtctatagattgtaaacccagattcatcaacaatggtttcatcttggaaatctttaggataatgttttgaacatttatcgtttttcatacaaggacacttcttgttcgcatcaccgcaaggaccatgcatcataaactcgctaaccaattcatatcctagccggtcggtgtcatagtcaggtatttcagcacagataaacccatctattatagaggctgagacatcggcagtggcagcagcaagccaaactaagcaatgtatgtgtggaaggccacgcttctggaattcaacagtgtacaacactgtaatcattaagaacaaaggttgatgagtgccacaccaatggccttaatacgctatgaactaacaaaattgtgaccatacctgcaagaactttaccaaaagttctgccttccctaatatcagttataaattcattaactttcatgttaaacacacgcacaataatatcagctctatcagatggttgttggccaggctcaaatcgaatcgcatttgcaatttcttgccatttggaattacatgtgtatgtgacaaaaaggtcaggaggcccatagacgcgacatattgccatcgcatcttgataattcatgaccatatatcttcttcctccagtgaagctagcaggaagtatgacacgcttgccaactgaatctccatcagtgacacctttatcaattgcatcaacaattccatctacagactcagagcgcagctctttttgatgatcgatgaagtactgtagcctatttgtttcaatagtagaaaatatatcaacatcgatttgatcgctcaagcgaccatagcatgtgaaaggatttgattcatttagtctgtaatgcatttcatatctataatattccggcatcgtgacatactttttgccaattccatcatagttactgtatttaatgcctaaatggaatccgcgttcaccatatggaaataacaaaggatattgcaatgccatataagatggatgcaagggagaaatctggcgcaggccacgacctttatcgtagacaagcacatcaaatttgtattctttcgcagaaaaatcacctactataatagcagctatttcactgttcgttggtaaattgtattgcacatcgtcttttgcattgcaacctaaaaggcgaagtgtcacttgctgattgccatgccgaataacacgttctctagcatacctaaagctctggacaagagtattttcagcatcaagcatcgatgatagggcacgaattatctcaggatctgctttatctgaattatcaccgtcgttttcaaatatatttaatcggttttgtaattcattttctggatcatacacatataattgcgcaaatttgggaggtgagccacaggatggcacaagagtaccaatcctatggtgcacaactccattgatcttgaatacataaggtgcatttccagtgttaatcgatttatcaatagctgcacccattgagctgaaagcaaacatcgaattatacgatcgtatttgcctcaaaaaatttttcgaacgtgcatcaccattatagttcaataatgatgctagtggctcaagaggggcatgcagttttggcaattgtatgcgtcctcctttgcaacatagattgtaaattatttttctttttgaaatagcagatgcactcttgaccctctcctggtaccagaacatggcacgacaatacgggcattcatacgtcggagggccatagtatgatctgtctgggtatgatgctgccacaaaagcgctggacaatgtcaaaaatagtctcgtgtaaaaaaacaatacattacgtgcacgtattcagaacagcggccgaaccctttagcaatcggatatactccttgtctgtccgggaggaactaccgttggctcgtgcagtgcgatttgctgcgaacaaagacagtaaaacggcctatgaacctaaactgcacgaaaaaaaacaagcctaccatcacagacaacaaaaagagcataccatccacattggccaaaggaacggacggatccatatttgaacgcaggagggaacgcctttgcctatttaactttgccagctgaggtgcaaaatccatcaacgaacatttcctcttgcaccgactttcctgatggggctgccctagcggaacgatagcatgttctatatgcattgcactctgttgggacagaacatttgtggcccttctctgccggctggcacgtaccctacgcactctatccatagcatgcgtttctaactgccatcataattttacagaggcaagaaaagaatgaagcaaagaacacgggcaaaaaaagtggctcaaaccacacagatacagtgaacgaacaatataaaacgaccgaaagctctggagcaaccacatgcagatttagacagcgatgaatgcaggcaatagaaacaaaatactaaaccaatcaaccataaataaaggacagaaagattaatagcgcgggaatacctttagcaaggaatatgctcgtcgacaggcagaatccactaaaacgcaccacgaagcgaacacacaagctgtgaacagaggcaaggaagaagacggaacagagctgcagagaacggagcatgatcagtgaataagaatgtaggaagcaaagcataacacaaggccaatgaaaccagcaacaaccaaaagtacctgctaggtcttagaagcagcccgcacacgtgcaatggaagatgatcaggaacctttaaaggtccattgcagcccatgcagatcgcctcccctaaatggaacaaaaggtgcagggtcaatgctagcaagaacagccgcgcagtcataagcaaacaaacaagagagaacaaacataaaacccaaatgacagaacggacaggagaaccacacgcattgatccaggccttaccacgccataacgaaaagttgaacaggagcaaaacgagtgggagtttctcgagcaaggaacagaacagtggagcgaagaaaccgacgagaggaggagaaaccgaagggaagaaagaaagagaaacgcaagtagtaatatatacagacaaagatagaaggggttctccgccgagctgcagcaaggaagcaaacaatcatgtacacctgcacaccaaacacccacaaataggaaccaaacaaatggctagctgagatgacactgccccacctatcagcgatataagtgcagcgcacctagctacaacccaagaaaacctgaccagagattagctgtgttcggctgagggagctgggaacgcgcacagtacttttcctcggtgcacgcttttcaaactactacatggtgcaattttttataaaaagtttctatacaaaagttgcttaaaaaaattaaattaatccatttttgaaaaaaaatttagctaatacttaattaatcacgcgctaatggatcactccgttttccgtgttcactgtgcgcgctgggaatggatggagccgaacacagcctaacagcataggctgcagaagaagaagactgcatggaccaagccgaatgaaccaagcatccaagcggattggacatggcccaggacgcagaggaacggggcgcatacaccaggaccacagcgatgcctgatattgacaacccacgcaaacgcaccaatagcggagaagccatcacagagtaatcccactacaggcgcggtctccaacagcatatggtcctagaccgtaacacacaggttcagaataaagcagacccaccggccagagagaaactgtgccatggacacagggcacacgcgcaccaagcgaccaaagcaatctgacacagcagctaaggcaaacagcatagacctgttccacgttaggtacgaacaggcagaggccatgcggcccacacggcagccacaggcaatctgtggaccagggctacctcaaaaaacaaagaaatgcaccacgcaacgcataacaccggagaaaacaagggcagggacacccaccctacccggcgcggggcgcaatgcaccgcacacaaaccaaccaaatgaggccaccacacagggaacaacacgttnatnnnctngggcggagagcaattcactaanggcgcgcgt

SEQ ID NO: 3650 - DNA, 1077 bp, Oryza sativa
  unsure (1)..(1077): unsure at all n locations
cttccccacatagcaccacgcagtgtccttcttccgnaggactgttggggtcttcctcccggcgtgtgttgtgttgttctgattcttgagtgcgcgagtatgtgaggatgtgagtgcttgagctcaaacatgtggcaaacaaaagtggttctctagtgggaaatcagattggtacagttaatattggaggaaattggggtttatatatcaaagattcaagattggtatagttaattctaatgcattgtgttgacaacataggcgtgcttcgtcatttgtaagaacagcaacgctttcttttcctattgaccttctttcatgttcttaactaacattgtgcctcacaacagcggctgccgaacaatattgctcgaggctgccatgcacaccatggacagactgtaacattgctttcaccgcacgcaccaccaatgaccgtcgaactagaaaaaattgcaggatcattcttcatctcaaaagggtggaaaacctttgttcaccgtactggcttactgtctggtcaatacattcgctttcaagttcttactccatcaaagataaatgtccttctctttgacaagaaaaaagatagcaagctgcccatgatcccttcatccaagaaacaaatcaagacagcaccaaagagatcgacaggaatcactatcaatgacatgcctaccagcaagcatgcttccatgctcatttcacacacatcaaacaaaggtgcacaaatatttgtctacaatcctgtgctccatgatatatacctatatgtacaaatctatagccaatcacactaatgacatatttcaacaccatctttcagagacttcgtcagattcaaggacagagtcgatgactgacatttccttcagctccgacaattcaggaaagccttcatctgntcacatataactcaagtcttttccttcctaaatcaccacattagtatccgcattcttggcacagagattttattacacaagcctaccagtacagagaacaaatccgagtcactattagcatattaacactcatgatataattaaatggctacttacagaanttataggcatt

SEQ ID NO: 3651 - DNA, 724 bp, Oryza sativa
  unsure (1)..(724): unsure at all n locations
tcgccccatgaattcgaatagcgaatgcacnngcncnnnccnnnntnggnccctncacaaaacacaggagcagggtattacgcttttcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcatattcaattactgatttgatgaaactaatttagttttattaatgtaactatatttacctataaacttagttaaactttaaaattgaaactttgatcaaaatcaaaacgttttaaacagtactaagcatgtggtgccgtgacactctggtcacgtcgacacgtccgtaccgtacgtacgtattgcttgcgtgtggttgccacttgccagctcgatcgatcgggacacgagtagaatggagtaatggtaagtgcatgcgccacacgtacttagcccatataacgtaatctgttctgccatgcatgatactcccttcgtccttaaaaaaacaaaccatagttttcatgtataacttttgactgttcgttttatataaattttttttataattagtatttttattattattagatgataaaacatgattaatactttatgcgtgacttatctttttaaattttttcatatttttttan

SEQ ID NO: 3652 - DNA, 1409 bp, Oryza sativa
  unsure (1)..(1409): unsure at all n locations
agtgtccaagtagnacancagctttnnagcnnnnnnnnnnnnnnnnnnnnnnnnnnnnnnnnnnnnnnnnnnnnnnnnnnnnnnntaacccttaaaaactcatcaaatttaccctcaaaagttgcatctaattgatctttaaaaacaagcatagatgaatctattgtagatgcaatttgttgttggatagattgtgatacctcatcattgcttaccgagtcgggagtgagcttaggacgtggcccgggcttgatgatcacgccttgacgagtcctagtgcttgccctcatcaacgcctcctgcgtgaactcgttgatgtactcctccatagctttacgatcttctccttcgaagtcatccaatgtgaccaggatcatattggatggctccacctccgtcttggatggcggcttcatcatggcgaagtcgaagttgagttgacgatgaacggatctcttccccaacggagtcgccaaaaatcgtgttggcaactttttgtgacaagtcgacaagcacgatcgcaacacctaaacgccttgcggtgatatggagtcgccaaccacctcgatctaaccaaagggccaaatcaagatgggttttgcaaaaagaaaagctaaaccggctagcggagccgatttagagatcaaaatcagcctctaggctgatttagatcgatatgaggataactacccgtctcgtgggcaaaacggaaggttttcaggacaaacctacaaagaggtgtcgcactctcgcagcggcggcggacggtttacggcgcaaaccgacaaagatggactaaaactagggtaaaatagaaaacatagtaaaagaatgattcaagtagattgtatttgggggttttacaatgaaccggccttgtcccttaaataggggttggtcttaccctctataggcccttctctacgtccaactcgggatagaaaccaaaggaaacacgaaacatgccttcccgagcaaggaaacccgagacccgacgaaaacagactcggactcggaccctgccggtctgaccgcccacatacctgtggtcagaccggccctactagccggtcagaccgcccatatacctacggtctgaccggggttgtgaaggaaactcggcactctccaaactttggcaattttcctctatttcgtccataggtgccaaattttggtgtaaacacatgcccccctgcctttttgatgaatatcgtgaatctaaaagcatagaacatattgttttagggcgataatccaattaccggccataggactttctaagcatcttaccaaatgctcgggaagtatttctttaagtatttcccattaattgntnnnnnnnnnnnnnnnnnnnnnnnnnnnnnnnnnnnnnagttttatggtcctaaaagtgtcgcatcttgacc

SEQ ID NO: 3653 - DNA, 742 bp, Oryza sativa
  unsure (1)..(742): unsure at all n locations
cgactggggtttgtgagttggcnnnnnnnnnnnnnnnnnnnnnnnnnnnnnnnnnnnnnnncttggaattcgcaccgtcggaagtgcgtctatttaagggagttttggggattcatttgaagtccgcctgtagtggaaaaattctccagcccccaagcgcctctcgtcttctccactcccgcaaaaaccctagttcagcaacttaggtcctttcaccggcgatcttcgatcagcgatggacctcggcaagtcatcttccaccagcgcatcgctgaaggagcttcaggaagacggcgcccttcctggtcgtggagccatggagagggaagcaggaggtactaatccccagcccgtcttaggtcgcatggttgcgatcgaagactatgttctctgcggttttctccctccgccttccgaatttctcctcctgattttgaacttctatggtctttctcttcttcatttgaaccccaattctattgcctttcttagcatctttgctcatctttgcgaggcttacattggggtagagtcttttcttgatctttttcgcttctactacgaactgcgttggatggagtccaacagggtatctggctccgttgggttccgacttcgagatggcctgaagtcgcgttatatcccgttctagtgcccttcttctcgcaacaaatggccgaatagatgggtttatcttgaggtcaaagattcgaacccttgtttctcggtcccacagaacaan

SEQ ID NO: 3654 - DNA, 1103 bp, Oryza sativa
  unsure (1)..(1103): unsure at all n locations
agatggtnngatttggatnnnnnnnnnnnnnnnnnnnnnnnnnnnnnnnnnntcggggtatctttctcgtatttatcttgacatactcacgttcgcattcctcttgatttatcgaaacttggtcctcgattcacaggtttgagcagtagggccgtggagcgccaagtcgggcagttaatgatcagtggaccgacaacggcgagtgacgtccccgtgcccctttgtgaaaagggggcgacggagcgtgatgccgctattaacgtaagtatactcgatggacatcccgcctttcctcttgagatcatcttatgacttgattaagcgtaggctcttcctctgactgacatcatcgggccgctcgcggaccatcaggtggcggcgtctctaaaagagaaggttgtcaaggaggcgtctgatgctgctgcggccactactagtggtggcaatgctccgacaaaggggaggaagttctcctctgtaagcggacatcgtcgcaaagcgccgaccccctcggtaagttatcctatcgccagatcgcgcagccagagggattttgccttacttcgcgttggttgtctttcaggctttggacgcatctcccccgcctccgcgacgacaacgtcttgtgacgatcggcgagaagtaagtagttgggtttttaagttcccatgattctgttcaagcgttgtatgatccgtggtcgtcccatagggaagcgtgggcaaaggccgcgcagagcaagtcaggaggggcttccagcgcctcgcctaccgcggcctcgacggatgtcgtactcgcagctgggagccgggaggtgacgcctagtggcccagtcagcgatcccgcggcaggtcgtggtccgcccactgctatcctcgcctgggaggagctccaagtcgaaatggggcgcctcctagaagctggtgcccgcagcattggccacgaggttgcagaggcaagctcagaagcggcgttggcgaacgcgcgtgctgaccggttggtgcgcgagttggcggannnnnnnnnnnnnnnnnnnnnnnnnnnnnnnnnnnnnnnnnnnnnnnnnnnnnnnnnnnnnnnnnnngnncgnccatcttncccag

SEQ ID NO: 3655 - DNA, 743 bp, Oryza sativa
  unsure (1)..(743): unsure at all n locations
ggatggaatttgtagactactggtacagnagntcatcaatatgttcgcaatgatcaatagtatattgcttatgaaatagtcaaataaaataattaagtgaagcacccactagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgnnacangtgacctcacctgtgacggcccanagtgttgggcccgtcacaggtggtcttacctgtgacggctccacggttggcgcccgtcacaggtgaggccacctgtgacggccacatatttggagcccgtcacaggtgattttgactaggggtgacctaaggttggacattcttttagatcgatccataatcggcgcccacttttactcactaacttttcttgaccggcgtcttgcctttctttacctctttgacagcctttaatcccttctttccaccgacgattgtacctcttcaaccgcctcctttatggcgccaaattctcgccctctccggccccctttaacacttcttttcactgttttgaattttaactttccggcaacatttttgctggcggcct

SEQ ID NO: 3656 - DNA, 7617 bp, Oryza sativa
  unsure (1)..(7617): unsure at all n locations
ctgggatgacnactggtnnactgagtaacagctggnacagnacnncatcacgccctctacgccgncctccccaccggcgnctcgacctctctgccgacctcttcaccgccgccgtctttcgaccgccgccgtccatctccatcgacctctgcggcgccatctccgccgccctctataccgccatctacgccctctacgccgcctccccaccggcggctcgacctctccaccgatgccgnctcactcactctctcgacggccgccgggacctcctctcagtcgccacgccaggaccgtcgtcaccgccaccgggatctcctttccgccgcctcctcctttcgaccgggactcgtcgtcaccgtgtgccgcctcctctgctcgtcgtctcctctccaggtacccctctctctctgatgcccatgaatggaagaattgattctttgataattaaggaactttattaggtttagggtttgaaatttagttcaaatggaagaattgattgattggccgcagatttaatgttgttccgaggttatcaaaccatcacagaatacaaaatgcatgggaaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcctttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttttttatgcataagaacagattttctgtacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcaaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcaaaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaagatcacagaagccgagaaagagcgagcttggacggcaatggagaaatggttcacattttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctaggcaccgcagggtacatcggcaaggaggcaatatgggcccaagaagatgcagccgctgcagcagcgaatgtccctaccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaattttcgttcgtataaagtacaagttcgtataaacgactatcttcttttctagttgggcttggttactgaacaagcttcacaaagcgaggttgagtccgcgccgaagaggcgcaaagatgacatcctcacaaaggcgctcggaaccaaagaacatcctggccgaacttggggaattggtagcgatgtgccctggaagcatggactccctcagtacagatcccaatacaggaaacggaaagtctccaaggaagagagggacgctcgtttgaaggacgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgtagacctgctagctgggtatgccaaggtgtccatcgatacagtaaaggacacctggtcaggctatccgctgcccgtgcccccaaatgatgaaatcatgactttgggcgatgcacgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggctgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccgaaagttggacactggtcttctaaaatgctactccttgtaagtgcataccttctatacttgtgatatgactggactatatctcctaattaaattagttctaatacgtacatattttaaggttgtgttggatcgagagtcgtcgccatggtaatcaggttggattccttgatccatccatggtgaatgaggttaatttacgacagagcttcactgaggtggttgactatgtcaaccggtgtttatgggcccatcaagacaaggagtacatcatgtgcgcacagaaccaagaataagaggacaatacccttcgtgtatattgtttttgaagttaaggttcttagtactaacgctacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggttttcacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaggttgtgcaggtcgatgacattatggctttaatccatttggtaagtatatatgtggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactagaatatatctgtgatgtttctatttttcagagggcatggctagcaaatcctgaggctagccaatatttagcatttatttttttctggaattaactcatcagtgacgggtcggaacaaaaatccgtcaaaggtaacataacctgtgacggactagcaaataaaggcccgtcagaggtgacctacctgtgacgggcctttacttttgggaccgtcacaggtagatcacctgtgacagcttctaactacggagacctcaacctctgacggcctttatttcaagggccgtcagagatgagtcacctgtgacgggtcctaacttgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtgcgtagcatagatgagagaagagcattaggagacaacacattggcagccatgatcatgccatgctgggatgtgctaggtgcattcctccctcgattaattaatgtctcagaaccaagccgaatggctctgatggactgcagtgcgcatgcatctgagttgagcccaacaattcactaacagtctttgtgcatttgaacggcagaaggaggaagtaatataagcacggctgcacatcaagcacatgctgcagtgcttattacggagtaaaaattaacagagaccgatgcatacaaaagcatcggttttatcgcatattgcatggtaggctctatgatcatggccatcttccatcgttaattaggtgtccggaaattaatattattactgccacccgccagcgtgttaattgcacaaactacatggtgcctgcgcgcaagcacaacgagcccacatatgtgtatatatattgaaccggccatccatacattgatgccatttcatgattttaatgagcaccatccaattagtgagcaaatttgaataatttaacgacgaccatcgtagcgtagcatagatgggaggagaatcaggtccgctgggcgtgccattttgtttgatgaaaacaaaataacgaacacacaaaaaatagggaaaccttgtattttattaatcacgattcattaatatgaatgtttacaaatacatcagggctcccacaggagttcgtcttttgccttcgcgaggaatacttaatggaaatgtatgctgactggagattgcatgcagtccgctgattccccgcgcctagcaatgaggctaccggttaattatatccataggacgagcctatggaacacctccgattaagatgcgctttgtgatcgtcgtcttcaaaattaattgctcgccgaaggttgaggttggtgcagaaatttaatgataactgtgatataggtggctttgttttgccgaaacctggtcacaatatattatcaccacgtccatacatgaatcaggtatcataataaaggggatgacttttgcctcgtcggtgcccagtcatatatgccggcctttattagatatagatatatcgttacttttgcctcgttgaaacctagtaacgtgtatcggttcctatatgtttggacatgttaataatatcgtgactccggcttcgtaaaggctcggccataatttttatcttccaaagatcatgaatagctcccatgcgtgtgcatggtagcaaaatatattttgtaaaacccggcttagattgtccattcaccaatgaaagttggacatatctagcaccgttgttatggcatcatagaccaaatagtgtgaacgctgtccaatggtagtcatngcaggcatgcccag

SEQ ID NO: 3657 - DNA, 14641 bp, Oryza sativa
  unsure (1)..(14641): unsure at all n locations
ctagcaccgttgtaattggcatcatagtaacaaatagatgatccaatctccaataagggtcggacatctaattttgagcatagaaaatatcaaatagtattcggataatccgatcgccaatgaggaccggaccagccttataccattgattgtataaatggagtttgatgataaacgtgtttcggctctcattgatctggctttaatcatcaagatcaagatagattaagaacacgcagatgttccgatcgccaataaggaccgaacatctattgtgtttaatctagaaaattaatatttattcaatgtgctcaccatccagcgcaaatatcttgaatggcggcatgttgtcgataaatgactcgacttgacgaaggacgccggctgcggtgtttaattttctccgcagtggcagcggcaccggtttgctatcaccaggcgacttcaatctcctctcctgattttcctaatctactaagaagaatgggatgaatgaaaatgggcagatgggtgtctcctgtggcgtcctcggcgtcccccgctctagatgggttctgctccttatataggcagcggtgacggaaacagcctccgaatttccagcgccccgtgctaatcctcctgataaaccgatgcagggacgagccaatgcgtcgccgtgtactggagataattatgtgattaacatgcctaatgacggtgggcccatgtgtttaatcgcctgtcaatttccaaattggagataatgatcctcacgtagcaaagcaagtaacgatagcacttgcttatttcttttcttttaatagctccaatcttttgaatcgtacatcggatttaaaattcatttgaaccattactttctattcgaattatacatcaaaacgagtccaatatcgaatatattcggacaccgtgatatttaaaatttctgggcccatatgtcatatagacacgtctcgtatatatttaataaaattgggtggcagataatattttcgtacaaaattaaatgcccaataatttattatatcttatatgaatttttttgcacaaaaactcatcaaagaaatgccccccaccgagtatagtctgtacgcgaagtaggacaggctaatactcggtgaacaaatcatctattcagataaacctctccataaacgattaattttgctggtaactatcaccagtatatctccaacaagtccgagacgtatcaaaactgattagtgattaatccggcatggactccatatcgccgggcatatatattctcagcagccacgcctgcctagggtttcgaatttgtcgtccttctattctgaagtaattttctctaatctttgttcgtctcactagtcgggacaaacgaaccgatctacgtgataaagaccaggtttgctctacttgactatttcttgctttacatatcttgctaataccttgaaaccctcacgatcaggcatgtacttttcaataatcttgtcagctatttttgcctcccacttttgatagtactttaagatggggagagagagcaaagaaaacgttcaaatccgtttcagggcgagcgagccaaaaagaaacaaatcaccggagatcaacacgatcgtgatcctgaattgattaatacggaggagcaatgcgcccctactgatcaccagcgaaactccatggaatctggcagttcagaaggttctcgtgacatgcgcacaggataccttaaaacaactgctcacaatgtatgatcaaccttgaaccactttattgttttaaaacataagcgtgaccatactacttgcttgatgagcttcctgaacttcctttattatttctcttttattcttacagaaaatgccaatctcaatgtacatattatttagcgggtatgaaagagaagcaccgccgcaagaagaaaacggagaagcgttattgtggtgagaggattttgatttttttaaggatgcagagccaaccggtaatttacccgaggatgcacaatcaaccaacaatggtgaagcaaagaaaacagatgatttcatgagtcaggttgcttcatgtttgaatattaagtggggtcaacaacttatacgtgaagcagagtggatgtcgctcacgcagagtcgtgactgggcagcattccgtgtcccgacaccattttaaaaattacttgccaattgcaaggatgtccttgtaggtcatcaagatcaaccagggacacagccaagagggaggcctggcagcatgtgtctcttgaagccggttttatttaatgactccgggacttttgatgtgccacgtcatactggtacattggcacaaaagttcattacctcaagaaccaagcgatggttggaagatcagccaatgcagttaaggctagaaatttctcccaatgacaagctaatgctatgggctcgtatgctaatggtgaatccgtacgaccgtacatatctcaagaaggccggcgtactccgaggcataatggcgtctatttataaatgcaagatagatccttcattagtggccgcctttttaacttattggaatgtggatggacacactttagtcaccagccagggagagatgggttatcctctccatacaatgtacgatgccatgggcataccaatttcagggcgcctttatgaagaatttatccctttaccatccacagctcgtgggcatgtgcagactctgcacaatatatatgttgaggagtgtcccctacaactaaatgagggtcctggaatagtaaccatcgcgacatgggtcaatcacttcttcggcgaccaccctgtgccttttcagtcatttttacccaatggttttgctgatccaaaaaaacctttatatgagggcccaaattttcgtgttgagattcggaatggccgacccactgctatcatgtgtggtctcgaaatgacttacgtacacacctacccattggtggtgtaccgggcagcttttatcgccgcatggttatgcacatattgcgttccagtggaggaaggcaactttattcgccccgaggtttttactatggcaatggaaatcgctcaaggcagccgctgggccattggtgttacaagcatggcatttttatatcgtgccctggacaatgtctaccaccaagtagctgcacgtcaggcttctgcgagtgactgttcttcatttgtgccaggccattttattatgggctggtttgcatctttttggagagggttcctacgtcggcaactttatcttgcccggtgatgaacccgccctttattatagacttcagagactatgagtctatggatattaagagcgcacatagcttattttgggattttaatgatgctggaacggctttacgttcactggacttcttgggacggtccagcatccgttttcccacatccgaccaggaggtcgagttatttgatgaccgttctcccaaggcacacagggcaatttccatggcagccgtggatttcttggtcagctgcactgttggcggcgtcacctataggagaggtgaagtttttgacaatttggtttactgtcctcatcgattcgctcgcatgttcaactatgaccagcatgtccccaatttccttatgatcaccattaacaggacacgtagccttgattttccaagttacctaaatggcaattctagggatgaatcgctgcaacttttgcaacggcgccacctagcttttcataggccgaggggtcactcaatatttattcaacctttcgcccgggacaccatacgttcacttgattacatcaacgggtgctctcaagctttcaattttctaaagcatccgagcctattctgttcacggtcaaaacactccaccaaagctgcaactacgaaaaatgcacccggggcagaaacatcaggcatgcagtttaccaaattttttttaaagaaaaatatatactctgttatcaatatgaatggtcattggttactgtttcctctaatttattttcgtcccccttcttttttttaggaggttcaggaggtagggtgggcacacctaagcaaagaacagccaagtctgtctcgatctctcctgagcaccaggaggagagcgctcaaaccgagatcaagacaacgttgccattacccgcctcgagtgcgaaccctacagagattgtgagggtaggacccgaccggtctggaaaagacatcaagaaaatcagaacatgcattgccaacccagacaatgtcacaactcatgtgtctgcccaagcctcacaacaggagttattagtgttacctcctcgaaatgagactgtactcaactcgtcagccatgacgcatatcgacccctacagtgaagggttggctattccacatgatgatataggcactctgcccacagatcttcttacaggcgatttttctgatctagccactcttttggatggaggggcaaaccctgaaaccagtctctgtttagattcgcccatttttccgggtgctactcagaaggacaacgttaattcgcatctcctagaggacgacgagacgcgtaccgaggcttgtgctgatacagtaaaagggggcacctctcatcacggtacaactcatttattttattttatagacatttctgtttgttcctttttttatacaaataaccaatttcatgcactcccttccttcttatgtgtttcagcttcactgactggagttgaagagttgtccaatgaatccaagaagttatctatggatgttgagcaaatcgtcgcacaaattctaaaggcaccgaacgtagaccctggtgcaggggaaaactcctagttcaagggatttcatgggaacaactcggtgaccctgccgaaactttcagatgatgtttcagctcgtggtcttaaacatgtctggtctgagatcaaagcgtttcaagaattactcaaacaacgcccgatacagaaggatattgtgcttaaagagataagcatcaatctggatttgtggagtaacttcttctcaaaaccacctcctgaaataattaggctaatggaagggttacgtgtgcaaaagggagcgctatcagaggaagcgccactgccaaccactaagattgaccatcatattgatatgctccgcactgctcaagacaaggtggagtcatcgtgcgtcgctttggcagcactaacgagtcaatataacgtagaacgggctgtagaagaaggcaataagagggagtgctctcgacaagcccagaaaatcaaagcagagatagcaatgttgcaagcaaaacttcaacaggtggaagatgattattcccgtgctcaatgccaccaagatgttgtaatagagaacttgaactcccatcttgagcgacatcgacaagctaaggatcgaggatatgagattgcggcacagttagagcaggcgagcgtacaccaaaagtctctccaaaatattgaagactttactaagccagacgagtttggtctgtcccaatatgtctacaatatatttgattttttcataggctgctcattagatgagtagacgctgttttaaaatcttgtttcaggcttgtaatagctcttcagatattttatttgtttctgatataacagagtgaactcctttatttgctattatatactttgatttgcaccagaacaacggagtgaactccttcaaatttaataggagcgttgcattgttaccaaccgtctttgtgcactggcttcttccttttttttctttatatatatacatttcctcacataaaagatgctcacgttcagattttttagtggctttactactgtagcagtaacagtaacgccactaattcttcacgattctggttcagccatagattttttttattcaattttttttactggcttttaaaagaccagcctccccgctatagaaattatagcgaaattcatgcaacaatgcaaatgtcgataaatataccatagcgaagattcatgctatgacataaaattccttgtggcgaagaatcatgccgcggcgtgagaacaaaaaaaaatttaaggaagaaaacgtagcgaaaaattcgtgccacacactgatgattatatggcgaagtaatcataccatcttataaaattctattgcgaccaaaataaatcggtgccaaccaatagaaaattaatcaagctagacgcgaccgttaaaatggttacggtactaggcgtctaaactcgaagggtttcacagtcctgcattgaccgtactggcatgctttactgctcccaaatattgactgaccatcatccgaaaatcatagatgctggttcagtgcaactgtacgtaattgactgggccactgtgagaacgcgtcccagtataaacttgataggattaattgccgtccgaaaatcatagacgttggcataatccaattgttcatgaaataataagatcactgtagaaaaattcgttacagtgcagaattgttggaattaatcgtcgtccgaaaatcttggacacgggtgaaacccaattaaataataaaatcactgtagaaagcacattacactgtacaacttataatattaattgtcgtccgaaaatcatggacattggtatgatccaaccatatattaagtaatcatatcactgtaataagaacaccacagtaaacttagtaggaataatttccgtccggaaatcatagacgttgtcatccttcttttcttttgccacgtgttttttttgccacgcgtcataaaggccttcttcacacacatcttgtaaattcaggcttcaaatattattagcatatgagacggatgcccccgccgagtagagttcatgtgcaaagcaacagggactcgactcggggaaacaataaatgagttgtcttgtttccaaggaggagagagaaaaaaaatatgtgggatttttttttgtgtgttggcttttcttccggtcgccaagctatgaggtaacgaatggcaaactgctggaggatgtaatatgccctcaatttctgaataacgacgggatctcgcttaatgcttcaactccctcgtgtaacttgtgataatgagctcacgtttcatcaggatctcttgaaaacaaaggggtcttttctgagttttccttcaattatgtgcctcatattttttacctttatcccaggaaggaggataggataaggctatatttcaaaggtggtttgggtcaataggctatgaaattgccattacttttgctgagggtgggagatgactacttcccgctttcagattgaagaagagcaaccaacccggctacaggctgctgccaagacattgccatactttcgctcattttcttgacgatgtcgctcgagatgggagttcaagttctctgttacaacatcttgtcggtgttgtgcactggagtgggcatcttccacttgttgaagtcttgcttgcaacactgctatctctgctctaactttccgtgcttgtcgtgagcactctctcttgttgccctcctctactgcttgctctacattatattgactcgtcagtgcctccaaagcgacacacgatgactccaccttgtcttgagcagtgcggagcagatcgacgtgttggttaatctggtcctgttgtgcgagaacaagattagtagttggcagtggcgcttcctccgatagcgctcccttaagcacgcgtaacccttccattagcctaattatttcaggaggtggctttgagaagaagttactccacagatccaggttgatgcttatctctttaagtataatatctctctgtaccgggcgttgcttgagtaattcttgaaacgctttgatctcagaccagacatgtttaagaccacgggctgaaacaacatctgaaagtttcggcagggtcacggggttgttcccatcaaattctttgagcagggagttttcctctgggccacagttcatgttcaccgcttgtgaaaattgggcgattatatgcttaacattgatagacaacttcttggattcactgaacaagtgttgaatcctagctggagcacatgagaagaagggtagtgtgtgaaattgattacataaaaaaaaggaaaacagagtggacagagaagtataaaatgaaagaaaccagttgtaccttgcagagtggtttctcctgcccgcatgacagaattatccccattacaatgcttactagtggcttcggggcccactgccttgttagaaactccatctggtcgtcatcaagaagcttactagtaggttgagttgggggcatggtgcagatagtatcacacggcgtgtttgatcctccgccggaaaaatcaacatatgttgcggtatgatagatatgttatgtttccctgtgaggaagctgtgatgatccacatgaaaaaataagtcggtggccctgtttgatgttcaaacaagaggctactttagacaaccacatccacttcttcgctgtcccgattgccgttacatcttcgggtgagatattttgctggtcaatgtgatagaaaaatttgaagtcatcacaccaaagaaacatctcgccattatcttctcttggcgccttcttggctagtccactgtataatgtgtagattgaggacgcctcaacataggggttccccttttaaaaaaaagaggcacttataagatggatcaattcacggaagagtttaacgattcagaacctaacttctgtcccttttttttattatgatcttttcgccgtgagatttttgcatgccaaggcccctcccttgctgggaagtttccttgataccttcatcactatcatggccaggcaatggtgggtcatctgggatctcctgccaagtataagtggggttgcacacgctggtatgatcggcacgatcactagccttctgcattttcttgtcttgaacagtagcaaagaaattcgatcgactgctttccccagtcgatcaccgttaatttgcagtagctctgatcgaagattttaacgatctaacatgagctctgttttaattactcgattaagaagctgtacagactttatttatatatataggacatacggccatgagcccgtatgatacatgaactcggcttcaatatatatcagatcatgcacgtcatttgccgattggcagccagcttgtgaatcaagccatgtaccacacggagatggattaatccttcgtaacaatatactactgagtatttcaccgagtgaagtctgtcctgcttcgcgtacaaactacactcggtggggggcatttgtttgatgaatttttgtgctaaaaattcatagaagaaataataaattattgggcatttaattttatatgagaatattatttgtagcacaattttactgaatatatacgagacgtgtctatatgacatgtgggtctagaaattttaaatattatggtgtccgaatatattcgatattggactcgttttgttgtataattgaatagaaagtgatggttcaaatggattttaaatccgatatacgattcaaaagattggaactattaaaacaaaagaaataagaagtgctatcgttactacgtgagcatgcatggtcattggctgtggcgattaaacatatggggcccactgtcattagacatgttaatcacataattatctccagactgcagtacacgttgacggattggctcgtctctgcgtcggcttatcacgaagattagcacagggcgctggaaattcggaggccgcttccgtcgccgctgcctatataagaagcagaacccatctagagcgggggacgccgaggacgccacaggagacacccatctgcccattttcattcatcccattcttctcagtagattaggaaaatcaggagaggagattgaagccggccggtgatagcaaaccggcgccgctgcggagagaattaaacaccgcagccggcgtccttcatcaagtcgagtcatttatcgacaacatgccgccattcaggatatttgcgctggatggtgagcacattgaataaatattaattttctagattaaacacaatagatgttcggtccttattggcgatcggaacatctgcgcgtttttaatctatcttgatcttgatgattaaagccagatcaatgagagccgaagcacggttatcatcaaactccatttatacaatcgatggtataaggctggttcggtcctcattggtgatcggattatctgaacactatttgatatattttctatgctcaaaattagatgtccggccctcattggagattggatcatctatttgttactatgataccgataacaacagctttagatatttccaactttcattggtgattggataatctaaccgatgttttacaaaatatattttgataccatgcacacacatgggagctattcgtgatctttggaagttaaaaattatggccgagtatttacgaggccggtgtcacgatattattaacatgtccaaacatataggaacggatacatgttactaggttccgacgaggcaaaagtaacgatatatccacatctaataaaggctggcatatatgactgggcaccgacgaggcaaaagtcatcccctttgttatgatacctgactcatgtatggacatggtgataatatattgtgaccaggtttcggcaaaacaaagccacctatatcacagttatcattaaatctctgcaccaacttcaaccttcggcgagcaatcaattttgaagacgacgatcacaagcgcagcttaaaataaaacaaaagaaataagcaagtgctatcgttaccacgggagcatgcatggtcctcggcgtcccccgctctagatgggttctgcttcttatataggcagcggcgacggaagcggcctccgaatttccagcgccctgtgctaatcttcaagataagccgacgcagagacgagccaatccgtcaacgtgtactgcagtctggagataattatgtgattaacatgtctaatgacagtggaccccatatgtttaatcgccacagccaatgaccatgcatgctcacgtagtaacgatagcacttgcttatttcttttgttttaatagttacaatcttttgaatcgtatatcggatttaaaatccatttgaaccatcactttctattcaaattatacaacaaaacgagtccaatatcgaatatattcggacaccgtgatatttaaaatttctggacccacatgtcatatagacacgtctcgtatatattcagtaaaattgtgctacaaataatattctcatataaaattaaatatccaataatttattatttcttctatgaagttttagcacaaaaattcatcaaacaccagatgaaaagaaccaaatgctgataacttgttcaattgtgcttacctggaatctcttgcattacattcacttgtttcttttgcattacgctctcttgctttgccttctgcatcatttgactccgtagccgactacaccaaaataaatggtaaagcagcaaaaacacaagatgattaatgcaactagctccagattgtgataaaagaagcatatgtacataagacacactagtcaaataaagtgtgaacttgttcagttggctgtcttaatgcccagtattaaattttgcttttcagcagagcaaacggtcatcagactgagctgtagtttttgacactgcaatcatcattttcttttatatcaagctgtgatgtttataattggtaattcgtaccaagactaacttaggaccaaatttattaaggtcatgtgctggcaaatcagtacaacgttcacgaaatgacaagctctactagttgaactgcacagaaaatagagaatgtaatgcaatttactgaagaggcaatgacaacgtattatagaagagtacaaaaggataacaccaagttagttactgcttgaatcatcgttaacaggaaaatagcatggcgttcagacaaatatgttcatgtctcgacacagcaaagcaatcgccgaagtactattagttagtcatttagctcataaagacatgctatgtttcaatacagccaatttgctagccatttaaccaacgtgttccctttatgttggaaaacaaacacaaagtagccagtgctaacctaaagaatataaccaaacagaagggacacatatcgaacctttggatgggattctttctcagatacgaggtgaagtggctggggaagaagtattcgccgtgaaagactctcttataggccttgcaacgggagggtccttgtacctcttgcactttctttatttcatcatcatcttcttcttcttcttccacctggatgtagagggtgggcagtgaccgcagcaccttatttgtcatgtccaactcaacgatccaaaacaggaactcatcatcgatcttttccatgagcaggaaggaaacgacacctggatcaaccaagctcaggtgagaaaaagtcggcacagcacgcggaagagcacaggtgtgacctacggaattagcacaaagatcccagaactcggcggcttccattgtaaaatccagttcccaggtcttttggtcgatgctgaccagagtccatgccgtgatggtgaaagcaggagggtatacatccttgtctgcggtggcggcaatggtgacgcagaccagcttgatgaagaagccactgtcactactacctctaacacaaacacagcgaactgggtcggcgcagtaggactgtctgaacaagcgggtgctgccatctctcaccggtttggggagcgggatgaagctgaattgatgtggctcgtccccagggttgaggacgtcgatgagcaggatgccctggtagtagtcgacccagcacaggaagcggtcgtggagggggagcacggcgtcggtcctccactcgccgaggttgaggccgagcatgctcatggcgcgacggacacgcaggggagtgatgctccactcctccgcttcccctgattgcacaacacagagctccacctccttgctcccactggatgtgaggtgcgccacagtgaagagcgaccggccgtcctcgccgtcgccgtcgccgtcgcggcacaggaggccgacgtctcggctgcacatgtagcgctgccgctgctggtggtacggctggtacaactcgtcctcctcctggtcggtgaagccgccgacgaagcaaggcggcagccgcgtgagcaacggctgcgaggagggggaggcggagtagatgaagtagtcgagggggtagtgcccatcgacgttgaacccgggttcctcgaaggggacggcggcgacgaagaggatgcagccgcggtgggcggcgatgacgtcggggtagcggacctcggggaggtcggccggccactggggagggcagtggaggtagaggcgggagacggcgggcgggtcggcgacgccgagggaggcgcggacggggaagccggtgcaggtccggccgaccttggacgccgtgatgtcctcctcctcgtacttgtgcctcctccgccagctgcagcggacgtacgggtcgaggacaatccagtccgccgcccccgccggctccggcgatccccggccttcttccatgtcgccgcgccgcagttcggtgttcggttcggatcggatctagctagggttttacctcccactcccagatgtctcgccgccggctggagtgggattggaacaagggaaaggggaactgaatggggatatttcctcgggaacgggaaggaacgaaacggatcccctcctgttgaattttttttatttatacatttttttattaaaatatttacaaaaataattttttgtttcgaaaatttacaaatctaattgcctgccgcctttaaaaatcaccctctcaaagggcggcaagggacctaaatacaaaatttttatttgtgttcaaacccttcccaccggttttaattgcttaaaaactaataatgcttattcgatactccaaatgattttaaatggaaaagtgataaactacaaagttagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattattttttaaatattttaataaaaaaaagtataaataaaaaaaattcctcctgactttggggggtggaaagttacggtgtcgctgcacttggtttcatccctgccgaccagttcatccaacggcacacatccatcttccctcctgcataccctattcatattgggctacccagtaagaaatccactgtggccatcggcttgcccatcaggccacattgactttgttgcctgctaccacatgcgcnnattgatggngtngtttcagtanagttcaacctaagacag

SEQ ID NO: 3658 - DNA, 6454 bp, Oryza sativa
  unsure (1)..(6454): unsure at all n locations
cggcgtgattcgcttctactgcacgtagttcatcacaaccagngaggaaggttatagttaacaagcagaactggccatgtactgtgacgactgctcaaatcaccgaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagattttgagtgaatataatgtaaaatcggagaggtacaaggggttttataccccgagggcataaaatcaccctcccagagagtggcaagggggccacctacaagtgccatgccatcctcgccacccttttgcaggcgacctcccgcacataaaaaaaaaccctctggaacgggacaaggggtccacctacaaaaatgctgggccgagcacctgcacattaaaaaatcgtataatcgaccgcgttgaataattcaaaataagacaagtttcaagtaacatcattcatgcactgtaaatcgacaactaagttttggacaacactataaggcaaatggctattgtgactaaaacaagaataattaactatttaccacgtttacaagtggtgataaagaatttgtcactggacccatatatcatagacacatgaggacccacatgttatagacagtgtcagattatgaataccgcgtacctaatagtagttgactaaatctcggcatgagccaccacataccatgtcctatatggaaacaacctgcggatataggaggagttccgggtaaggaaagacaaccagagttctacatggaaacaacaaggactactcggattgtatccatattggtttcccctagttctacttgaacaagagaacacctataggtataaatacaaggccccctatgaggagaggggatacgaccacctcaatcaacacccaccatagaagacaagaacaatagatcaagacacaagatcaacatataagccaacatacgccaagacaagacgtcggatatcgacttcaaggataagcacggctagtcccctacctggcacgccactgttgacgtttgatgtcgcgattctctcgaactagtacgtagcaatctcccgcaccgtaacctccattggtattcgagagatgattctactcgctcgctagttctcgaaccagtacatagcaatctcccgcaccgcaacctccattgatgttcgagagatgattctactcgctcgctggttctcgaaccagtacgtagcaatctcccgcaccgcaagcttccattggtgttcgagagatgattctactcgctcgctggttctcgaaccagtacgtagcaatctcccgcaccgcaagctccctggttctcgaaccagtgcgtagcaatctcccgcaccgcaagattccattggtgttcgagagatgattctactcgctcgctgggtctcgaacaagtgcgtagcaatctcccgcaccgcaagtttccattggtgttcgagagatgattctactcgctcgctggttctcgaaccagtgcgtagcaatctcccgcaccgcaactttcattggtgttcgagagatgattctacttgctcgctgggtctcgaacaagtgcgtagcaatctcccgtaccgcaagccttcattggtgttcgagagatgattctactcactcgctggttcgcgaaccagtgcgtagcaatctcccgcaccgcaacttccattggtgttcaagagatcattctactcgctcgctggttctcaaaccagtacgtagcaatctctcgcaccgcaacttccattggtgttttgttttataagagaggagaggtggctacatggccctatatgttttgttttattttttttcctgatgaggataccacgttagcgaaaccaaccatcgatccatactaccataagacttagtttaacccaattttataagttgtaggggcatactttctccatcccaaattataggatgcctcttcttaaaaagttaaactcgataattttaactaataatcatactaaccctatcttccaatcactaaccatatcttgcagtaaatgttgaataggggatgcatcggttcgtgctcctccatgtatagccggtttccaagttcccaaccttctcctcagtcctcacgttcacatcttccaagaacgatacgcgtgggacccaccattcccacgccccaattcaccacccaagccgactgacagcgaggccccacaccttcaaccccaccattcgaccccacacgtgagccacataacccaaaccacccctcgtacgcaaagaaaataatctccgccgcggcagcgcgctgtcccctctgcctctgacacgcgcagcgccaataacgagacaaacccgaggaggaggaaaaggatcgctggccccacctggcaggtgacacagccgaggaggggggaggaaggttggcccccacctggcagtgattcatcaggggccacgtggcgtgagggattcaaacctggtggtgggttttgtccatggggtcagccatgatcgctgcggcctgagctagcccgaaacggcaaaagaccaaagctgcaaaactttttccctctcgctcggtctctcctctctcgaggagagtgcagcggcaggagtgggggtagtcgcagcagcggatcagacacacgaacagagagagagagagagagcagacaacgagtacttcgctttggtttgatttgtctccttcccgtggtgtgttggtggaggaggagaggaggagcatttgagattggagagggggaggggaagaaggagnaggttggtgcagtactgctgggtgcggttcgggggaaaagcgcggatgtgagaggtaaggcgcgcagcgtccagcgatcgaggagatcgttttgatgttgattcggtttggggggttttggttgccttgtttctcagattcgtgtgttttagttgggtttctcgtttttttcgaggattttcgccgggatccgtgtggttttggcccccctctttttgcgcgtttcgtttcctcgaagctctcgtcgcgagcatggcgtacgtcgcctctgttgctcgccgaagcgacgagagggggaggaaatggtgctctgtttccggtggtttcgtcgtgagatgttggggtttgacaagcgccgggttctcgctggcttccatttgcctggagttctcgtggattaaatatgccgttatgtatattgcgatgatgcggttttttttcgcttgtgctttttgcgttttgtgtgggtttgggaaaatttttaactaccttgcggtgctttcatttgatttctggattttggattgatttgcctcatttgacaaggatttttgaggattttaatcattccccgtgcaaagtaggggaatgcttgattattctcttttcctttttcagaatctccgttcggatttgtccgatgcacaagtcatccatgcgtactgctaatatgcgtcgtctagtgtctcggcgcttctggattgaccagtgctagggttttaggtgctgttcgttgatggcttcatgccttgttttcctttttttttttttggagatttgggcttttcgatgatttacgttcgtgtgtattccacctatttgtggtgccacgattcgaccaatttcagccgccgtgcgaaattttccttgtcgtgcctgcttaaaagcagaggcgactgatggattcgtggaattccatttttgtgaatctgtctgcagtttcagtcccatctcctggttcttccgcttgctgcttttgtttgaaaatgtttagcgtacagtgcggcgatggctcgagtttcgtgggtttctttctgtacagagatgatattttgtttcttgatttcgtttatgtgaggctatgggttttcggttgatgtaaacttgagcgaaatttatttatgtgttcgttgtgttcatctgtgtttcaagtgtttgaagagttcgttttgtggtttgattttggcaggacgcgagtgaagagacgaccgggagcatggatcgcgccaaggcagcagcgcgcaaggacaaggcggcggcggcggggaaggagaccgccgtgtcccgcgccgtcgcgttggacgacaccgcgctgctgctcgcggcggtgggaagcttcaggaaggagggctccgacgcgtcgcggatgctggaccaggagatgtccacgaggctgctccacctcgcctgcaagcacgacgccgtgcagtgcgccaggctcctcctcgagggcggtcacggtatcaccgcgtcacccgtggatgccagggaccagctcacgcggacgccgctccaggtggccgccgaggcgcactcggccaggtgcatcgagctgctgctctccaagaacgcgcgcaccgacctcaagctggtcgatggccggcctcttctcgcgctcgagatcgctctcttgagcagaaggtatgcacgctagctagtgtcgtccattgcttgtgatggtgatcactgagctcacttctcaaattctctccctgcaatggctgtttccctgtactgactgatgttcttatccagagctcaagttaaatggtcactggacaactccattgaggatcttctgtcttctctgcaggaaaaggtctgtatggttactaccaatgttcattcgctgtctcatcatagctggtccatacatcttctcacacagaaatgccaccttgttccatgtgtaggatctgaatgtagtgaggctctggcagagaaaaccagagaggttggggaggtggcctacagatatgccatggagggtcgtgttactgtgttggcaatgctgcttctggtggctgaagagaagatatcggcaccagtcagtgtagtaatagagggcgtcaggacaaagaaatcaatctactactctattgtggatgaggctctgtccattggggatgctccagcccgggacagcaatgagaggagaaaggccctgctcagtgagattcagctacttaaccaatttggggcagcgttatggagagatcgcaacattgacaagagaagcctgccccctctgcttaaagctgccaaggtacctctgttcatactgctgttcttgttgacagttcacagagctatttcagaatttccttgcttgacactttatgtggtatgcatactgatgagttacaattaataccatgtaagctgagcttttgagtcattttcatgccctgcccaatttcaaaactaaaatttctccaattatggtccatgcaagatgcttaaaatgtgctatgcataacaaggtgaagtttttagtgttacaactgtatacaccataagactttcttctgactgacctctcctgtaggttggagatgtaattacctgacaattcaggggcccgaatctgtataaaataccggcttcggccaacaggatgtagggttattacctgacaattcaggggcccgaacctgtataaaataccgctttctgtgaggaaaccaacgaaaaccaagctacaaccccttttcgatcgcatgtccaagaaggtggccggttggaaaccgaagtttctctctccggatggtcgtctttgtttgatcaaatcagttttgatggccattcctgtccatcttctttcggtcatgcagctcccgaagtgggccattaaagatattgaacgctgctgcaggggttttctatggaaagggcaagaagaagttagtgggggtcactgcctcgttgcttggcgagtggtctgcaggccggttgagtgtggcggcctgggcatcagggacatcgatcgcttcggaaaggctttaaggttgaaatgggaattcaacagactagagcaagaagacagaccttggacaatggtgcggtggaaatctgataaggatgttcgcgacatcttcaattcagtggcacagcacattgttggagatggcaatcgcactgatttttggagaggtaagtggctgccccgtggaggaagcattgcaaacaactggcctattcttttctcctttgtgggtcgcacgaagatcaccgttgcacaaggcctgctaaacaacagatgggtgagggatttgcaggggtctctctctaatagagctcttgttgattacctggcgctttgggatgagctgcagctcgtctcgcttcagagtggtgaggcagattcagttttatgacggttctcagctaacggggtcttttcggcttcttcggcttatgagtttctcttctccacctcaatcaaatgcccccacggggagctgatttggaagaccaaagcgccagcaagagtgaggttcttcctctggttggcggtgaaggggcgttgcctcacggccgacaacctcagcaaaagatgatgctgtcctacangagagtcactcaccgcg

SEQ ID NO: 3659 - DNA, 1143 bp, Oryza sativa
  unsure (1)..(1143): unsure at all n locations
anaaaggttggagatgtaatgtcacaaagatgctcctgatgggggatgttgatgtcaatgaagccgatcctgaaggaaacacagcacttcactggtgccttagtggtagttcaagcacacaggagccaaggtatgctatcagaattttgttctatcaactgttaaaaacttaaaatacaacatactagttcttactgctctttgcattctctttacttagttgtcttatgtatttgtgcaggattgtgtggctcctgctgaagaatggtgccagagttttccaggggaacaaacttggtcttacaccagtacacagtgctgcagctaagggaaattataaagctcttcaggtagccttttgttgcttctactcacacgatggcattttttgagcttataactaattgatagtatgtttgtttgctctgtaagtcacttctgcttcacgctcaagattgcgttgatacaccttccaagaccaaagaaaccccattgttcttagcagtgaagaatggttctttggactgtgtaaagcttctcctgcgttctggggctagcaccaaagtacagaacctaaggtggtaatatttggatttaagaagaatattgcttctgtttgatggcttgatgcacttaccatcctgtgatcctttgacattgaacagaaagcaaagaccaatagatgtggcaacgtcccaagatatgcgtttcattcttacctctgcaaatgtggctccatgtaagatattttctgacatttaaagatatttatcaactgaaatcacaaaaatgtttgtagtagtgcatacaattagcagtgttcgattcaatgaaaaagatttgaagattggtttcctgttggttttactgcataatgatcaatacgcagcaaataccttttcaacggaaatatattctgtttgtagggaaccgtagctcacatccggaaaaaagtgtgatgagcaaggaatttctagatgacaattttgttgattatgacagcaatgatttaaatgaaaggtttgtctggtgaatggtgcatgatttatatcagatcttccattcttttgaatactagaagcattgcttctcaccctatgtttcaactaatatataattatttgatatgtgcagcttactggc

SEQ ID NO: 3660 - DNA, 8009 bp, Oryza sativa
  unsure (1)..(8009): unsure at all n locations
cgttcctggtgaccgtgnttatgccgnaccncatcactcccaccttctgtgggcgctggtaaacttcagaatcctgaactacttgtacttaataaagttagaactaatgtgtttcgaagttttaacacttgccttgttttgttcttcctggcagagtacctcactgagttcttcactgctgaatttggacctatggaggaagcagtagtcattgggataaggatgggtgatcgggtgcaatccagaggattcggttttgtaaagttcaaaagagaagaggatgtgataagtgcaaaggaaactcatcatgtgtacatgcttgggaagagagtggaggtaaaggatgctgttgctagaggatccttgccttcagaaatccagaaaacttcttcattcaggcaccacaaccaggaggttccaaaggtaactcatcatctgttgggtggtgagctaaaggaggaacattacattaggaagcggaggcccttgccagagaagtgtcttccatcttggttctttatattcaggaagtggctgccaggatttcttgcagatgctactgaacgacttggagataggtacccattgagctccctgaagggtgatttcagagcaatttgcagaatggagcttgatcatagcacacttggttatcctaagctcagtgatttcatgcgctcccttcctggtatctgcagaatgtgtgtagtccctgtaggaagcggtcctgcaacacacaaggtcctccttccaccggtctcgcgaccgaagtatgtacccttgctagtaccattctcctttgatcatgatgagctcccagaatcagtgtcagatcatcagttcccgatgtctccacttaccactaatatcaccgaggactcccctcgtaacacagacagtcagcacggtgatacttgcagcgagagcaatgcggagagccagcaggatagtgcttccactgacaatggtagccaattgtacacttcaattgagcctgtatctacaagaaagcttgatgtagttgagcctctacctgcaagaacacctgatcgagttgaacctcagaagattggttctgatcctgcgagaaagactatttcccttgaatctggacttggtgtgcagattttcataggcaatggtagtgcaaatttgtcactacaggtcgacgtcaagaaagacgttgaatacatgctgatgttatatcaaaagagaactggaatcagcagtagaaatatctattttgtatacagagggaagaggctcaggttaaaccgcagcttactatcatatggtgtacagaaagacagtactgtgaatgttcgcagtagaattctggggggtgctggtacatcactggaggaatatttacacaagcacaagaatagtcttgtgaaaaaaaccgccttgtatgatggaagattcttcccagagttgacacccaaaagcagtattcttttgagaacatgggtcttatgttttacaaaggcattcaaggagcgacattgctgggagcccaaatgtgaactctctcatttcaaggttatcaatggtcatgtcaaggttagcacaccagcaaaagggaacctcacaacgcattttctgcaagaaaatttatcttttctggcaaagacattaaaggatttcttcagaacaattggaacaaatcttgtctcagaatacccaccgtactttgaatattttatgaagtttatattgaaaatagatctaccatgcgtaccacatttgcagaaagttataattgaattgaacctatgctttatggattcatacatgagaggggtgctgacagtgagattgaagcaaaaatttgatagcctacctccaaaacaaagagccactttgatagataagatcaatcatatcacatgggatacatctcgaatgccaaatctttctacaattcctgtctttgataaaatcatcaaaaaagcaaaggatgatggagagccttacttcattgagaattcagtgaacttggagtttaaggcgttcaatggatttaggttgagccgtgatgctcctatacatgctcctcaacacagatttgtaagtatctaacttgcttcagttttatttaattgtgaattgtttttattatgcttaatataatcatatccttgtcttattgcttttgtttgcttatccactaagtatcagtagtagtttagttgctcttttcttgttagtttactataaatatatgccatatgcttcgaataaaagatatagcttcaaaaaaaaatcaatcctctgttctgcttgctctctcaccctctactcacctccttcagttcattctcaacatattataggtatcacagtgctatttgtacttttcaggacaaaacatcggtaccttggaaggaaaattttccagataatacaatagaattgatgacacctgcttatctgggtgatttgcttcccgaaattatctggtgctttattctaaataaggtggacatcacagaggagtaagtatactgaactttttgtgagcttcttttacataatactttaattctaatccttatttgttgctactaatagattatcacaaagtcagactccatgctgtactatgtgccatcctataaaaacaggtaatatttacatcttgtctcatttatcttgatgttgcactctttgtaactgtgtaatagtttttgtgttagatgtgggtgaatatcccacgacacagcaaactactgtgcaggataaacagcctacaatggaagatgttggatcctcctcatcaatgcagcaaaatgtatggaagaaaatctggtaaggcgaatgagctgaagcttcacaacaaccaccaccgatcgagcaggagccggatgaagggtggaaaacagtagggaggaatggaaaaagtacatgttagctgcctcttccagctgatgaaaaacaggaaaagcttacaatgatcgtccatatgatttgaaaaaggggactgcagttgatcattgtgtactctttgtgcgggagttttgtaatagtagtgcttttgtattagaaacaccatgcttgcaaatagcttaaccatccaaactcatcagagggtactaaatgttctctctctttccaatcgcctacaacagactattaatgtgatgaaccttcaagttaagaaccgatattaactagatatgatgttgcttcctggccagtttgggtgtgaattatatttgctttagtttgttctgaattctgactattttcaagaatggcaaaaagaagaggatattttggtattacttttggagttcataatcacctattatttattactcttaggttatttacctgaccaattcgctatgcagctgaggttcctggactcatatagtggtaattgtgcaatttaatctggcactttactctaatcagttcaacatgtttatgtcttttagaagtagaatggccagttggatttgaatttttttttctttcaattatcatttatttttttcttttgtgtaaacacaatgttgtatagtctcagtgtgagtaatattgtcacctgaaaaatgaaatttttgtgccttcaaaaactttcatctgaagaagcattatcacattgtttctcctgctctggacatctttatttctcttttttttgatgtattccttgaaatctctacctgttctaccttttttcaagataatgttcatgtcctagcattggtccataacacactttgtggtggtcttttctggattggaggttttaacttttaacatggatgtcctgtttaattattagtgctcctttgtgccaccaaatcacaattaggaatctagcaagaggggtgaaaaccgtacggaaacggacgaaaaccacctttatcgttttcgttttcatacgtttttcagaatcggaaaccccggatacgaaaacggaattgaatattatcgaaaccgaaaatgaagcgaaaacgaaccattgcgaatacggtaacgaaaatttatcggaatacaaaaacccctcaaactgataaatccaattctcaagtctcaacggtcaacaattcatcataaaacataattatacaagtccaattgttaagtctcaacagtatatcacaaagcacaatctatggaataaattatctatgtttaagagagaaatgtcattgataaatcccaatgcaggaaataaatattcttatgtaacttcagatttgaataacaaatattttttaaaaaataacagccaaacaccatggtattcactgttcagtgcttaaaaaagaatccagggtatttcaatcacaaaatttctggaaagttttcggccgattccgagttcagacgaaaactgcccttatcattttcgattccgttttcgagaaaatatttccgaattcgtttccgtttccaaaaaattccgaccgacagattctgttttcgaaaataggttcggaatccggaaagttttcgtaccattttcaccccctacctagcaatgatttatttggtgcatgccttttagagcccacatatcctaatttactgtgtgtatagggttaatttgatctatgccattgcaaatatgtctattcaaataaatgatgtaattcgtctgtttatagctgtgccactcaaatattaaccaactgggccttacatacttcatacttcattcatgaaatccaacggacgaaaatcatctaatctaacgcctcagatcgtcccacatacccccttcaacctccgcacgtattccctcgccgaaaatcatgccgctcacatcgctcctcctcccccacgcgctccgcaacctgcgccatcacctcccatgccaccactagcgccgccccactccccggggcaaacctaatcgccgccgccacctactcctctctcccctgccgtctcaagctccacccccttgctcctcttgcgccaccactggatcactctccaccccggaggcaccgcgggtgatggcgacgcggcggcggtgccagaccgccgtggctcctctctgctctgccccttccttgtgcctcaccaccttgctgttgaaaggaagaaggaagttgcaaccactggtgtcagcgacgtcgactaaaccctagaaccaagctccagaatcgatctccttttgcttaccggtaatgggtgagccaattccgagcctacaggtacggactacttcctccctctctccccgacaatcacgacatcgattgatttatcccattgctcctgtgaacttggtgcattgtttgattcccaatttcagaatggcgtgtgaaattgcaagtacagagcgagcccagtcagtcatctcctcaccagcacggcggtacgagaagtttgggcacaacaagcaagcaggaggctagcaaaggtttgtcagctctaatccaaaaaacaacaccttattgcacatatgttccatgtatgtgaaagaccatatctactgtgcagacaacatgtgttattatcctatcgtcaaatctgatatacaaactatattgatatttcgagtgactgaataatcatattatcggtataggttagttcttttactcttctttcctggtcatattatcggtaggatgagggtatattggttggagttgctggcattttcaatggcttaaaaagtgatgttcagggttttttttccttggcagaagaatttgctaagaggctttgatgaggtgagctatccactataaaaataattttgtttcttttttgtactgaaagtgcctcattccttgtgttttctcatttcctgtggatctgcaggtcagggattttgttgcagatcagatgtctttgagggtatcacatttcatgctgaccgactgcatgagcagtacatcaattttcagctacagtgccactctacatatatactccctccgtccctaaatataagggattttaattattacaacaaatctggacaagcttcccatccagattcgttgtactagaatgtgtcatatccaaccaaaatccgttatatttagggacggaaggagtattctttactattggttatgacactcataggcttttatttctatagaagttgatgagtgtgaaattcttctgatatggcaggaaaaactgcaatttgttggccatgtagttcttgcttaagtacttactaaacaacttctgcaaagacatcttttttttatggcagactaggagacttgtctattctcaatcaattatataggttcacatacacttgtactcaaattcgtggcattccaaggttaaaggtgctgattagtggtcgtatcatgaggtcgagaaacatgtagttattgcgatgtatagatacatcataaatctgagtaaatcgttaagcaatatacattctccattatttaattattgcaattgttaattatgcttaaaaacataatgttaatcatgctcaaccgtaatgctggcaactaaaaatattacctagattgacagtagtacagttgaacatttgaacaatacctagactgacagtagtacagtttgggtggtgaaggtctcattgctcactgatggctttctaaatcccctatgccgccgtaagcctgattatcgtagtatattatttctttgaggtgttataggtgatatgaatgggcatgtacactgttatggccggaataaaacctaggtttgatgcccatttacatatgaagaacacacgaattaatttgatcagttattatgctttattctgcttgtttctatgcactacaatgccaatttgagtgcctatcttgtcatgctattcagtgtaatgtcttggcaggctatgaatctgttcatgcgtctatatgcagccttcatataagtaaggattaaccagattacttgctttgtctaatgcagcctcaccatttcatttgtggtgagcaccttaattccatcttgacattgtcgagggagtatatcatctacatctaattctgtatattgagtatatattgactaggatcttggaatttttatattaagtttcttagtttgatgatttgattagtttttcaactaatcaccattgatcacaagtaaacaccactaatagaagtttaatggctatttatctaaaaaggaaaaaactaagtttaatgattgaaactgcagtggtactatgatctataaacaaataaatctgctgagtttcctagcagctgctgggtgcactttcctcttgttgtgtcttccattaaatttcaaaactgcaaattctttgtataggtattacggggactcaaatgtacacctttcagttcacactcaattctgtataacagtaaaagcgtgaaaatataggaaagataattgatttgttcagaaaattattcaaatgctaaggtaatcactttctcaacatatgtatatgtacaacaatgcataccgtttctacttttcacagttggaacctgaaatatcaagattctaaaactaatgtgtgtctgctgcacagttcttaaaacaatgctatggagtattctatgactaatatgtgtgtactgtacagttctgaagattgttcaaagtgtggggaacttccgagggaaagttcgtcaaaaaactgcaggttaccagtgttttggtggacattcacatatttatgcaatttgatatgctaaatgaatttactactaatacattacatcaatcttctggttgtaactggttcagtggaccattagagctttctgttgacaaaataaatgagctttgttcatttatccaacaaacttgtttctttttctgaatcttgctccaaattttgtgtcatattattgactattatttttaaaaccatacaaataatttggtagattttttccctttttgctggacaaccagaactgcattcaattgtatgatttgtatcttagtccttttgcaggtaagggaatcggagaaaatatcataatggaaacagaggaagtgatgtaattctggaccctaatttgtgaactctaatn

SEQ ID NO: 3661 - DNA, 1972 bp, Oryza sativa
  unsure (1)..(1972): unsure at all n locations
ngtcaaaaacaaaattaggtgagcagcctttttggttcggtcataacctgttaacaatgcgnaagtgggtatgagaatcataaaaaaaaatgggcattggatatcagtcatctgcgactgttagaattagatctaacgggttatgttataatggagctgtggctattcatcgaagcggcattgtgtgttgtggatataaagaaaaggcatgcttatttcaggcagaccacaaagatacttatgtctcaattccgtaggcacccagtatgtgtattacagatcattgctgctctttttaggaaacatatgacatcagtgttgtacgttttataatctgacacaaagttatggtgttcatggtgtccgcggattgtatatatatatatatatatatatatatatatatatatatatatatgtacatatatatatataggagcatgtaaggcaaataacagggattttggccaaactgacaaaccaaggaaagagataaaggtttcttgaatattataaaaatacaataacaccgtagcattagcacgggcatattactagttttataaaattgtaaccatgccatcgccgtcacgttttccatcttcttccccatctgcacgtggggcccacccgtcagattcatcttcttcctccatcctctcctcttttctttttttcccacttctctccaccatgttcatgatgttcgccgtcgcgccggggaacgggttgccggcacggaggttgttgtcggcgtccgtcaccctgtgcaccaccttgtgcgtcggcttgccgggctcggccacgccattctcttgaaagatttcacatttctcactgtcaatttgacaaatgaactcatccaatctagggacaacatctgtttggatttaacaagaatggaccaaccaagatcgaagtagtcggcggctcgacgccacgggggagggcctcacggccgaggcaatgcggaggccgtcacgccacatgtcggggtccctgaccgccgacacgttgccgccgccattcgtcttgagtctcttgacaaactgcgccaccgagtagcacgagatggcgaggacttgacagactgcaccaccgagtagcaggaggccgaggagagaagtggtgtccgccacaggcccacgtgcatgggatgaggccaagaagtggtggagagagatggaaaaaaaaagagaaaagggaaaggatgaaggatgatgatgaatctgacgggtaggctccacatgtagatgaggaagaagatgaaaaatgtggcggtgatggcatggtttcaattttataaaatttgagtggcacaactaaaaatagacgaattgtaatggcatttatttgaatagacatatttgcaatgatatagatcaaattaaccctatttttttttatgttacccaatcactaatactgtaaatctaggaaatccgtggtagcgtgaaatacttcctccgatttttaatatatgctgttaatatatgaaaacgttgacttttatacatatatttaaccatttgtcttattcaattttttcatacaaaatataggtcatgcttaaattttttaatgataaatcaagtcaaaagaaaataaattatatttattttttttcaatattatgacgaaatatcttaagaagtcaataacatcatatattaaaaagctgagggattaccatttttggtccaggacaacacagtgccatggcatcttcctatctgtgctggtaaactaaaattacgaactcaattagaaatcacaatcctatctgtggaatgtgctgtcactgttcaattagcaaaagtttccttggtgattcttcagtaatgatgtagggtatcaatgatacagaacagaaggcatataaagtcatgcacttatgtaacttgatgaatgatctgaagataattgactagagatttgatgnnctacagcagagaagcaaatcacgngcgct

SEQ ID NO: 3662 - DNA, 1722 bp, Oryza sativa
  unsure (1)..(1722): unsure at all n locations
attttcatatggtggagggcaccctgagttacagactnagttgaacaatgtgcctccattagccattgttactgaaattggagaatggttggagatttccaaatttgccttgtgcaccgatgaaccattcactgagccgagtatgtgcaagacaagacacggctagataagtcaaatagaagaaattgcttttacacaagcaactcttaccttcactttgggagacatgaatatcgtagtactgccactatcaaccagtgcagtagcaaggagagagccaattttaacttgcaaggtgaaggtagttataccagcatttagaccattcaaagcatgcagcgacacttcaggagaaggttgaggttcagtaggactgtcaggagtagtgtaaataacatcacctgaatattcaactggtaggtcatcctcctccatggtaaccaagtaaagttgttagtttactttacacactcttccatgaccagggacccacggctcctggcatttgaagcatttgccccctcctctggtttggacaacaggaagagatttgcgtctgtttgcattggttccttcttgacaggttgcataggggaatccttaagagccactttagggtaagaatgagcagtgccagctggctgtatagaagagaaggtggggctgtcataattgtgagcatgttcataagcttgcatcttcaaagacttgagaggtcttttgatatgatccttcagtcctaagatgaagtattccaagaagtattcttcattgagatggggtttattgtgtttgacaagaggcataatttcttcaaacttgtcaatgtaattgtctactgagccatactgacttaactgcaaaccgctggcacaacatggtgcaaaattcaggccaagaaagagtatcggtaggaatatcataacttgagatccactgatctgcttgggcaatgatgtacactttagccaaaggcacttcatcttcttcaggggtacgggccaaagaaaagtattggttgcccttccagatccaagactcagggtgatccccatcaaaccccggaaaatccacatgcttatgattacgattaaaaggggtcaccatattgaggtctttttctgtaactgtgatcaacagaatcataacgagtctcctcctgtctgtgccagaatggtggtccacgatcaagaggtcggtggaaatcaaagaagggtgggggtgaaggtggtgaacttggttgataaccccaagaggattgatagggagggtagaaatatggtggtaaggtagggttttgtccattggtcatcaattggccagttatatactgtgaaggtggaggtggaggtataggtggtgttccaaagtaaactgaagtgttccactccagatttgggtaggtattctgagtacatacatgaattgtggggggtggtggtgattgagttggaatggttttgtgagcgtgtatggcatatgtttctcccatttcaaaattaggcatcgggcagggatctcctatgaaatcaaaagctgaagaatttgggggagtcatagctttacattgtgctcttcttgtgntgngtncttgcggaagagaatgcaaatcaaaaccccatgggggggggggnngggagagcaaacctacatataacnttacatgagacacttaantactaaaaaaacgaaaattaaacatagaatatgagaacagtacag

SEQ ID NO: 3663 - DNA, 759 bp, Oryza sativa
  unsure (1)..(759): unsure at all n locations
gctgatgctgcccgcacgcagnagttcatcattggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatataaaagttgacaatgaaggtttcaccactgtcaacttggctaacaacgcgttcacggcttaaaccgctcgttttcgccaaacacgttggtaaacggttctaaatgcttcacccaggtaccatagaagttctcgttgttctgtaagccaatagaactatcgttggtctgtccactctcttagcctagttttatatcatcctgtctctccctctgttacgctacgcgatattcttctcttctacaccccg

SEQ ID NO: 3664 - DNA, 1183 bp, Oryza sativa
  unsure (1)..(1183): unsure at all n locations
natagacggcatagcacagctgcccgggtccgatctcgttggtaaggcggaggccgcgatctccccagccttgtcttgcaccaggcgctctaggtcggcaagagtgctctgagccgcggtaagctggctcaccaactctgcgtcaccaggctgcccacccgccaccaggtccttctcctgggcctccagctcaaaagcccttgccgccatcgccgcgcactcggcacgagcactctccagatgccgagcctcgcgcccggcaacggcctcctcgcgtttcgcgagttgctcgcccagccggcgcaaggccacctcacggcggttcacctcggcttcgcgctcggcacgcctcttcccggagccgtagctcctccgcgcgacgggcctccgaagctttcgcggcgagggtggtccggtcacgctcggctgtggcctcctcacgaaggccaagggaggcctccgtctccgccgccgttctctcgtgggcggccaaggtggactcccgctgatctagcaggcacgctcgctcctccagcgcctgagcccgcctctctagctcatgggctcgctgtgcctgttcctggctgcgctcgtcctgctcgcgctggctccggtcaaggacctcaattcaccgacgaatcgtggcctcaaactcctgcgcggagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnggtnatgnggtnggtgcagtagnagnagaactcattngacagggggggggggagggaaataagggatagaaaantaataaaaaagataaaagggggaaaagatagagtaagtgtacggtattataaatatataaaaaagcatgatgaagaaa

SEQ ID NO: 3665 - DNA, 1709 bp, Oryza sativa
  unsure (1)..(1709): unsure at all n locations
gtattactcctcttttattnactaccatatcncaatantacngcatttcttctacataatacaactttttataccggtctttttctatttttaaaatatactattcttttcccnccttcccccccccccccctgtttagttaatgcactactgcaanacnccancaccannagcacanaannaagggagnannaannaanggnnacaaaccaaaaanaaaanncaannaannnnnaaaagaaccnnnngncnaaaaaggcncggcgggaaaggnancgnnnagcagnncagaaaacatacttataaaagaaaatgaaatttggagggagagacatccatcaaaaaaattttaagaaaaataatatgagtatgttagggattgaacacaagaacacggagttaaaaccacacatactctttgccactgaactatcaaatataactcataaaatatatattcatgaaaaaaaataagaaagtagccaaattgagaagctgtttcaaactcaaccttaacaaacatcacattccatgacttgcatgcgctcccatgtgtttggtgggaaggtcatctatactattacttttgacataaaatttcttcgtattccgattgaatttgaccaagattttgaaaaagatctctctctctctctcttctttgtaggacttttggtctcactagaggccgggcagaccaaattcaaaggtcacctataggaaaaaaaaagcaaagtgatttttgttataaaaaaactcataagcgtttttcacacggcatgattgggtgtgtggatctgtggagattctggctgggagctagggggcctacatgtgcctttggacgcaaggacgggatcgacaccgtgaataattgccatcgcatgcaatgcaaatcgtacgaatatttggatcgattgatcgatgggattctctcttctcgatctcttctccattggattctttgctgcccctgtactaaactctccccatctctctctttttcgtaccatatgatatcgatcaccgcatgcatctggaggaaagcagcatccagctttgatccaagcatatatgcatccccccttggcatgaatgagaccactgtagagaatccatatcctaattaatgtaattatgggggttgcaatggattccaaacaatataattatatacatttctgaacttggaatggaagttaattaattttgtagataattttggaatggaagttcctatggaaattgtagataatttgtaataaaatattgatccgcaaataataatgttggaagtcatatacttccccatgcacaaatataaacatttttagcgtttaaaatttatccgcaaatataggcatttttggagtggtacttttccaatcgaaccatgcactactatcatgattccctacatttatgttatattgttgcatttttgggtgtgatctttttcgaactagtaatgaacttatatataggagcatcagagtaattttacctcaaccttaacaaaagttgctacatgcatttaaatgaaccatgaaaaggtggaaattgaaatttgttgtttaccttcaaattaaggttaggtgctatacctttggtttggcaagggtggacggtttggaccatgaattcttccacttcggaattcatgggtttgatgnnctnctgcagagnggcgatcaatgcatcaaggcgcc

SEQ ID NO: 3666 - DNA, 9384 bp, Oryza sativa
  unsure (1)..(9384): unsure at all n locations
gtgggaatggctacattggacacacttcataaattttccccctgggaaaaaattagaggaggaagagaagagattcctcttgaatgtgtgtgtggaaaagaaaagagggaagggaatctcgcaccgcacgctgcgtttgtcggtctctccctggcagcgggtgctgacgtggcaggctgtcagtggcacaggttggcatcgaatcgccgcgtagtggggcccaccactctggcacacagagagagagagtggaatgtgtacacgtcagcatctgggaaaattgcactgaaatttcctgaaaggtgaatggtgaggttgtctggttctctgactctgatgctgtatgcagtgacctttacaaactggatgaatgaattttttttaactgaaattcgagtgaaaaattgttaggaattcctccatgtttgattcccagccggtgctctgtttcaaaaacctactgtattcaattctgtggactgataaaaggagagaaattcattctgatcttggtgctatctgaagcctagacattgaatattttttaactgaaacttgactgaaatcctagcatcagcctatgaactcttccctgtgtttctgccactaacatggacagacttattatgaacagaaaattttcatccgatcttctagactaacctaaaaagttattatcacataaaatcaaccgtgacgacgaggacataagagaaaagaaaaaaaaagaggaggagaaattcttttcttttctgatatggtgactttatttgcaatcttgttcgtgtggttgcagaaaaatattctgctgatggtggcgcacacagttcagcaatggaaatggcccatatatatacacacacacatgactttattcgtcttctttttttatcatcgttcgtagtatgagtatatttctttcctcctttccatggatctcgactttatgtgcactgttttctcttgtatgctatctgctggctttttcaggatcagagaattcagaatgcccctctcctcaagttctctcctggtggacaggctgactttgcagttggaccacagataagttggttctttgcagttgttgtacctgaattatggagaagaatctcttgccttacctaacaacataaacacattctggattgtgtttgaatcctctcttcttcattgaacgactacatcgtttttcgtaagcacgctttccaaaccaccggagtaaatgttatgtttcattgaaaaacttgttatatagaaatttattctgaaaataatataaatctaaatttggagtttatcataattaatagtcctactcaattaatcacgagctaatggttcttctcgttttgctcccacattactcgttttgctcaggagtaaataagttgtattccacacatagaccccttagtagaataataaatccctccaaacatcataagaatttcatgtattagcccacataaatccattatggataaaaataaattaatagtttaattttttttttcatgaattgagtaaaaccaaaagagtcaaagaaagaaaaatgttttgcgtgccatggaaaagatcggctgttctgcctaaatgaacacaagagtactaatacagaagccctttttctgaagaatatgatacgcttagctcgctgaaaaactctgctcacaaatgaaatgaactatcgattctctcaatctctctgtggagcaaaagattaattagctgtttgttgcgaactgcaatttgtgtctcgtggaaggaagaatctctgcaagttttctcgttctgctgatctgctttgagaggaaaatgacaggagcaggaggatgcatcgatcagcaaaaatatggatggagatgatatccgatctgggtgagaatgagatactgagatctccattggatagcactaagtgctgcaccatccatccttagacccgaattcaaattcggtttaccaatattcatgatataaaatcaccccttattttgttcactagaaagaaaactagtcaaatttataatctttcaatttaagcatagtcgagcaggtaatcacccgctatgaataacgacgaatcaatgaattttgtataacctatagctatatgtactagtattatgaaattgagaaattaaaaaaaacacagcacaaccgtagacgtttataatatgcacactcatacctataaacacacgcgcacacacatgtcacctaccatgaaaataattttagagcagaaccttttatatttttgctctgaatggtctaaaagaccatgatgaaaaaagaaaattgacagaatatctcaataagttttaaaatttaaaatttatctatgacttataagcgaacaatcaaacgagggtgagagaacaaagggtttgttcacttctttaccattatcaatcattccaaaatttagtaataccaaaatagccttatcaatagttgataattaactttctattcaaaaaacttttctcagtatttggtaatgcatcaaactaaacactactcacctcaattttaccctaccgaaacttgataatgccaaaatcgagtattactaagtgtttttttttcacaaaatgaacaagcccaaaattccaagtggtacggggccatcactggtccattgttcaactacatgggcccgaaagaaaggggctcaaaagcacactgatccagtacaaatgatgggcttttggcccattagtacaaaacctgttaaaatatctgggcttctcaaataggcccataatatgctcatcccaaattgggcttaaaatctacagtcaccagcccaattaaagagcagcggcagacgatgatgatatgactgaaataccctcaccgtccttgtggccgcgtagccgccaatccgatcgcagccgtccaaggaaatatcaacaaccctataaaaaaagtcaacccatgtacaccgtccgatctccatccgactgctccagacgcgcgagggcacgatggtaattaaccaccccttggcgcttttcggccccaccgcgagatatttccggccgctttttccccgccttcctccgtcatccccacccgccaccgacctgtgagccccaccatcagtcgggcccacctgtcagccacccacccgaggatgcgggtagaataagcatccgtcccagcatcccgggatgttttttctcacctgaacgtcgacgagcaatcacaatgacatgtgggcccggtgtcatgcgggacccacgtgtaagtgatagagtgggtaggtagttgggtgggtttaggattcgtatgtggataacgtcctttgcttcgtcttcccccactttcccgcggcaataagaaaaagcgcgggagcaaaaggagaaaaaaaaacaacagcgagaaaaaaaaaatcaagaacacgagcaagcgagaggggaagagagagagagagagagagagagagagagagagatcacgagatcggaggaggaggaggaggaagaagaggggaggaggtggcgtgttgagtcggatcgaggtttgcgtttgtgttcgtttggtcgccggcggaagcgatggagagggcggcggcggggccgctggggatggagatgccgataatgcacgacggtgacaggtacgagctggtgaaggagatcgggtcggggaacttcggcgtcgcccgcctcatgcgcaaccgcgcctccggcgacctcgtcgccgtcaagtacatcgaccgcggcgagaaggttctctttccttcctctcttttctttgctgcgagcttagcttagcaaaattgagaagaaaaaaaagggtaaaatcaaagctggtttgatcgaccgtggaattcgactgcagattgacgagaacgtgcagagggagatcatcaaccacaggtcgctgcgccaccccaacatcatccgattcaaggaggtgaccatgacacgattctcctcttcctcctctcttctttggagatcatgctgattgctgatgctgaatgatgtaaaaggacacctttgtttgttccttcttgtttcgtttgcaattccgactctgacgaatcttttcaggttattctgacgccgacgcatctcgcgatcgtcatggagtacgcctccggcggcgagctcttcgagcgcatctgcagcgccggccgcttcagcgaggacgaggtcgatatcactgtcctgatacactatgatcatgtctatttctttcaccaataattgtgtagtatctgtattgtactgttgtattggctaactctgaacttttggtgtactttcaggctcgtttcttcttccagcagctgatatctggagttagctactgccattccatggtacagtatcattttgatttcaaagttaccgtgtgattttcgcttgtctataactataagcggtttgctgcattgagctgaagcgattttgttaatgtgtttttgcattgttcagcaagtatgccatcgtgacttaaagctggagaacactctgctagatggaagtactgctcctcgcttgaagatatgtgactttggttactcgaaggtactaatgtttttctatttatttttgctatgcttttagttgggattactttgatcatttggcaatactatgtgatactgatttgatgatctgaaggtagatagtatccacaagacatttagggtgcacaatgtggcttaaattactttctgtagtagtgaaaagaagagagaactttcgctagatttttctcgatgtgattgctgcctggataatattgtactgttgctttctgattttgcagtcatcggttcttcattcacaaccaaaatcaacagttggaactccagcttatattgctccagaagttttgctcaagaaagaatacgatggaaaggtattatctatcccctttgtgctttaaaagttgccatcctgcatgcaaagatacactgataccagcagctgcccaacttctatgccttttgctcgacaatagaagctgccattgtgttgtaaaggtgttgatccatgtttcaatggcatgggtagtgtatggtcttgtgaagtaacccttttaatgcattagttagctcaatccctaataatttgtctttggatggagattgccgatgtttggtcatgcggtgtgacgctctacgtgatgttggttggcgcataccctttcgaggatcctgaagatcccaagaacttcagaaagacaattcaggtatccttgccaaccattcagctttgcagcaccacaatttacagttataatcagccagctaaatagtaatgcctaaatactttttttagataaataatgtctaaatactgatctcaatttgcagaaaatattgggtgttcagtactcaattccagactatgtccacatatctccggagtgccgcgatctcattacgaggatttttgttggcaacccagctagtgtgagtaccaattctattcctgccacacaatcttcaattattcagctctgatgtgagacaacatatgcaatcatttgctcttgcagaggatcaccatgcctgagataaagaaccacccatggttcatgaagaacatcccggctgacctcatggatgatggcatggttagcaatcagtacgaggagcctgaccagccgatgcagaatatgaacgagatcatgcagatactggcagaagcaacaattccagcagcaggcaccagtggaatcaaccagttcttgactgacagccttgacctcgacgacgacatggaggatatggactcggaccttgaccttgacattgagagcagcggagagatcgtatatgccatgtaatcatctcaacatttgcaatgaaactgcactgaaaatcagcttgtttcagagcaggtagagctccagaagagatctgtgttcaggctactaggaagcaggctctgctgcctattagttcttgagtctgaatttctgatgaaccatactgcagctaagttgcagcagattgtgtagtatgtaattatgtatgttgtgccaaaaatttagcaccggatgatatcatgcaagactgtctcttgggaacactaagaaataaaaagcattgtatggaacctagttctgtattgtattaaacaaagagacagaagagatgtattggttaatgtatttgctatgtgtatgtaaatatgctttgtgccaagaaaaaaaatctctattaattcatggttctattttctcagcaagctttggctgctgctggagagtcagttgcatgaacactgaacatgtcaaaattgcagagtggattgttcctccatcctgtattagacagggaaaaatatacacatcatctgtacaaaggtgagcttggagccaaaagcatccaggaacatcagtctacaagccagtccaggttataacactcttctgctacctgaacccggaggtctgggatgacctgctcagcttccctccacagcaacgccgtctcctcgtcgcacacgacgtgcccgagggacttgagcgatgaggacgacctcgggaggctcctcagtcgcgagcattctcgcatgtcgatcttctccaggcttgtcaggtgaccgagctcctcagggaggtccgtcaggttgacacactgcgaaatgtcgaggtatttcagcctcttcaggctgcataccgaaggcgggagccgccacagagccgggcaggcgtatacccttaggatgctcaggcaatgcagcttgcccagctcatatggaagctctgtgaggtcatggcagtttgagatggagatgctctccagggaactgatttcacatatgctagatggtagctccttcaggtctatgcagtggtcaatggtgaggttggataggcgcgggaatgtcatcgagagatccacctttgatcctctcagactgttggtcagctcacagaggacaagggatatcttgcgcaggttcttcagtgggattgtggtttttggtagcggtggaagtgtgatcttctcaagccaaaggctcctcaggtcactgagcgtggtgaaggcggataggttatcaagggttgcactgatggtgccatagttgatcagcaccagggctttcaagttctgcatggttgcaatgaatggtgggagatagtatacacttgacgcgaagttgaggataagcacttcggccttggggaagctcatctggaaccagtcagattctttcatctcacctgaagattgaaaccaattggtcagattattttgtccgaaggggaaacacaaataattgcaagtaacactaccatagaactttaaataagggaaatatttcacaagatcaggtaatactaataacaaatggaactttatgtattaccttgaaggattaagcatcagttaaacaaattagatggtatttttttttctcatagcaagaaaaaaaaagatgaaagtgtagttaatagccaatgaatcacctgtatgaatggaaactatctgagcttcgaacggagtgtccttattcctctgccaatccttcggtagtgattcttctcttcttggcatcaccagccgtctccggttgttcagagcatcacgaccactcatgtgaagcgctagatccctcaatacatcatgttgtgtaaccgagaagtcatggtagctgctgtacaaatcgccggctttgttcctgcatagagtaaccaaatgtcaaatccgtccttttgtcgcatccaaattattaaaggctttgaaaggaaatacagggcaagctgtacatactgtgcatcattaactagggtgagaagattcttgtttgatagctcaaccaagatggcgaaggcatccggctcatcaagatcatgaatctccatccatatattgatcaacacatccagtgggatcttcttatcctccggaaagcaacccagatcaaggaaacattctctaaccttccctgacaagcactcgatgcttgcggccatcctctccaggagtttggtctcatgagagtcagatatagtctctcctcgcgacaaccggttcttcgcactcaaccatatcttaggaggctgatcccgcaacgacgcaccgataaccttcagtgctagaggaagtcctctgcactctgcagcaacctgccgaaccagtttcttgtcagcggtccgaggaacggactcctgatcaaaggcagcacgacagaagacagaaagagccgcctcctcatcgagcaactccatttcgtaagtccgggtgaccaacgaggggaacttgaaccttgatactacaagtgtcttgcacccagggaacttgaagatgagctcctctagctgtgagagagaccagacatcatcaaggataacaagaacaggtcctttgtcccttggccccaacttgagttgccattctgggatctggttgtacgcaccgagcacaaggtttccactgatctgctcccatagcttcatcttgatagtgtccagatttgcggactgcgagatcgtctcaaagaagactctatcgctgaagtagcctacagaaacaagaacgaaatatgttagcaccatgaaaaacaataaagcatgcaaacctttccagagaaaccagcaaaggatcaaatacaactgtcttttgtgaacagatcttgatggcaaacaattaacgcaaaatccaaggggttgctcagatcaattaggaaaaaggcgaataaattcgaagaaagttctaatgttatgttgattaaaattggcaccatgaacacaagttgctacgttgagccgaatgagttcaccaacatactaattataactccctttgcacttacagatgatcataccggggtttgtattaaaccatgccaatgaacactaggcaaatctcataatttcaatctgaatctaagcaagaacataccatgccatgatttcaaggcaaaaggccatgaacagaaaacgagttactactcaatttggaccaaaaataatttttcacagcatctccaaaaaagttaggccgtgtggcgtaattgtgtgctccaccagcaatctaatcccattaggatcgtacacatcacacttaagcttggtcaaagcgccaattttgaccaagcaggtagcagtagtgaagaacaagacggaagcatcaacctcaactttacctaattgcgcacaaaaagcacacaataattttgcaggttttacaccctaagccgccacaataattgaaggaaaaagatgtgaaacccttctcttttcctttttttcacacgaggaatcgaatcgaatcgaataatttttgcaaaaaacacgcaaaatttgatgatgatttgttggttacctcggattttgtgatccttgaaagattccatggcgagcgtggtcttgccgctgccgnccatgtccgcagattcc

SEQ ID NO: 3667 - DNA, 2108 bp, Oryza sativa
  unsure (1)..(2108): unsure at all n locations
ccacgttcaggcgcagccgctccgccgtcgactggcagaagaacgtccccctcaccgccggcagcagctctttcaccgcttcccccgccagctcctcgaacagcctctccatgcctccacttcttcaaaatcaatccaacacaattctttccctgcctcttcttcttcttggatcttgggatgatgaaatcaattgcaatcgaacagaattctttctattctctgcctcgtcttcttggatcttggatgatgaaatcaattgcaattgaacagaattcttcctcttctttgcctgtctcgtcttcttgaatcttggatgatgagatcaactgaatctctttgaaattgtttgtatccctctccctcgtgttcttgggggtggcttggctcagccgggtaagtggtgggtggtggccatcgccatggaattgaggaggaggagttggagaagagtggaaaagaagaataaatataggaggagatgagagagggttggaggggtcaaccgccgcggctacgggtcactgacactgccagttaccgtgtggggcccactgctcagtcagtctaccactagtattagtacactgcacattgaattactactactgtattagtgggacaaacactgttcaaggtttaagtagaggagctgatagctgacctaaagactatgatctgagagcatctttgatcttggctttgagtcaaggagcaaagcaatgggtgttaggggtattagcagtatgcattagaatggttcaacatgtaacttatgggcatggtgatgatgattttgatagattatgcatatagagaaaaaaatatcagttcataacgatgaactaaatattataaaaagcgaacaaataccttttaaaaaacgtattttaaaagtgcggcccaaataatccataccaactctattaatctcttagaacacgccattacagtttaatagctctaccaaacgacatatttacaaatgaaaaataattcgtgaataaaacttttacatacgtgttcttaacaatcaaaaaacaaaggctgaaaaataaactacaatgaaaaaaaacctcaaaatcaactctaaatttaagattgaaaattcaaattttggctaataaatataagcataagcaaaaagatgaagccctaaatctatttatgcataacgtataacagggcatcagtatgtatttgttagcgattagcgaagtcatttattcaccattggcatgtgaggtttcgctcagggtgatgctaggaggataaccggaagagtatcttgcacccaacaattgaaggtggacaaatggtattctaaaaaaaatggtattcttttctccgagggaacaggaatagagctcttgcaatgcactataaaataaaagaattgattcagtttataaaggaaaccggacccaaaaaccttacaacgacacggttaattttagataggagttggattccttctagagaatttgtagtaggtcagatgaatgcagacttataggttagcacgggtgcagtggtggaagtagtacgtgagtactagatatatatgcttagggtgaaggaggagatgcgtcaaaggcaccacaatggtggagaaaaaaatggattcccaataataatacaaggaacctagctaggcaatgaggacgtcgccttcgatggcattccaccacacatcgcttgcagaatttcacgtacgagcatgttaacataactaagtgttgaattggtggtgccgttacggtgactttgtctatggtggtattttatgtgtgtgtggttgggtggggtaatgatgatcatgattggcactatagtctactcccttcgtctcaaaataaaccaatctcgtatatgatgtaacacattctagtatgatgaatccggatatctttgtgttgtatccagattcatcgtactagtatgtgccacatcccgtatgaggttgatttattttgggacggagaaagtacatcctagaaggggagccgaaaccacatccgttgagttgaaattaagatgcatgttactgaagatagtttgtcnctgatnnngtnntggccatctcgataatcgatnntcaatcccag

SEQ ID NO: 3668 - DNA, 2103 bp, Oryza sativa
  unsure (1)..(2103): unsure at all n locations
cgtgctggcctttgattgcatgagcaacgcactcccatagggcgaattcgagctcggtacccatcaggaggtctttttcttttcttgcttcctttcggcaatgaggacacaacattaacattcttagcaaaagataacaaataagggttattttgcaacacagtatgaccaatacatgcattattataccatagtttacatttgccatttgcaaaatggcaataatatccatcaaaatcctatttttatacacttattaaattacataaaaaacatcttgaatgtaaagggtgaagccaatcggtagctctaggcaaagacttcaacagcttctacttttgctttaacttcattggcaactctaatggatcctttgtttctttgcgtagttcctgccgaacggaatccctttaaacaattacacgcctgaatagttactccagaaataatccaccatgtggatctaaaataacccacataatgagatttatttacaaatgtaataatggtctcacctttctttgccatgatcatttttaggaagtcaggacaatctttcttgtaatgtcatgtcttcttgcaatggaaacactgatggcttttcaacagtgaaatgttgatgctgtggcagatgctgaggctatttcccttttgaggggatggtttgtggctctttttcttgttatctttaacatagttaatagagccaccattggactctttgattctttcctcctcttgcacacaattagcgatgagcttttcaaaattccatttctctagacttatgttgaagttgacaataaagttgtcaaaatgctttggcaatgaggccataaccagatggaccagaaagtcatctgtgatacccaaatccattggcttcaacttggaagccatgttgctcatcctaagaatgtggtctcttacaccacccccatggtacctctctgtcacaagctgctttatcagctgtgtcgcataagtctttgaagaaccagtaaactggctctttattctttcgaggtactcagagacggtgtcacactctgggattgagcccaattctttgttgtgttgcaagatgagctttatttgttatctctttctgagaatgtgaatgttgtgtcctcgttgacaaaagaaaacaagaaaagaaagagaactcctgatgtctcatcgaaattatggcactatcgtttaggccatatttcgagggggagaattgagagactagttaagagtgatattcttcctccattggagttctcagatttagaacaatgcatagaatgcattaaaggaaaatttgttaagagcatcaaaaagggtgcaaaacgaagcgcgggaattttggagatcattcatacagatatttgtggtccatttcctgtgaaaagtgtggatggctatgactcgttcataacattcacagacgattactcccattatggttatatttatccaattaaagaaagatcagaagcattggataaatttaagatattcaaagctgaagttgaaaatcagcatgatatagagtttaaaatagtaagatctacccatggggggagtactatggtcggcatacgccttatgggcaagtccctggaccttttgcaaggttcttgctagagaatggaatagtagcccactattcaacaccgggcgaacctaaccagaatggggtagctgaaaggcgtanccgtacccttatggatatggtgcgcagcatgataagctactccgccctaccattgggtttatggatggaggcgttaaaaaccgccattcatatcctcaacagagtttcaagcaaatcggtgcccataacaccgtatgagctatgtacaggaagagtcctaaagttataccgcgataacaaacctacagtaatgtacgctcgcatcaatcagtcaagtggtgctgccaaacacattgacataaagtactatgttgtgaacaacacagtccgggatcaaacaatcagtctcgagcacattagaacagaaannnnnnnnnnnnnnnnnnnnnnnnnnnnnnnnnnnnnnnnnnnnnnnnnnnnnnnnnnnnnnnnnnngntcgcattgcaatcatngccac

SEQ ID NO: 3669 - DNA, 1916 bp, Oryza sativa
  unsure (1)..(1916): unsure at all n locations
gtgtcccgttgagtaattgatactctagtcgaanncgagctcggtaccctctcctcctcctccttcagagcagccatatcactttgattggcatcatccttagcacacggttcatcagaatcatccccattcttgtcaatgccaaatatactagcgtgttctccggcctggcagccagccatagctgcaaaacaagcaaagttttggttttgatgtttcccatccaacaaacaaaaaaaaaatactgcctccgtctcatattataagactttctagcattacccatattcatatagatattaatgaatctaaacacatacatatatttagattcattaacatatatatgaatgaatgaatacaatgctagaaagtcttataatataaaacggaggaagtaccaattaagagggatatactgactgatgcaaacgagtgaacaaagcagaacagatgtacatgaatgatgaatgatcgatcgattagttgtggattatatatacactcacatgagtaatctttctccgagtctatgaggctgcaatcacgctcggcaggaatatcaagaactgtcaacgccgccttctcttcccatgtgatctcccgcttacgcttgcctgcaacaattgcaagattcagtccgccgccgccgacgtcgtcgattaccataccgcccctctcgctttcgtccgccatcttgacgctcatgcagaagaagaacacggaaagaaagggacacaggtgagattaggtgcccatacaatgcgatttcgtcgaatcggaagagagaatcgaggcgatcgaggagtgtaccgtagacgtgttcgctggcagccctgatcgccccgtcgccgccggaggggagagagccttagggttttctctttctgtttccccgattatgaagaggctagggtttgtttggtgaggacgaacggcttgtttggcaacttgagggaagggaattgggagtttacaccaaggaattaatggtgagattaagatgggaatttgatttttcatcccagtctcttgtttggtagaggtggtggaaattgatagggagtttagttggtgattagatcattaatgaaaatggatggctgagatttgtttagacgaagtaaaggaggaattccctcctaattacctgcccctacccaggtattgaaaaggagggaattcattcctcaattccccatccccatccccatcccaccaaaattcccatgtcccccaaccaaacaaaacagttaatagactcatccctctaaactcctaatccctcctaaaaactctctccaaccaaacagaccggaagagtaggttacctgatgggcctttttctttggaaaagacttaacctgatgggcctatataaagaaaacccctttcaccgcagcggcggcgatcgatcgacttctcggttgcggcgtgctagggttcgaggagatcgcactcgcaccacgtacggtacgctcgcctcctcgatcgatcccctcttcctcttggtatgcgatgcataaaagaacaaatctaaatattgcaatttttgcttctcttctgaatttatagctgtggcgatgacagcattggcaagatgggtgaactaaccaagaaggtcaccatggagaagaaggaggagcatggaggtggtatggctgctgggaaggaggagaagcagcagccaactctgaaaaagcagcagcaggtgggaaaggtgaagaagaagttcctggattttgcacaggagttgacatgggaggagaaggtggtgagcgttcttgacatcgttcgccgctatcagttagctgaatacgaccccaagttaaaagaatttacccctacccgggtcannnnnnnnnnnnnnnnnnnnnnnnnnnnnnnnnnagattngcatcntcatcggcagcagg

SEQ ID NO: 3670 - DNA, 1027 bp, Oryza sativa
  unsure (1)..(1027): unsure at all n locations
cgtggcccatttgcattgatggnnnnnnnnnnnnnnnnnnnnnnnnnnnnnnnnnnnnnnnnnagaaaaaaaataaagatcatgaagctttttttaaaaaaattatcattctacctccttaatcttttcctttcccttgtccttcttcggtggaggcatttttgcgtaccagcaagtaggactgaaaacggggcgggtattttccgaccgcccgcccggccacattatttcgggtcaaattcgggtcgggaatttgggtacccggacccttacacggatacagggttcgaatacgggtaattttttgcggatatgagatcgggttcgggagagcggtatccgacggatacggattatccgggaaattatgcgggtattacccgataatctatccgtatattactcggatagatggacaacagcccaacaagcaagcgcccaacaggccaacacaacaggcaacagccagcccacatccaaaaggcccaccaaacaaagtgccaagcacaaaccctagccttcacttcacagttcagatcagtacagcattgagtctgaagctatcaagcaatgaatgtctacttttgctactactttggtacagttttgctgataggcattatgatgccataagcccctaatatattcataatagacatataggaaatggctgaatggctattgtctatgtggtatatttggttgttgctttgacttgatatttgaataaatattcgtaaccgatagagttcgtatccgtcttggtacgtattcgttccgtatttatgcccgatattatccgtgcttctattcgtatccgataatatcggtgcccgacccgattccgattataaaatgtgggttaggatatgggaaggatgagctccccccgaacccgacccgatttcacccctaccagcaagggatcgatcggaaggggtttgnnnnnnnnnnnnnnnnnnnnnnnnnnnnnnnnnnnnnnnnnnnnnnnnnnnnnnnnnnnnngcagcagtcgaaccttccaccg

SEQ ID NO: 3671 - DNA, 1268 bp, Oryza sativa
  unsure (1)..(1268): unsure at all n locations
agttggtatgggtgggtgttacccacnaaacgccctgatcccccatccatattccacgggcggcatcttttctccgactctcacctcccctcccctctcaatttaccatcctacccctctcccctctccccttcatttcatcactagtaaaataatactactattcatgctatgtactattattttttttttctaaacaagctataatttttttaaaaacaggctattcatgctataatggggttgttcggttgagctagctatgctgtggtagccagcccaatacaactataccggttgtagtaaccaattgcagcagcagcgtgtgttcaaacttgcagtcgaatggctagggttgcgtagcatagtctagatcgctgcaacgacagagtatcgaacaaccctaatactactacttcgtaggatttttcattgttccaatctaaactgaattttcttgtgaagttctagcaaaattcttgtttggcatggctccacgtctggatcaactcttggaatctcgaaaaaaaagaacttatacattaaattaacatgcattaatcctcttattttaattttaaatatgaactaaatatttcgtattattgaaattaatcaaccatcacctacaactcatgaatttccggagctaaagatgtctcgttatcaaatattccatccgtcttttttgatattttaattttgaaccaaccaacatcaaatattaaaggatggtggcagtaaaaaaaaaacttggagatttttacgtctagaaaccatcgttacacataaatttaggcaggaaagttttttttcccaactcagagcattttagttgcaaaaggtttatgcaaaataaagcagaaaaaaaactactaccagtatcttttacatgcacagatcagaaggacccagtggttgtacagataatagcagaagctagtggtatcttccacggcccgattctatactgttccacgtcaaattaccattctaccctccattctgcctgaaccggaacccccaaccttcctccggtataaacgcggcgagagcgcgacgccgcaaaccatttccaccgccaccgtctcctcccgaattccggcaaggtgttgtggacgatggggtcgtcgtcggcgtcggcggcgcagcacgaggaggcgccgacggcggcggccttcgtcctcggcggcgtcgacatgcggatgcttgcggcgaggaccgccacngncgctcttgccagggccggcgccgcaaggccggcgcct

SEQ ID NO: 3672 - DNA, 2909 bp, Oryza sativa
  unsure (1)..(2909): unsure at all n locations
ttaaacaaagtttaattttgccgtgtaataattcaatccccaaaaaaaaaaataggaatctttacaattcaggtgttcaatgaaaaattctctctctttttttggtttctactagaaagaggagaaactttttccccatatcaccatgtagaatagaaatggaaaaatacagaataaaacaaaaaaaaaacaaagattcattttgttcgatttcttgtaatttgtcaattttttctatgttattccaccaagaaaatattaacacatgttgagcatgcatagctttgttgtcaatctcatgcatatttgtctgtattttcgctaacttttttctcaaaagagtatattttttcctaactagttctgtcaatttcaaatcatgatcaggtgtccaatgcgttcatgccactggccaccttgccggcgtttgcaaaatcactggagaaagccgacgccgccgtgccagacctgtccctctcctcccgggtggcgatggccgacgccccggcatgtccggcggcgccgagcgccaccagcagcgccgtcacggatgtcgctgtagcgcagcggcagcaggcggtgcaacggaaggccagacggtgctggtctccggagctccaccgccggttcgtcgccgcgctccagcgcctcggtggcccacaaggtgaggatcatctcattctcatcaacctaaattgtgcaaattgccacattttattttagattcgatttttttttccaatgataattttagatgattgtattttctttctgaactgtttagatgattgagtgataatttgtggtcacattgttgattgctcctagtaaaattgtttgattaattttttgattggtgcgctgaaacttgcttaatgtttttttattgttgatgcagctgcaactcccaagcagattagggagctgatgaaggttgatggcctcactaatgatgaagtcaaaagccacctgcaggtttgttcagtctcaactccttacttttacaacctaaaaaatattgccatatgtcggtggcaacaatttggtacgcctcttttataaaaagttcacgaacctcaaagcaaattgtgcagaagtaccggctgcacacgcggcgggcatccgacggcggtgatggtggcggtgaccatcagacggttggcggccgtctatggccgctgccaccggagcaatacaccacctcgcagcacagcacatcgcagtctggctcgccgcagggccccctccagctcaccgtgtcgtcgagccacgccgtgtcagtgaccgccggcgatagctgcgacggcggtgaggagaaagaggaggacgggaagtcggggagctatagctggaagatgcagaatggggcaagggcatcatcatcatcttgagcaccattaattaattgtctccaggtgctgcacagcagcagtgaccgaagaacttaggcctatttctgtacagtggttgagagctttttttgggctttttttttggaggatgagattaagtacgggagttacccatgtgagtaatttgagttgttgttgtaaagggtttgagaatatgagaggtgttaattacatcacattgtataatctttgggctaaattgtgatgtcgagattaattattcttatgtgaggagaatattgctagattattgtccacctttgatgcctcctgttgtgcaaatttatttatttttttgaatatgcaaggaacacatctttttattaaggggaataaagtttatttacaacgataattttatacattataagccataatggcttatcaaaaataaaaagtattttacgaagaaaacttttatatatgtgaacaaattatgggaaaacacgctaaaaactgtaaaatgattccaaaattgagttttaaaattcaaatttgactacaagttataagtgaaaggcatgttgatttgtttgtaaaatttcatcaggcacactactggctgtgataataaaaaaaatgtaactgaaaaattaacaactgaggtaaaaaaatgaaagtgagatcattcgattagttgcttgcatcttgcagtggatcttgattggagatgttctcttgtgccaatgaatctggatcaggatcaggatcatttaaccctttttttggtaagtgcattggtgagcatcaagagagtggttcactctaacctactcatattaatgcttaatcaatcaagtggttggtactgcgtgcaagatggtataattatgaacttcggatcttgacttttgccgtgcatttcgtactggtttcatcctttggcgggaattggtagaggaagctacctctagggttcattgttcatctcttcactgtacgaatttactagtttttttctttaaaaaaataaaaactgtacgagttgaatcaggaacagtttataaatttgtgtccggtttattgggtttgaattgaattgggctgaaaaaaatgcaggtccatttatttcctgggccgaaatgggccatcccttttctgattgagccgaataaattgggctaaaaaatccagcccaatccacagtggtagtgaggggaaaacctccacgatttttcgcgccgccgccgccggcgacgccgtttggctgagcacctcgccgccggcgctattccccaccggggaaacctcgccggcgtgtctgtggagatttctgctgcgagggaagcttcttcgtcgactccgccgggcggttgcggttcaagagctcgccgagcggcggcggcggtcatgagggaggcggtgacggtgcatgtttgggggtttttccaactaccctcggttcccaatttttgaaatttccagggggtgggcctttttttttttcttttttttttttctggagacaccccacctgttgtttcaccctgggcagan

SEQ ID NO: 3673 - DNA, 6126 bp, Oryza sativa
  unsure (1)..(6126): unsure at all n locations
catggcttttggtctaccgctggtacagtacttcatcaccccagcttgttgctccacctggtgcaagaacctgacgcttcttggggtcttcttcttcttcttcttcttcttcttcttcttcttcttctccaggatgagttgctcgggctcgccgacgaccccgacgccgatccggtcttcaagaacgccgcgctggacatggacgtcctctaccgctccggcgagacgcaccaggtaaagccgccgctcatcgctggcatgacaaaatgcgtcggttcttttctttctgtatttgtttctcttttttttttggcgttgttgttcatcttttactgactactagtatacactgcttgatttcactagggtgttgctacctactgccctcgtctggtgtctgttgattctcgaggtaatttgatgctgaatttggtccgaatattattgtagtgcgtaaaaccccatgtttagcattcaacttataagcataaacgaaaattttgaatcttagaacttaatttcagggttgattatggggttttttttttcatcatggtttattttccagcattttgttttaaatcagtaagaacacgtatttaaatttttttacccataaatgattttctaatcgctaccagtccatttcacttataataagtatataagcgaaacgatgaggaaataagaactaagaactgttattttgttattggtagtgtatatactgcatgttcacggtggtatcatttgcagggtctcttggctctttgagttcatccggtaatctcggtcagtctagtactgctgcagatcaactcaatgttgctacatggcaagtggcgctctaacttctttagaatatgttttcatgtttggttttgcttattgtgcccaccatgaataattgaccactgtgatttggcatgtacgacctgcgcagaaggcggctgttgtttcagtttagttttggattgcttgtgcgaatgggttacagatgtgctaggatcgtttaaataagcttgcatatctataactgggggtaattctgacaaatggtgaaatcatgtctgcatcgtcaaagcaagcagatagcaaatacagcagctttactatagcactgttatattgatacagttctaggaaatttctgcagcctgagcaaacaatgagctgttcttaggctgataataagagagtaataaactggtaataatgattcatatgctcatccagctgctgtggaagtgatgcattgcatctgcctattattctcgtagagttgcattcatcttttgccttactgttgcttgttttgcactggtatgtgcaaatcattcaatgtattagtaactatatatatatatgttgaataatgtgtcgggctcataggttaccatgatgaattttccttgtttatgtaggtctggaaatgtaacaagatcagtctcaaaacctcatgggcggaacttgtttctgcaaagcttagttgaagaagggcagaatccaagcactagcaatggtggcagcaactcccagaaaagtgttgaatataaggacctgattgaatgcctagagaatggcatcaacttttggacagattattcaaaagttcactatcatcctcagagtttgtatgagttatatggatcatggacagactttgacaagttcgataactatggcagcgcacaagaggttgtttcagactggtcgcaaatagaggaaatgaatgagaggctaaggttctttgttgaagaatgtgaccatattcaggtcctacccttttttccccagtaaattatcagcaaactctacttacagttttgcaacaagctaacgttcacttatgcaatcatttttgccatcatgcatattatttagaccattattttaagcttaattgattcataatttaccacagggcatccagtttattgtggatgattcaggaggtttttccagtgtagctgcacagtttttggagaacattgctgatgattacacaaatacacttgtattgctttactgtgtgagggatccaatgacccttggaccatccaggaggaatcaaagggagtccattatgagagctcttcatgatgctgtttcattttcaaaactttcgtccttttgcaacctgatggtacccataggaccgccttcattaagtagaagtatactatcctttgcctgaactccacatttttagtttatcttttgttattgttattctgtgattttataggacttctttctggttgcctagttttgcctttgattgcttcaagtatactgatattgtgccttaagatactgcacttgattgcgtttctattaaatatcaactccttttgttcaagctgtatattcacatttgatttccatacaatattactttcatgaattcccttaaaaaaatactttcatgaatatacagaaagcttattctgaatgagattttctcacaaatttcctttcactctgtttcatcaggttgcatgtcaccgtacctttatatacaagatgagaaaccattccatgctagtgctgtttgtgctgcagcaatacattcaatcactgttccatttagattgcaacgaacgggaccgagttcagacttagcacattcatctggtaatcttgacattggcgaacttgtgcacattttatctgatcaaggtcggcagaacatggttactgctctggatgtagcgatgcctgccccttctttgacaggtatacaacataacatatgccctactgttataccaacattggatggaaatttaatcttgcttgctaattgcacactttaatttgcagatagagatgctatggggaacatagagatgaagctgcactctttgacccctgaaatcagcgatgaggacgaagatccttattcagttgaatcgctagtggttcatggagctcttgatagaggtctgcacatcttatcttttgccttaggatctgattaactcctattatttgtcatgccaacagaacttatttttctattgttgttaatacttacaatattgaacatttaacaacattataggcatggtggctaaattttggttatacatgtagaagtacaaagaattaacaattgaaatttgtttgcacaggcgggcaaaggacttccatatcacaagtgaaggactcggtatgttcagtctacgaagccagagagacaaagccaaaattttcccatctctcagcatctctttgccccctccctgtcccccttccgttcccgtcaatcttcagaggcaacattggccggcacggggagatccttagtgaccatacagaagaatcccagccaaagggctcacttgacatcgaatcgataccaatggcggcacggttacgatcaagcagcgccgtcctgcctttcatagagaggcgatcggggagcctccagaagcacggtgtcgcgagaggcgccatcgggtctctggtcctccatgactggggcttcgggagggaggaggtggaggacatgggggagcacctagcgaagttgctccgcccgtttcaccctgaaatggatcttacttcggattccgactagatcatcttcgaaaaatcttacttcgagaatcaagcatgatccatctgttgcaatttatgtggattgtagtaatactaaatctttttttttcagagggttttcagatactgaaaattcatgctcatgtggctggctgttgtgagatcaagaatgagagatctgaatctatggccctgtttagatccggagggctattaaatagccctctggaatcttactatttaagagtattaaacgtagattactgacaaaacccattccataacccctaggttattttgcgagacgaatctaacgaggtatattaatccatgatttgctacagtgatgctacagtaatcagccgctaattatagattaatatacatcattaaattcgtctcgtaaaatagcctaggggttatggaatcggttttgtcgataatctacgtttaataatcttaaatagcaagattctgaagggctatttaatagaccagaggttctaaacaaggcgtatggcatggtagaccttttttgtgttctactcatgtgcatttgagcacgggtgtaggctgtgtatgccacatgctgctgccgtgacattctgcggtgtttcaggccatgtacagatcaaccgggccctggcttctgtcaagtcaagcagttccattttcgttgtgatgtgaggtcacactccgtcggtctgtgacagtttcacatgaaactggagtactcaatttctgttaaaaataactaaaattcccgcatttcaaatataaaagccgataggctgtatatatcgggttttagccacattaggaacatggaaaattttcgccattcctatggagttattctataaatttcagcctcttttggaatgttggatttttgaggaatttcgcataaattgagttgtttcctgtaaaaatcctacggagggtttttggaacaaaagaattttataggacttttgatcgattgtactcctaaggaaaatcctttaaaaaacaaagatgatttcgggaagattttcaacatgatatcgaatcttttggaaaaattgattaacgtctacctatcttttcttattcatgtatttttcttgctccattcaaacaatcatttctgtagtttttacatgtttttctatccataagatttgagtatcagtgtcttaaaatttctgccattttctaaacagtgacaaaaaggcctcctatcattttcctggaccgaaacatttctttcatctcttaacccaatacctttcatgcctctccatcaagcatctgtacaaatcttgttgactaaccaagtccattagcacggtcaccaagaacaacactaaaattaaactgtcattcaagtatacaatacggttaataaataattcagagctgtcaatcaacgaaagtttggcatttttcgcatcaatgattggtggcgagcatcacatggccggcccgaccggtcatgtgtccgaaaacgcgtgaacatgtttataatttaaaagtgtatttgtaaattgtaatcgcaaaaacaaagacacgatgattttttataattattagtaaaaaaaaaaggagagactgactgacacacacacgaccaaagacatggattgattgattttttttagtgcaaagcgatccggatcttgaggtgatgcgctctttcttaattgtcgttccatgcgtgttcaggctcccatattttttttaaaaaaagataataaaaataattcccaaagtttgatttttcggcgtgtttttttggatgtatgcattttcttttttgcgatgaagtttcctatccttttcctttgtgaaaaaagttatgtgttttttttccaaaaggaaaaggaatagaatctctaggttctttttgcctttttcataattggtggatggtatcaagggaaaaagtaaccttttttttatgtgcctgttctaacaggttttatttttgaaagcgactttgtgttgaccgatgaaaattagacacacaacaccaagatttttcttaaactttagccctcttaactataaaattcatgaccaggagtccaggaccacttgaccgctaactcttttttttggtgcaaatctgataacctgtcttagcttaatctagaccggtctcggaaatccaaatatgtctgttgatcgcttccatttttactcaaccagccgctgcccgttggtgtattacgatattctaaagagccgtaatatttttcacaaacgttgaatgttaaaaattcgaaaattatgtacatcctccgcttaaagatgactatgaatagttgaacccacagaaggaggaaagaaagaaaaatctcgagtttgtgaggaaaatgtccaggcagtacttatcaatgaagaaactaaaatctcgagtttcgtccttaacgacgtcgttgacttttcacataacattatactaaaagaacatataatttttttattataaattatcttatcaataaagaaactaacttatattttttaacagggatttgatgaactnctgtaccagtgtactacctgccgcac

SEQ ID NO: 3674 - DNA, 4494 bp, Oryza sativa
  unsure (1)..(4494): unsure at all n locations
gtcctccaattttaaaaccaccgcagcaagggttcaaaattcgagtgatttacataaaacagcggtgaaacccttcctaaaaaaaaattggagcgtgggctttttaaataagccatcctagtggggtgagaaacgaggcgtgtcttccaaagtggaaggcgccgcgcccaaaaacgcgtcccggcccaagaggaagagnaagggacancctgctactgcatcagtagtattgtaaaggatatgcatcatatatttatatatatatatacactaagctttaattaaaataaaataatcaaacgttacgtgaaaatttaacgatatcatggatgaggacagaatagtatttttcataataacacaagtggtctcaaagactggtgcagtagagagaagagaatagtgtggtcagtagagaggaggaaaagcctcttgtcgtctctttgacccaacgaccccgccattgctcacctccacctccacctcacctcctcctcctcctcatcccctcgccggagcggccacgccgccgggagggagggagctcgccgcagccgcagccgcagccgcaaccagccagctactgcgtgctgcaacctgggattttcttttttcttttttttcttgtggatttgatctgaagtggaggtgggaggaggaggatggagagctacctggaggagaatttcggcggggtgaaggcgaagaactcgtcggaggaggcgctccggcggtggcgcaagctctgcggcgtcgtcaagaaccccaagcgccgcttccgcttcaccgccaacctcgacaagcgcggcgaggcccaggccatcaagcacgccaaccacgtactccctcctccttctcctcctcctcctcttccactcccgctcgctcgctcgctctgggatctgggacctcgccgccgaggttgctagggtttttcttatccatcctgcagagcgatctggagttgggggcagttggtgtgtgtgtgtgtgtgtgtgatgtgatctcatctccaccaactactagtgtttgtagctgcacactgtgtgcgtaggaggaggatcttgagcttagcaagtagtagcaaattagtagcaattttgtggatatggatgcggctgttgcagcgagaaattgcggagtctgatagtgatggctgttgctgagctataggaggggatccttggtgcttcatcgctttcgacatgtattgcggtggtgttgattttagtatactcgctatggtttgggaattaggaaacccggttcgcaagatcggagcatctgcatgtaggcgcttttcttgtgaacattgtgtagcaagcccgtcgatcagagcctactatcctttccttaattgactccagagtgcagctatgtagtagcttcgcactcacgaatggattttcgagaagttatagttggaaggttttcggtgctcacgctgctgcattcctagagcgtgctaagcttatttttcgcacttaattctaagaggttactgaatttcgtactgtggatggttttaacaggagaaactgcgggttgcggtgctggtatcgaaagctgcactacagtttatacagggtaatcatgtaatgattggatgctgtttcataatgtagaacgtgccttgttttggtattttcttatatttctgaccatttttagtacctaataaacatgccatcaaaaatacaaatactcaggtctttcacttcgaagtgagtatgttgttcctgaagaagtcaaggctgcagggtttcagatttgcgctgatgaactgggctctattgttgagggtcatgatagtaaaaagttgatcacccacggtggagttactggaatagcagacaagcttgcgacatcaccagcggatgggttaagtacagctgaggaaagcattaagcgcaggcaagatgtatatggactaaacaaattcacagaaagcgaggtccggagtttttgggtgtttgtatgggaagcacttcaagatacaactcttataattcttgctgtctgtgcctttgtatcgttggttgttggcattgccatggaaggatggccaaaaggtgctcatgatggtctgggaattgttgcaagtatcctcttggtcgtgtttgttaccgcaacaagtgactatcggcaatccttacagttcaaggacttggacaaggagaaaaagaaaatacaagtgcaagtcacaaggaatggttttagacaaaggctatcaatatatgatcttcttcctggagatgttgtccatttagcaattggtgatcaggttcctgctgatgggctattcatttctgggttttctctactgattaatgagtccagtctcactggcgagagtgaacctgttgttgtaaatgaagataatccttttcttttgtcggggaccaaagttcaagatggttcctgcaagatgctgattacaacagttggcatgcgaacccaatggggaaaactaatggctactctcagtgaaggtggcgatgatgaaaccccactacaggtcaagcttaatggtgttgcaactattataggcaagattggtctatttttcgcagtcataactttcattgtcctttctcaagggttaatcagcaagaagtaccatgaggggctgcttttaagctggtcaggagacgatgcactggaaatgttagagcattttgctattgcagttaccattgttgttgttgctgttcctgaggggttacccttagcagttactttgagtctggcattcgcaatgaagaaaatgatgaatgacaaggcattggttcgtcacttagccgcatgtgaaacaatgggctcagctacgaccatctgcagtgacaagacaggaacactgacgaccaatcatatgactgttgtcaaggcctgcatttgtggaaacataaaggaagttaacaatcctaagaatgcatctgatttgtgttctgagcttccagaaactgttgtcaaaacccttctggagtctatttttaacaatactggtggtgaggttgtgattgaccaagatgggaaatatcagattctaggtaccccaacagagacagctttgttggaatttgcattgtcacttggtggaaattttaaggcaaagcgtgatgaaactaagattgtgaaaatggaaccctttaattcaacaaaaaagaggatgtgtgttgttcttaagcttcctggaggaggatgccgtgcacattgtaaaggtgcttcagaaatagtgttggctgcctgcgataagtttatggacgagacaggtgctgttgtcccccttgataaaacaactgctgacaagcttaatgggattattgaaagctttgctaatgaagctcttaggacattgtgccttggttatcgggaaatggaagaaggcttttctgttgaagaacaaataccactgcaagggtatacatgcattgggattgtaggtattaaagatcctgttcgcccaggcgtgagggagtctgttgcaacctgccgatctgctggaattatggtgagaatggtcactggtgacaacataaatacagcaaaagcgatcgctcgtgaatgtggcatacttactgaagatggcctggctattgagggaccggagttcagagagaaaagtcttgatgaactactcaagttgattccgaaaattcaggtttgctatgcatatattaccttattgacttaagtttttaccatctatatacaaacataattcttggtgattctgtgtattgaaggtaatggcccgatcatcaccacttgacaagcatacacttgtaaagcatttgcgcacaacattcaatgaagttgttgctgtaactggtgatggcacaaatgatgcgcctgcgcttcatgaagcagatattggacttgcaatgggcattgctgggactgaggttagattatttaaccatttgaagagatgaaaacttcgagttctattctctctggtcacaactgtgtgtcatttttggatgttgacatggcgtagcaaatgcaactttgaccactaatttccattgcgataatgataaaactcagtagaattaatattatgtaagcatttttttattcatattttttttgtaaatccaacataaacattcggagatgttagaaacatatggttagaaaacatcatttgtttttgactggatggactaaatggtattaatcaactagcagatatttcatgatttataattttttattcaagtcatgcatttagtcaatttatccagcaccatacacccatacaaaacctaaatattggtaatctgaaatatccttatttatgtcatccagtaactaatgcttgcttattcaggtggcgaaagagagtgccgatgtcataattctggacgacaacttctccacaattgttactgttgccaaatggggacgctctgtttacgtcaacattcaaaagtttgtgcagtttcagctgactgttaacgttgtggctttacttgtcaacttcttttn

SEQ ID NO: 3675 - DNA, 2032 bp, Oryza sativa
  unsure (1)..(2032): unsure at all n locations
cgtctcatctctttgnacacagaatnacgatgcacgcgngctcacatactctcttctactctgtattgtattctttncgatcttctactctttcattcctangataatnatatctcttncctnntccccccccccncccggtgtganttttagatcnctgctaaacacnacancatcatnnggccttgatggccctgatgctgaagttgtgctaaatacaattattttcaactcgtttgtcttttgtcaggtatgtgtaccataccaaatatgtttctttttttcttcggctaggagtacgggtgttgtcaaagttgccctatgcatgcagaggcctcatcactaattcaattagttcatagtccatcacctgcacacttaattaatcaacatttttttaaaagaagtgtcctgcttttctccagttagcatccacattgttttagatgccgatatgttagggccaatgcttataaaaagggcaattcactatgacggaattcagtcagtagattaacagatgtctagccagatgtgtggctaacaaattgatggccacaccttaggcagggtatggcaaaaaaacctagtcatgacatgtgggaccataagtgtggcaaacaaaataaacaataggctcataaagtgtgacaaagtttggcaaagtgaggtagtgaaccaaacacccctagtcccagaataacatcaatcctctcttctctgtactagcagttcaagatccatttctcttgcaatacatctgtcataatttgttgaaataaggagggtagtccaacagaagatgataattgtttcactgccaacctgataaactaacctggtatatgctatttcaggtgttcaatgagataagctccagggagatggagaagatcaacgtgctgaggggcatactgaagaactacgtcttcttgggtgttctcaccagcacggtagtcttccagttcatcatggtgcaattcctcggcgagtttgcgaacacgataccactcaccaggctgcagtggattgccagtgttctccttggcctcattgggatgcccatctctgccattatcaagcttcttcccgtcggctcgtcgtgatgaagatgagatgatatctgcagtgacagtatccatactgaccaaattccatattgtttggaggagctgaactctccatgcagtcttttggaaatgcatgtggggcaagcagtgggaataggcaatagctgcactttgacaagtttttttgtagaatatgaatgtgtcatatttcgcatcatattgtaagaagcattttgttttggcacttttgctggttcagttgtgtagcaggatttcaaggttggtgtttgtattgaatttcggtgccgagaaaattatgtggattaatgaacagaagcataaaaatatctccttttatcccctttccccttgcacttgattttgttatgttcattgagtagtggttagtgatacaccgcattgcactttgctatagcgtccatttttcctccttttttttcacctatgaaattattatatcctgaattccaataggatactctttctccagccatttaagattttaagaattttttattgatgaaatgaaacacaattcttgtacgttttgagaaaaaaatgtcttggtttatctattaaaaaaacaccatggtacatcttactaagaacaataagtctttactaaaaaaaacactaaaagaaaataagtctttatattataaacaatttactcttattctgatcggtttgacccgtttatttttttaccacttattataagctgggaaaagaatatacacaaggaacctaattaacaagctactccctccgtcccataatacgtcccataatataagagattttgagtttttgcttgcaacgtttgaccacttgtcttattcagaaacttttaaaattattatttattttatttttgacctactttattatctacagtactttaatatgaactacgtaccagtgtactcactnttacatca

SEQ ID NO: 3676 - DNA, 1284 bp, Oryza sativa
  unsure (1)..(1284): unsure at all n locations
gtcgtcattgtcgtcgtaattgtttccatcctcctcttcgtacaacatatatggtgttatatttattgtgtaaatgttgtacntttttatatnnnncccnnnncaaggcgctttttgatgcactactctaggcacacnnnttcatcaaaaccgttcactcaaggtccctaagcagtatatatgggtggtttcgctgacgcggcatcctagtcagcaaaaacaattaaaaaaagtacgtggggctcacatatcagccgcactcttcttcagtgagggaggccggcgcgagcatagagcggcagcggtcggtgggtggcgggtggaacggcaggtggtttcgccggcgccatctcttgctggctcccaagatgtgccgcgacctggagccccgcgcgagtggcggcggtgctcgagcaggccaccgcgggtgacctgctgaccatcgcgctcgacggcgccggtgagcgcgtccagaacgtcgacaacgtgcgccgcatcatctccgggcggcgtgaacggccggagccggaagccggaagccgagactacatgacttctatagcaaagcaaacaaactttggccacatcgtacgcgcacgcagcacgcgatccacttaatttggcagccactagctagccgcatgcacgaagctagtaactgctatgcgacacatgcatgtattgactagctctaactaatcagctaactaagctatgcattgcatgcacaccactaacagttttgtactggttaggcggtgctgaggcgctgagcgcgctctactacgaccagctcaagctccagcagcggcaatggcggaggagacgagggcagcgggtgggaatggcgtgatgaggtcgtcgtcggcggaagcaggcgaagaaggaggcgtcgctcggtcgctggccacgagaggtagctcggcggccgcagcacgcacgccaaggtttccaagaaatcttcaccgccgctgccctctaagaccctattgaagctctcctcgaagagcttaagtgaatgcaggatgctcagagccgcctcctccagcgagctcaccttcgccgaatcctgcacgccgcacgtcatattttcctagaaagaacgaaccagcggtgtggacgtcgtcttgtccacggtggtggcgtgctgctccttgacgatcactggtggagaaaccatctttgatcggtcggctcatttccacaatagtcccggttccaataaaaaccgggactaaaaaatatttttagtcccggtttaaaagctgaggggtatttttatgg

SEQ ID NO: 3677 - DNA, 1024 bp, Oryza sativa
  unsure (1)..(1024): unsure at all n locations
cattaataaaaaggttgaaactcagtatgtcggaaagctttcacttaatatggggatgttcactaaacgggtcggtccacccaacccatgttaaaatttggaatcttgaacattgttttgtaagctatgcaaaatatgatgtcttcgtgtcagtagttggtgaagaataatttgctcaaatcgggcaagtgtgtttccattttgtttcatatgttttttttagataatgattctgtttgatatgccccgcctaaatttatgtggtcttgtagtataagatctgaatgaggcaactatggtgtgatctgtttggcaaatttagaaataagatgctagaacaatgtctccataagccctacctcccaattaacctattcacttgagtttctactctatctttgagatgtactaatatctaataattccacccaatatcattaggtgaaccagaaaaaaagtgagccaattgggtttatcaattcaaagccgtcaagtcattgcaccaagaagattgatctttaaaccaaaacaaaaaaaaaaaaggttcaaacagggggttcatcagagagcagccgccgccttcgtgctcatgctcgaggagaggaggaagaacaggttgacgacgacctgaacgccgtctcggaggacgtgcggggtgggagcagcaacaatggcggcggccgatcaggtcggaacagagctcgatctttccacggcgaccattgagcgactccggtgtccaaattatgaggctgcgacgaaatataagtgggcattccaggccagatcagcagaaacacctagcttcctaggcttgtcaaaggttggggaaaattgagatgaacttatcatatcttactataaagttatcccccactaactccttaaacttaaacgtgcaagatgccgcataatcattcattaattaacaagataccacatcatcattcactaacaatcatcacatctaaacatcatgcaaacatgctatatctttatagntttataaattaagagcttttca

SEQ ID NO: 3678 - DNA, 2145 bp, Oryza sativa
  unsure (1)..(2145): unsure at all n locations
gcgcgtttgacattcacctaccacatggnacagnagntcatcatcgggctcgcatcctcttcatgcgagaccgcccgtgtcgtcagcccacgtcagtttcacgcaatggtttagcgataccggtggtatatttgtgccaagaagtttatatcaagactatttatgagaaaaaaatatgaacagtatattttcaaatttaagtcattggatccatgtcattataattttatcattttttgaaaaataccattactattcatctatttggaatcgtgccattgtaattatatagttagtcagtatatgccactacttacccgttcaaaacatattgtaaattttttggaccaaattaccctttttcatccttcatttctgaaagttcaagtgccattgatttggtttgatgattaataacaaatccaattatgtgagactaatgtttttataagcatttctttgcctagtctcatgtggatatgaaagtggagtgttggtggacctaaatcacaaggatgaaatgcatggagatcaagctatatgtatcactctttctcttcatgtacatattgatatgatcgtatataatatttccacgtgattggcatatgcatgtgtgactaatgttttgtttgagtattatctcttatttagtctatttacattgagaacgtggagatgatgaaggtatttttttagtatctatatttgagaaatgccttctattcttgtataggataagctctcaatgtttaatatcttgttatgcatatacttgcttcacacaaatattttgtatgcatacatttagggggagcaaatcctatactttagttatgcatgtaatcgatccaagttattcaccttcatttaattgggatctttacatttgaacatatatttgagtatatgacacttgttgtgttgattaacactcatcatttattcatatccttttatacatgcgagcggttggtcaacatgcggaggctgacaaccggatcattgggactaataattttattgcagcgaatgaaagaaataggtgccaaggattacaaaggagttgatgctcaagagatatcattacacctaataataccaagaatgacaaagtgaagatattgaagatgtgtgatactaaggggctattatagcaagatggtgaagggcaagcgatgctcagacgcgatggaccatgcggcggagaagggcaagcaagggggcttggcgcccaagaaccaaatccggtggtgaagggcaagtgacggctttgtcatgatggaccgtgagagaccatttgaagctacaagtaaccgcatcaatcatttgaagaatatatggtgaaacggtatcggcattggcgtccctcaaacaatgaaagaaagatgaaaaaaaggcattcctaatggtataattatcttcttatttacatttgagtttaggaatgccgtactattaagagggatgctacgtcgagatgtttgtgtatgtctcggtgctcaaagtgacctatcatagtgctaccttgagagaaacccaacctttaacctattctttgagtggttttagaccttgtttttggttgagtttggtagtcctctgagtgagctttccatagagtccaagttcataaaaaacggactcccgagcgaaaagttatagtcgttttactctgtgcttttcggaaagtccgaaaaattaccggaaactccgaaaatttctccgaaaattttcggacattccgaaaatggctgtgaatctgagatttgcttcagtaagttttcaaacttgtccgaaaatgcttttcggaaactccgaaaattacagtcttggcctccaacggttagtttttgaggggctcgggtatataaactcctccacccctcctttgaggggctgctgctcttggggagtattagacacatccaaagcccaatagccatccctatttccctacctttgtggtgcctctttgtgaggaggatttgagaagggaagagagtttgattgagagagtgaggagttgagagctagtgagcttcactccatcctttgtggtgactctttgtgagagggatttgagaaggggaaagagttggattgagtgattgagaagttcagagctagtgagcttcactccat

SEQ ID NO: 3679 - DNA, 1748 bp, Oryza sativa
  unsure (1)..(1748): unsure at all n locations
nnnnnnnnnnnnnnnnnnnnnnnnnnnnnnnnnnnnnnnnnnnnnnnnnnnnnnnnnnncacttcttgtctttaggccatcgtgccgtcttgtttgtaaataaagctttcccttcgcactttctacccctttactttctccattgaatgcctgcggcacggaaagaagaaaaaacaagagcaaaagtatataattaacctccctgtgatcgaaatgccgtttttaccccatncggccccgggcccaaccccccccccccttgggctcgttcttgtgaaaagataaatgcgcgctcggttcgtggtacctaagtactgaggggcaagaccgtcgccccgagggagccgcccagcgggactggccagaccgaggctacgacgaccgggggtcgaggacggccgtgtgtaggcccttccgagcccctggggttcggcgcaacctaggacgcggccctcatttaggctccctttcggcgcttttcaggtcgcccaatgccacttagggtttggagtaagcgcgaactgtcctttgaaccaggacaagccagaggaaagagtgagaaaaagggggcgtaacggcctccactttaggtggaaaaaatttattgcctggaaagggaaaaagatacaaagtaattcacagcagtagcccccgtccaaccccgcacaagccgaggggttgtgcgggggttggcccaagctcctggaaagcaaaaaatcgcgacgctatggatagaagcgatggaggtgttcgatattccaggggttaggcaactccgtgccgtcctctgtggttagtcgaacagagcctagccggagaacgccgatcactttgtatggcccttcccacattggcgagagcttgcttagccccagacgcgactgcacgcggcataggacgacgtcgccaactttcagtgaccggtcccggacgtggcgctgatggtagcgccgcaggctttgttggtagcgcgccgcacgtagggccgcgcgccttctccgctcttcaaaatagtcgaggtcgtcgcggcgaagatcatcctgcttggcctcatcgtacagcgcgacgcgaggcgatcccaaggaaagctccgaaggtaggaccgccttggcgccatacaccaggaaaaagggcgtttcccccgtggcacgacttggagtagtccgatttgcccacaacacggcgggcaactcctcgagccacgaatccccgtgtttcttcaggacgttgtacgtcttggtcttgaggcctttgaggatttcggcgttggctcgctcgacttggccgttgctcttggggtgggcgggcgaggcaaagcacaatttgatgcccatgtcgtcgcaatagtcgccgaacagctcactggtgaactgggtgccgttatctgtaatgatacggttgggcactccgaatcaggacgtgatgcccctgatgaacttgagggcggaatgcttgtcgatcttgacgaccgggtaagcttcgggccacttggtgaacttgtcgatagcgacgtataggtgctgatacccgcctcgagccgctttgaatggtccaaggatgtctagcccccagaccgtgaaaggccaagggagtgggatgaccctgcaggcttgtgccggctggtgggcttgcttggcatgaaacttgcacgccttgcacccggcgacccattcttgggcatctttgcacgcagtcggccaggtaaaaccttgttngaagggcttaccgacttaagtgcgtgaaggcgn

SEQ ID NO: 3680 - DNA, 7581 bp, Oryza sativa
  unsure (1)..(7581): unsure at all n locations
ngtgcgagtctttccacgaaggtcccagggggagtggggctcgtgccgacgcaacacgcgacaactcatcagcgactgtgttgtcgcgtcggggcacgtgccggagctcgagtccgtcgaagtggcgttccatgcgccgcacttcgcggacatatgcgtccatttgtggatcggtgcactggtactctttggatacttgattcacgaccagctgggaatcgcctaggaccaggagacggcggatgcccattccggccgccgccctcaaccccgcgaggagtccttcgtattccgccatgttgttcgtggctcggaagtcgagccgaacgacgtatttgaggacgtccccgcttggcgaagtcaacgtgactccggcacctgcaccttgaaggttgagggagccgtcgaaatgcataacccagtgcccaccacgaatgtcggtgtttgggtcctctccatctccggggagggagggaacgttggacggaacagggtcatccactggggtccactccgcgatgaagtcagctaggacctagcttttgatcgcgtgccgtggttcgaagtgcaggtcgaactcagcaagctcgatggcccactttacgacccgaccggtaccctcttggttgtgcaagatttggctgagatggtaggatgtcactatggaaacccgatgtgcttagaagtagtggtgcaatttccttgaggccattaagattgcataaagcatcttctgggcctgtggatatcgggtcttcgcctctcggagtgcctcactgacaaagtagatgggccgctgcacctttcggtggagccggtccgtgctgccaggggcagatgatctggggcgcccttgcctaggggccccgggggggtctcgagtcatgtcaggaccataggcctcgggaacactcgccaaagcctcccctcctcccacgggggcctcggggtcctcctgggggttgggggcttcgggcaccgggtcttcgggggacgaagggccatcgtgagtcaagggggcctccggtccgctctcttcgcgctcgactactaggacggcactcaccgcatgggggatcgcaactaagtagagcagcaacggtttctccggccccggggcaaccaagatggggggaggagatgaggtaagctttcagctgattgagagcttgctcagcttcctccgtccacacaaatggcctggagcgcttgaggagcttgaataggggcagcgccctctctcccagcctcgatataaaccgacttagggcggccatgcatccactgacgcactgcacatccctaagcttgctgggggggcgcatcctctctatcgcgtgtattttcttgggattagcttctatgcctcgggaggagactagaaaaccaaggagtttgcccgccggcacaccgaacacacttgtcggcgttcagtttcacgcgtgtggatctaagactgtcgaaagtctcggccaaatcctgcaacaacgtgtcctagtggcgcgtctttaccaccaggtcatcgacatacgcctctatattgcgccctatctgattactcaaagtaatacgagtcatacgctgaaaactagggcctgcattctttaacccaaaaggcatagttgtataacaaaaggtgcccacaggagtaataaaggcagtttttcctcatcttccctagccatgcagatctggtgatacccagagtaggcatctagaaaacacaaaaggtcgcaccccacagtggagtcgactatctgatctatgcgtggtaaagggcagggatctttagggcatgccttgttgagatccgtatagtcgatgcacatccggagcttgccgttggccttcgggacgaccaccgggttcgccaaccactctggatggataacctcgcggatgaagtcagcctccaggagccgcgccacttcctctcggatgaaggcctgctgctccggggcttgacgctgcactttttgccggacggatcgcgcatccggccgcacggtgaggcggtgctcgatcacctccctagggaccccgggcatgtccgacggcttccatgcaaagacgtcggagtttgcccgcaggaagaagacgagcgcgctttcctatttggcgtccagggtcccgccaattttggcggtcttggacggatcgtcgccaagggggatctccttgacgggcacctcgtcagccgaggtgaggcgcttcttggaggcgcgggatgcggaggcctccggggcctgtggctccgtggccactgccaggttgtcggcgcgctgctccgcgcaggtgagggcgactttgacattgccaaagacggtgatgggaccactagggcccagcatctttatctggaggtaggcgtagtgggtggcggccatgaacttcaccaacgcaggtctgcccaggaccgcgttgtagggcagattaaggtccgccacatcgaagtcgatccgctcggtacggaagttggtggagtcgccgaaggttaccgagagctcaacgtggccgaggggccatgtgtgtcccggagtcacgccgatgaccggcagcgcggctggagcttcatccccggggccttgaacgcatcgaaggcggctggggagatgatgctcaggctggcccccccgtcaaccaggacgcgcttcatcctaatgttgtgaatggtcagggagaccacgagggccaactttccacctcgagcgagcactgttggatggtcgctcttggtcaaaggtgagcttcacctccgaccagcgtgccttccgagccgcttcgtgggtcgggacggcggccagaagctctcgcctcatagccttgaagcctcggcgggaggtgtgaacgcaagccccctcctccccccggtcgattgtggcgacggttccctgaggtatctggaactccagatcctcgctgttatcgccatcatcggcgggagccttcttcttggcctcccctcgcaggtcttcggttggggtcgcgggggctttgccctctcgtcgaccctgccgcttctcctcatcggctttctggaaccgctcggccaaattcttgaccgagcggcagtcggcgagattgtgccgataagtgttgtgcaccgagcaccacttgtctgccgatcggccctcgccggatggagcagtggagctcggcttgtcgccggtggcctttcccttgcgcggggcccgtgtgggcccatcagccgcaaggacatggccctcgtcatcggagcgggccggtttccttttgcccctcctatctcgccgcttagagaggggaacagactcgggggtagccgcagccgccgcgccggtgccgggggagttccaggcccacacctcctccttccgagccaccttgtccgccagctcgaagagctcggcggtgatcttggtctccttggaggcgatcttctccagcatgcggttatgccgcacgccattccgaaacgcataaacgaccgcatgggccggaatgcatggaatagtgttgcggacctggcagaagcgctgtatgtacgagcggagggactcatcgtccttccgccgcacagcgtgcaggtccgcctcttctcttgggcggggatatgtgccctgaaagtttgtgacgaactgctggtacaggtcctcccaagagtggatggagtcggggggctgggtcatcagccagccgcacgcctgacccttgagggccatggggaaataattcgccatgacccagtcatcgccccctgctgccacgatgatcgtggtttagatctggaggaactcggagggattcatgctgccatcatacttctccgtgaggttggggcgaaacttcgggggcaaccggacattccgaagactcgccacgaaggccctacaaccagtccctccaggggtgagcgtggggggagggctgtctcgtgaggaggaacgcggcactccagatgaggaggcgccttcccccatgcgggtagctcggcgctcgtcccggcgtcgctcgatattgattcgagcatcctgctccccgtagagactatcgggacacctccggcttcccgaggcccccgacgatgttggagccgtggaccgcctcgaggccgtggctgatcgacgggccctcctcctcgctgacgaggagagggtaatgggggtacgcgacgtaccggtgacggcgggtcggccgcccgcggccaactgccgctgggcagtggtgaccaatttggccacgtcgtccaaccagcgctggacaggggtctccggctccgagttcacggggggatgccgcagaagggcacccgccgcctgaagcgtgcctcggggcgagccgccgtcaccgtaagtgaggcggcgccatgccccgatgcgtcgtggcctccctccacccgggggcggggagagggccaaaccacccgaacggttggggtcctccctccgcgaggggtcgtggcggggagaagttggagagttgcggcggtggtgacgagggccgtggctctcgctagcatcctcactcccagacgaagtgggggtgaacaccaccgcttcctcctccaggacctcgaccatgatcatcgagggtcaaaggaaacttgggacggaaggaaacgacttctcgttaaagcgcacgacttccccctacctggcgcaccagctgtcgaggagtgatcctctctagcagaagatcgtgagacccccctcccttcatgagttcggccgggggaagaagctcgcctctagaaatcgcgtatccatccccaaggctcctagctagctcgcacacaaccaaattatacaggttcgggccgctatgaagcgtaataccctactcctgtgtgtgggatttagactgagagttacaacagttcctaaactcgggagaacattcttacttccctcctccacaagctcagattttctgagagtcatccactttctcggtgggcaaggtcctccttttatacctcaaggggataccacatgcaccgcctctacctactcttctttcgggtggggacccaccctatcttgactggaactccacccgtgccttcgcctggaagctaaaccacagcttgtccttgagcggggcccagcgtcgtccctcgcctgacatggggaacagccctgtcattccctcattaataggtgaagacttgtggtggccgccgtccgaatgaccccccgatgggacgggtcatacctacctccactccgccggaagcagatgcgacgtgggagcacggttgtccgtccagtcagacgtgaccggcgtcaggccggtcacagaccggtcattcttgaccattgtgcgtcagtttagcacgccgcacgtttgccccactgcattaaatgcgatagggggcagttggggcgctgcacgcattaaaggaagttcagcctgggccccctcctcgcttgctccccccgccaaacggcggctgggcgagggcctcgaggcgaagaagtgcaagggcccgaggggcatgatgtggcaccccgaggccccgactccccggccgctcctgcggttcgcggaatgcggggacaggaccaggctatagggatacgtggcaggatgggaaggtagattcccctcacttcgtatacccccgggcccatatctccgacatactccctccattctaaattgatctacatatttcataggtacaacaagaccaagaaaagctaataactctctcatactatatttactctagcaacaaactcaattcatgcatcatccccactacttcctagccaatagcaaatcaagatattgcatgtgtggtataaatacttgtgtgcatggatgcatgaatcaatatccatttactccaatgcataaataacgaatagacttaataaatgaacacaaatatatagattatttaggaataaccttaaaaaaatatatgtagatcgatttggaatggagggcgtagttggtaaatatacattggtgatgcccttaggaatttggaaagagatgccccatggtagatgccattatatgcaagttcctacctttgtctttctttctagttatgtacttcggattgactcggatagtatacccatttgttatacccctaatgatatatctaccttgtgcaaaacttggagagaggcaacacaaatatgctaccttcattcaggcaatcttaaaatatacgacatttatttcttctctaatcgttgtgacgacttcttgaatgtgtaggttttggaacttgggataggcatgccatttagttatacttgtggataaaattggcacaaatgaaaataccaaagaataataaagttcaacattaataatgtgtgtattcatatccagatatttttccaacatcttagagccctgagatgagtgagttcttgacctgacttttgtacacaagctagttgatggcaatgttccattcgtttcacaaatggagggtgcatgaagtcatcaagaccatgagtgcaagcaaggaacatactagtgtagacatcatatacaagagttattattacccaaaattaattacttgcagagatgaacaattactttaagcaagactgcaaataaagtcaacaactacaactactagctatagagaggaagtgcagtattaattgtcaccaaattgcctaatggattctttatatggaggggtatatcttgtgggcactctgtccacttgtgtgaacagactgttctatgcatccttgatgcagagaccaaaggtatcacacaggtctcgttcgattctccaatatggatgaagattaagtgcacacgcaaaagacataagtcattaccacataattaatcgaattttaattattaaaaacttgaaaaagagatttattctattttttagcaacttctatgtagaaagtttttatactaaaaacacattgtttagcagtttgaaaagtgtgttaccggaaaacgaggaaacatttgtatcttgttggagttttagaaaaaaaaacgaggaaacactcttgcatcatctataagaaaatcgctaaactagtcatgcaatatctttgagttaggagtgctgagaagggaaaaaaggactcatttaaaatggttgttcaaattcacgtggatttcatggaatgagagttacttgttggctaggataggcctaggaggcatctggagttgttgggttactgtgaacctagcatacactataatagatagaaacattgtggtattaattggttgcaattcgtcttagtttttcaaaatgataatgttatatgcatgtgagatatgtgcttaccggtggggggcgaaatttcaatccctggttcaaagtggaatggtaaatttgagtaggcctgtctgtggagcaatgtaactgttttgttaagaataaaatgaattggattttagactgttggatcaccatccaacgatccagacctgcccactgtttactagtataactttaaactgaagtgagcagatgactaaacatttacgaactatggtcttcaaatatctgcaggtgctgaataattgcccgaaatttgatgangtnctgtnccactggtgatcaatnatcagtntcaaacgcca

SEQ ID NO: 3681 - DNA, 1133 bp, Oryza sativa
  unsure (1)..(1133): unsure at all n locations
gcgtggaaatggtactccattctnnnnnnnnnnnnnnnnnnnnnnnnnnnnnnnnnnnnnnnnnnnnnnnnnnnnnnnnnnnnnntagcatttgctgttgggttcgtgagtcgcttcatggagcggccaactgaagagcacatggtggccctgaaacccattctacgctatgtcgcttgcacgatggagtacggacttcattacaaaagggagaaagaggagcagcggctgattggttacagcgacagcgacctcgccggcgacattgatacaaggagaagcacaagtggcatgttgtttttccttggctcaagcttggtgagttggcaatccatcaagcagagagtggtggctttatcttcctgtgaagcagaatatgttgcagccaccaatgctgccacacaaggaatctggttggctcgattgctcggcgaacttcttgggaagcaacctaaagcgatcgagctaaaggtggacagcaagtctgccttggcgctggcaaagaaccctgtcttccatgagcgcagcaagcatattgatttgcgctatcacttcatcagaagctgcttggaggaaggaagcatcagcgccagcttcatcaccaccatggaccagctcgctgacattctaacgaaggcattggggcgagttcgattccatgagcttgttgcaaggattggagtggtcaagattagttcagaatagaagaacaaggattaaggggagattgttagtataatccttgttctagttagttatttggttttcttagacagtaagctataggctgcagctgttactcggatgtcagactgctgctattagtggtagtagtcaattttgattttacctctagcaggaacatagcagcagcagtattgtcggttcagcaacggacctatccatgtactataaatatagctattgtgctaacataagtaagctttttaagctcattttaagtttcagtttcagctagattattgagtgccctccagaagtgatcctaccaccaataaccatcagcatattgtgttcaattgtgcttnnnnnnnnnnnnnnnnnnnnnnnnnnnnnnnnnnnnnnnnnnnnnnnnnnnnnnnggntnntgctancgattcctactttgcacg

SEQ ID NO: 3682 - DNA, 1155 bp, Oryza sativa
  unsure (1)..(1155): unsure at all n locations
gcgggaaaggaactccagtctnnnnnnnnnnnnnnnnnnnnnnnnnnnnnnnnnnnnnnnnnnnnnnnnnnnnnnnnnnnnnnagctcactgtcggcgtcagaaactccgaacttggcctcaagagcatcccacatgtccttcccagaaggcatgtgcatgtatacgtccactatgttgtcagcgagtacactgatcaatgttccacggaacaggcaatctgaagcctcgaacttagcctcttcctcaagagaaagaggtggttcacttcgtttgccccgtgaaacatagaagcactgcatcgctgtcaaccacaatagtgcacgtgctttccatcttttatagtttgaaccatcaaaagcatgtgttttcagtgcagcagcaaagccaactaccgaaaatgacctatcaagtttttggattgttggaaatatagtcattaatcggcatattttaatccaaaatgttaaagcaataatcatggcataagcagtgtagggcgatcttaacataaccagtagcatactatgcgcatcatgaatgtcaggaacaggaacataacagtaacgcatagaggcatcatgaagaacaggaacaagaacatagcgcacatagtatagcgatagcgctaataatggaacaggaatagcgctaacaatgggaacaggaggagaagattataccccgagaatggccctccgctggatggtgaggcagaattgcctccgttgttgttgtcgttcacggcacctcctcctggcgcactagctccggctcctgttggcggcgcaccacctccgccatctcctccagcagcggcggcaactccagacatcgcgatgagcagtcgtgtgggaggcactccccaaaaacctgatcacccgcctacccggtgcagatctcaggcgaaggtgtggtttcggaggcactgctccttccaatctctcgtgcgcgcaagagatcagaagcgaggaagcgagagcaactcaggcggagaaggagaaaccaacaccggaaaagaagcgatgaaaacggatcgcactcgcggcctccttatctatnnnnnnnnnnnnnnnnnnnnnnnnnnnnnnnnnnnnnnnnnnnnnnnnnnnnnnnnnnnnnnnnnnnnnnnnnnngcctatcccntggccgcgtg

SEQ ID NO: 3683 - DNA, 756 bp, Oryza sativa
  unsure (1)..(756): unsure at all n locations
acgggaatgaattcaattacnnnnnnnnnnnnnnnnnnnnnnnnnnnnnnnnnnnnnnnnnnnnnnnnnnnnnnnnnnnnctttggagtaatctgattcgagagaagattatcttttcgactacgaaggtctcaggggctactgtggatattatgggtaccccatacccatacggcatggttatccgactagtcataggggataacttatatctatggaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcatatgagacaaactgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaaatcatgtttcgacacttgtattcctctcgtgcctccactgctgctcgatggagtggaggagtggtggcagcatggagggcgcgacgccagcgcgnnnnnnnnnnnnnnnnnnnnnnnnnnnnnnnnnnnnnnnnnnnnnnnnnnnnnnnnnnnnnnnnnnnnnnnnnnnnnnnnnnnntcccgcgn

SEQ ID NO: 3684 - DNA, 761 bp, Oryza sativa
gtgcgcccatgtgtgactatcgtctagggcgaattcgaactcggtaccctgattttccttcgtccattcttgttgctggagttggtggagcggacggaaatggagataatgggactggaaagttgcttgcaatcatatgattgatctacttatttcttatcagagctaaaattgaaccgcttgactaggtcttgctcactgccttagatgttacaacaaatactgataaccttatatttcccagattggaaagattgaggagggaatgactaccaatatgcgagtcatgaacagtgtatgatttttcttatttgcacagtagtatttcatcagtatatcatgttccatgacccatcgcagcatgaataaagcatttgcaagtctgtctctcctcatctgaacaaatcaggaatatagtttatttttttctagggaatgggttggagctctgccatttcactgatagaagaaagcaggaatgtagtttatgcatttatatgtatatgttgaagacgtattattatatccttgctgacattgttggattttgtcaaaatagatacatgcatctcatgttagagaaggaaaaaaaaaaggacaacagttagacagctgtttcttgaaacctcctcttaggacaagaaaaaaaaatgttatgctgtttgttgttaatgaaaaaaaaaactttatgcttaagatttcaactaattgagcgggtttcacattttttttgtaaagattctgactgaggcagcaactgg

SEQ ID NO: 3685 - DNA, 794 bp, Oryza sativa
  unsure (1)..(794): unsure at all n locations
cgcgggaatgaactgcagctctcacnnnnnnnnnnnnnnnnnnnnnnnnnnnnnnnnnnnnnnnnnnnnnnnnnnnnnnnnnaatggttaggatgaagcctggtatatatctgaccgggaccaacgtgccatctccaggagctaacacgccggctccggctagggacgagtgcttggaggctctcatcctgatgggatggggcgggctgtgcgtcaaaccgcctgtcgccacctaacccacgatctgatcggtctgtgactggtcacagaccggataaacgagcgcgctgcattgcgttacatgcggcgtgacgcgctcgtccaaaccgcaataaatgtggttaggtgagccctgctatgctcacctaccccgtatacgcggcgcaaaacccacaaggggtcggggcgcctcggccctcggggccgagacgggagcggtccgacccctcggggagacaaagagaagggcggccgtatcaccctcgggtccgacccccccccccgagggggttaggccacgtgggtgatcgtgtctgcctcaagtctctaagtcatgatactcccggtcccatgtcaccgacagaatatatatcaaatcagtaattaaatatattttcataataaatttgtcttgggttgaaaatattattacttttttttataaatttggtcaaataaacttaaaacagtttgactttaacctaagtcaaaacatcctataacttgaaacggagggagtagggtaccgagctcgaattcgccctatagtagtagtagatctacccngaccatct

SEQ ID NO: 3686 - DNA, 733 bp, Oryza sativa
  unsure (1)..(733): unsure at all n locations
cggtggaatganatgctactccnnnnnnnnnnnnnnnnnnnnnnnnnnnnnnnnnnnnnnnnnnnnnnnnnnnnnnnnnnnnnnnnnnnaggcaaacagcaagaaaaggacttattttttcctggtttctcaatttcatatctcacaaaacggattgagtttgatcctaaattttacatggttctataacatcacctccctgaacttttatacggttgttttgaccacgtagatggtttccattattccatcccggtaaaacttaaaaccagaacatattgacagaaacagtctaatctcataaaaataaggaaatatgctattgagtagtgaatggcagtgtagtaagagggaggacgaatcgaatacaaaccggtgaggtgatgatctggggatcgtccctgctacgcctgaacaaatacacacacctatagtcatactgatctctcgctaacacggtgccgaagatgctgatagggtaacccacgtcagattcgacaaccttgattgaaatgatattcatggaggtctccaaatggcgataatcagaggaagtgagcgagtgaatcggtggcccaagcccagccttagcttgtaaatcagagacatgagacttcaatcagacaaaagaatatgtatgggttttacacacttnaaataatccaatcaccaatgtgatgaatggatagagaggccgcatacgaatggttagtgnattagatcatattcangn

SEQ ID NO: 3687 - DNA, 885 bp, Oryza sativa
ctaggctccgtcgcagtacagcatctccaccaccgccaatcaccgaagcgcgccaccgctcatccgtgtccaccatcgatctttgccgccgctgcaagatgagatgatataagactgagggtaatctaaaaattctgaacgttcacaattgcattgggaattgcatccgaatatagaggattgattggcgtgagagagcgtacataccgtagcgggaacaccgatcctctccaactccggctgctcttcggggacgagccgccgccgccgccgccgagccagaggcggttagggtttggcaaagatgtcagatgggctattccgtctctctcggacaggccagattctctaaaggcataccctccttcctttcctgggcccgtttggcacgttacggctttctagttttggaggccgaataagttcacaataggtccctccatttatcgcattttcgtcctcaatccggaaaaccggatacaacacaattacaaaatcatgcaaacaatccagaaaaccagatacaacacatccttaacttacaaagccatgcaaatgagatccctcagtagtattgacccgggcttggctaatatggaacctacatagatcttttaacaaggttttcatcctatatagcattgacgtgacacttacgtgacaatttgatccagaaaaataaaaaaatcatgggcccacatattagttacacacacaaaacaataaaaacaatggtgaggcccatgtggcctcacatgtcatcctcgctactctctgcttctctctatcctctcttttccttgcaaggagaaggccagagcaagccaccagcggggtgggcgatgggcgggagcacagggcaacggcgagcgagctccttcgtcc

SEQ ID NO: 3688 - DNA, 1340 bp, Oryza sativa
  unsure (1)..(1340): unsure at all n locations
cgctgctgcctttgaaatgcgnnnnnnnnnnnnnnnnnnnnnnnnnnnnnnnnnnnnnnnntcggcgtggccccctccgggcgcctgctgctggcacgcgccgccccgcccccttggggaggagatgggggaggggttccttcctgcttcctcttcccccgggcgtcggcagggcggtcgctccccgggcccccgtcgcggggcccagaagcacgaccccctcccggggtagattgttcccccctgcggctcccacccgcgccatcgtggcctcgaggagcccgctccttcaacgccccgactacctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagcggcgcaatccggcgacgaaggtagtcgccgaacaccatggcccctgtgagcccctgggatcgcaggcccaccaagcggtcgaggacggcgtcatagctgtcacgaccggaaataacccaacgggctttcctgacgtgtgtgcattaatccttgtcccaggaggcaaggtacaccataagttgatacaaatcatagtttaacaagcggaagcgtaaatagttaacttattacatgggcagcgaaagcccagcacacacagagacaaacgagaaacagcgggagactagggcgacgaccacaggcgcttgacggcaggcacgagctatacaccgaaaccttcatcttcaaggaactccttttctggacttgggaaaaattgagcaagactgagtacaaccaccgtactcaacaagacacacccacaaatgcagaataaatgcaaaggagtacaagggaattataatgtaaagggttagggttgcagtaaacagcatttaaagacatttagttgctcagggctattttgtaaacgcgatcctagaactatacaaagttattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattnnnnnnnnnnnnnnnnnnnnnnnnnnnnnnaggcgattctatcctgtccatc

SEQ ID NO: 3689 - DNA, 2215 bp, Oryza sativa
  unsure (1)..(2215): unsure at all n locations
acttttgtttatgactagactgagccacaaactaagccttacccactagacatgtgaaagtacggtagtgctttgcaacagaggcccgaagaccggtccttatatggccgaggtgctaccatcaaaaccatgcaccccgaacccagcctaaaaccatttttggggattttgaatggagggggcggtgtgaagccaattccacaatgatccaacaattccacagtgtccaggtgatatgaatatttcccaaagtctatagttgtaaaccacctaatgttacctaattaaattgcgaagcatctatctaaatttaaactagggatactacgagtagagtgtccactagttgaggttttgtttaatctagggtgaacaaggtaataataataacaataacaataataatatggtcacaacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaccgacggcttcgacttccacgaagagcggatcttccgaagctgcagcgtctacacgaccaacggaaaagaaaaggcttttactctaataaattccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcgggtttattgcgtcagccgagggagagggcgcgcggaccgggtccacgggagtggggcccacgcgtcagcctctcggtccacggtggaccgggagcacgcggctggcggcggccggcgccgtgggtcccatgcgtcagccgcacccgcgggcgcgggcggctgacgcccgggcccacctggcagccgcggggcgcgcccaaagggggcctcgccggcacggtcgacgggagacggcgcgcccgcgccccgatggtcaccgccggcgaccaccagcgcgtcggatcggcgcccgagagagaggagggaagggggaagcgaacggagcggtccacggctcaccccggtcgacggcgacgacgggaacggcggccgaaacgcaggaaggcgtcggcgcggctcggtacgacgaggacgacggcgctccgacagtcggcgggcgaaacggaggcgcggacgaggtcgacggggacgcggcgaagccgaagaaggtgacgccgagtcgggaggaggtccggagcgacgacggcggcgaaccgaagctcggcggcgacggcggagagaatatgcgacggcgcgagcgcgattccgacggggagagcgagtggcgaacgtcggaaacggaggaggagggcacgggagtggcttaattagggttgggagtcagggaaggcggccggggtgttggtaaccggcgcggaggttccggccgccattgattgcgccggcgtggtttgcggttacgattccgggcgtttttgagggagagtgagagggacaatcggggggatagatagagggattcgtggggtttatttcccccttctttattgcgcgcggggccgccgggagacgccgagtttcgcgtcggcggcggcgctagggccggggcgaccggcgggcccggcgcgagttgggggttgccagttgggccccccccgtcagcgggggtgttggccgggcccgcttgttagcggcgcgcgcgcgggggggacccgttgggccgcgggggaaagtagatagagagaggaagggagaggtttggcccgagccggcccaggagggggtggggggccgggggtcttcttttggggtttttttctttttttngcccttttcccctttgtttttttcttttcgnttnttntttgtgctctgccccttcccttgnnttcccctccgcttttggcttttggttttgcggggtctcctgcgtttttggttttgggttctctgcccgccgcggngcggtttgtttgggtgttnntggagtgtcatcatcccgtgggggggggaggagaaagtgttatccctctccgccccgtggtctagtctcgactatttgtatggagtcgattattttctggattcggtgtcaggtttgcg

SEQ ID NO: 3690 - DNA, 791 bp, Oryza sativa
  unsure (1)..(791): unsure at all n locations
cgcgcgcccctttgagatgcgaatctnnnnnnnnnnnnnnnnnnnnnnnnnnnnnnnnnnncggcataacaggccagccgtgtaggcggaggcaccaatcggcggcgacggaggcaggccggcggcgtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccaatcggcggcgacggaggcaagccagtggtgaagacgatgtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggctnnnnnnnnnnnnnnnnnnnnnnnnnnnnnnnnnnnnngatctactcgnaccagcg

SEQ ID NO: 3691 - DNA, 1243 bp, Oryza sativa
  unsure (1)..(1243): unsure at all n locations
gtggggattgaatgcnactnnnnnnnnnnnnnnnnnnnnnnnnnnnnnnnnnnnnnnnnnnnnnnnnnnnnnnnnnnnnnnnnnnnnnttagtgaacttgtcgatcgcgacatacagatactcaaacccgcctggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccacattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactctcttcgcggtcctcgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtctgggctcgctaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccctagtccagctgccaccttgagtcccgcaaggagtccctcgtactctgccatattattggtcgcccgaaagtcaaggcgaaccaaatatctgaggacgtctccgttcggcgaggtcaacgtgacccccgcaccggcgccctgaagagacagggagccgtcgaactgcatcacccagtgggcggtgtgaggcagctgcgaggggcccgagctggcctcggggactgagacgggctcgggagctggggtccactctgccannnnnnnnnnnnnnnnnnnnnnnnnnnnnnnnnnatcagcatctcaatgggcgcgc

SEQ ID NO: 3692 - DNA, 1745 bp, Oryza sativa
  unsure (1)..(1745): unsure at all n locations
ccgcgcccatggagatgcnnnnnnnnnnnnnnnnnnnnnnnnnnnnnnnnnnnnnnnnnataccccttctcgtcaaatttcaaaaccatttattttattccctcaattaaatcctgatgtttcttttgagaggcactcaagtcgggttccactgagcgatttattttttcttaaaaagaatgtgtgcctcacatggacagaaaccggctagcgcctagcctctctttctctccgacctgtatgtaccattgaaaaagttcactttgactctcttttaacttgatcaaatctgattcatatccattaaccataaaactggatatgacgacttctctaactattgaaaccgtcaaaaacgatgggaggccacttcgctgttggcgctggtgcggaaagggctgggatgggagagagagagaggagaaccacttcaccgctccccgtcatcatcctgacaccctgttgcgcttacgccgagaagaagaaagagggagagagggggagagagagaagagggagagaggttactagagagaagggatgacaggtacaagaaaacaccatatttatatggacttagtgcttctttaatcatttgtatttagaattttttgttagttagtgtttattattatgtttatatatggtaaaatggtaaatttgaaattataaaggtgaaataaacatgttaaggagtcagctcgtgagccaagcctagttaggcttttagctcattaaggttaatgaggtgaggttgttactgttatagataagacatacctaatatttttatgttagacttagcaggacccaccgtatattaagtcttgtacagaatcaagcctcacacatgtaagatgttttaaataaggaaagagaagcagagtcctacttaggcatgtcaaggactactcggatcgtacttggcaccctagttatgattggacaaggggactcctaatgatataaatacaaaacgccacaggtgaagaggagagatgtgaagacatgccaatacagatttagacaattcaaggaaagcttagacaaacctaatatggagtcatagaggtccacgagagggatctaggcgacctccaatctcaccaagttcatattcgaggaagcgtactatactagctgtcgaccacatgtgagagctctatgccgctaagctgaccaagactagattagattatcccaaatttagtactcgtgtgatactgatatatataaaggcaacactgacttcagccaataggaatagggctattaggggacccgaacctatataaaaacttgtccatatcggacacgacttaaactttacaaaaataaacacaccagcccattacgaactctaacatagatttctaaaactcataaaagaaaactgactcttatcctaattaatagatacgattgtctaaaacaaactccttgtttggcaatatctttaaatccttgatccgagctcgacttatagtcggaaactgtctgtatctgctatcttttccatatcggctaaccgagtctaattttgtatcgatcgatacggctctcagccgatgcgctgcattggccttggaaaccaaattaactccttcaaatccgctgttaacaggaggctgcgcgaggagatgggaggtgcgcagagaggnnnnnnnnnnnnnnnnnnnnnnnnnnnnnnnnnnnnnnnnnnnnnnnnnnnnnnnnnnnnnnnnngtgcagttcatcttggcgct

SEQ ID NO: 3693 - DNA, 2030 bp, Oryza sativa
  unsure (1)..(2030): unsure at all n locations
ccctgttangagtagggtcnnnnnnnnnnnnnnnnnnnnnnnnnnnnnnnnnnnnnaagatactgatgcctattagtagtgacagcgatgtagccagccgtgaagaagatagcatcagttggcgttagaacaggccagccgtgcaggcggtgataccagtcagcggcggatgcggcggccggtcggtgaagacgtagacgcccaacaacggcagcataataggctagccgtgcaggcggaaacaccagtcgacggcgggcgaggcggccggtcggtgaagacgtagacgcccaacaacggcagcataataggctagccgtgcaggcggaaacaccagtcggcggcgggcgaggcggccggtcggtgaagacgtagacgcccaacaacggcggcataataggccagccgtgcaggcggaaacaccagtcggcggcgggcgaggcagccggtcggtgaagacgtagacgcccaacaacggcggcataataggccagccgtgcaggcggaaacaccagtcggcggcgggcaaggcaagccggtcggtgaagacgtagacgcccaacaacggcggcataataggccagccgtgcaggcggaaacaccattcggcggcggcgaaggcaagccggtcggtgaagacgtagacgcccaacaacggcggcataaaggccagccgtgcaggcggaagcaccagtcggcggcgggcgaggcggccggtcggtgatgttctgactgatccattcctggagcgtaagagataagcttaaagccatgaatcccttttatgcatatctggatctggatcctgcagaacaaacatataggatgagtagtatctgatataaatataatacttgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatccaacgagcccccgggtgctaggaatcggcccaaaggcaaccatccattggcaaaccaaacggaaagcataggaggatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtctgcggcgacaaaggcggtcgactgtgaaagcgaaaatgcccactaatggaggcataatatgtcagccgtgtaagcggaaacaccagtcgacggcaacaaaggtgatccaacggtgaggatgtatacattcaacaacggcggcataatatgccatccttgtaagcggaggcaccactcagcggcgacagaggcaggccggcggtgaaatcgtatacacccaacagcggcggcataataagccaaccatgtaagcggaagcaccactctgcggcgaccgatgcatgccggcagtgaaatcataaacgcccaacagccgcggcataatacgccaaccgtgtaagcgaaagcaccaatttgccgctacggaagcaagccggcagtgaaattcttgacccccaacaacggcggcataatatgccaaccgtgtaagcaaaggtaccactcggcggcgactgaggcaagcccgccgtgaagtcgtaaacccccacaatggccgcataat

SEQ ID NO: 3694 - DNA, 875 bp, Oryza sativa
  unsure (1)..(875): unsure at all n locations
ncgncggcataataggccagccgtgtagncgaaggcaccactcgncgccgacgaagcaagnccggcggtgaagtcgacgatgcccatcaacggtggtgtgaccacccgcccgtataggcggggacaccagtcgccggcgacgaaggcaggccggtggtgaagtcgtagacgcccaacagcggcggcataataggccagccgtgtaggcggaggcaccaatcggcggcgacggaggcaggccggcggtgaagtcgtagacgctcaacagcggcggcataataggccagtcgtgtaggcggcggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgcagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataagaggccagnnnnnnnnnnnnnnnnnnnnnnnnnnnnnnnnnnatactcatcccgatctgccg

SEQ ID NO: 3695 - DNA, 732 bp, Oryza sativa
  unsure (1)..(732): unsure at all n locations
cgggggattgaaatggtatctccnnnnnnnnnnnnnnnnnnnnnnnnnnnnnnnnnnnnnnnnnnnnnnnnnnnnnnnnnnnnnnnnnnnccgccttcgctcttccaagtagtcgaggtcatctatgcgaagctgatcttgatcagcctcgcagtacatggtggcccgaggggacctcaaggtgagctcggatgggagaaccgcttccgcgccgtagacgaggaagaaaggcgtttccccggttgctcggcttggcgtggttcggttcgcccagagcaccgctggcaactcctcgatccacgaatcaccgtgcttcttgaggatgttgaaggtcttggttttaaggtctctgaggatttccgcattggcgcgctccacttggccgttgcttctggggtgggcaggtgaggcgaagtagagcttgatgcccatgtcttcgcagtaatcgccgaaaagttcactagtgaattgggtgccgttatccgtaataatacggttaggcactccataccgggctgtgatgcccttaatgaatttaagtgcggagtgcttatcgatcttgacgaccggataagcctcgggccacttagtgaacttgtcgatcgcgacatacagatactcaaacccgccttgggcccgcctaaacggtcccaggatatcgagcccccagacagcaaatggccatgaaagtggtatgatctgcaaggccttggcccgctgatggatttgctn

SEQ ID NO: 3696 - DNA, 1445 bp, Oryza sativa
ctgtcccgtggatgcgatcatctagtctaggcgaactcgagctcggtacccctactcctgtttggggatttgaatccgtcgggtgtagtatagatctgacgatcaggttgtctcatatgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctggtacatattccatagatataagttatcccctatgactagtcggataaccatgccgtatgggtatggggtacccataatatccacaacaagggaggacggcctcacctggcacgttcagcacggcctcgacgcggcggcggtggtggctaggtcacctcctccacactgtccaggtcgaagaacctagactcagcgttgtccacagggccggcgttgttgtcgtcatcctccgccgccttatcccttgcccgtgccgctgttgacgcaaaaaacacacactggcctgggagatctgcttagttccagtgcatatccaaaggacgatgagatgcgggtctgccagtcagtttgactctgcaactgacaaaatatacaaatagcatatcaatgagccgatcggctgacaagccgatggagtaattctagcccatgcctatgtcagccgatagcgatagggttttgagctatcgactatatatccaatgtagaatctgacacttgatgtaaacaacaatataaaggcaatcggttgatgataatataatatagcaataatatagtccagtagaaaccattcggctaataatgatatggtaaataagcatcgatccgaaggttaaagcatacatcggctggaggtccgatagcattaaatccacaagattagataatcagtaaaatctttgttgccatcggctaaatccaatatgtatgcaatccttgtaagctgatgcaacgtctagataactcattggctgaaaccccgatgaaacacttattggcagtcaaaaagcaggctagggattatggttttaaacacgacttagtagatcaaacttaacttatgcagcactaagtatgaatagaaacataatatctagacaatcaagcctttgactaatttttgggtggtagatgtcttagctaatctaatctagtaaaacaatttagccggtaccgacaggaaccctaaagcgagaaacaactgatagagctaaattgagatactaagactagattaactaagacatatgataaataggcagacaaatatatcatccaaaccggagcaatccaagaggtcgaacgtactgatgcagtcttgaacgacgccgacgtagactagacaattgccttgggccgccgaaacatgg

SEQ ID NO: 3697 - DNA, 1298 bp, Oryza sativa
  unsure (1)..(1298): unsure at all n locations
cgatgcgtnnnnttgagagtgtacttatcnnnnnnnnnnnnnnnnnnnnnnnnnnnnnnnnnnntgagatattttacaatgaccccgggtgtacatatttatacccatggggagatactagtcattgtaggacaagaaagaaacttttttaaagataaaaggaaaatataaagtccttataggacactaaacacactttcctaaagataaaaggaaactaacaaattattcctaattaatagataacttgctatgccgcatcattcttgaactcggtcacttttagataaatagatcaatttccttaaccgaatatagcaggaatccgactattggcgatgcgataattctcctaggggcttaccaaatttcaccgttaatagccgcaaccgccgcatgctggagctatgcgtggagcgccaccacggtggactggtcggcaagcgccttcgcctgccacgccaccgccttcgcccttagctgcacgacacactccaactcggtgccgtgccgcgtgacattcaaggcctccggctccttctccctcattcggcgtgcctccgctcctctcctgcgcgccacccatctccttgccggcctctccaccccgcctctttcgagaaccctcccccacctttgactcctacgacgaggatgcgcggtatggagtagaaggtggaggggacgaggagctcgctcgccgctgcccctctgctccgcccatcgcccaccccgctcgtcgcttgctctggccttctccttgcaaggaaaagagaggatagagagaagcagagagtagcgaggatgacatgtgaggccacatgggcctcaccattgtttttattgttttgtgtgtgtaactaatatgtgggcccatgatttttttatttttctggatcaaattgtcacgtaagtgtcacgtcaatgctatataggatgaaaaccttgttaaaagatctatgtaggttccatattagccaagcccgggtcaatactactgagggatctcatttgcatggctttgtaagttaaggatgtgttgtatctggttttctggattgtttgcatgattttgtaattgtgttgtatccggttttccggattgaggacgaaaatgcgataaatggagggacctattgtgaacttattcggcctccaaaactagaaacccgtaacgtgccaaacgggcccaggaaaggaaggagggtatgcctttannnnnnnnnnnnnnnnnnnnnnnnnnnnnnnnnnnnnnnnnnnnnnnnnnnnnnnnnnnngaagtgcaatactattcccat

SEQ ID NO: 3698 - DNA, 754 bp, Oryza sativa
  unsure (1)..(754): unsure at all n locations
cgtgggttttggatgcnatgtnnnnnnnnnnnnnnnnnnnnnnnnnnnnnnnnnnnnnnnnnnnnnnnnnnnnnnnnnnnnnnnnnnnnntcgtagatccccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaagcaggccggcggtgaagtcgttgacgcccaacagcggcggcataataggccagccgtgtaggcagaggcaccactcggcggcgacggaggcaggccggcggtgaagtcgtagacgcccaacagcggcggcataataggccagccgtgtaggcggaagcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgcagacgcccaacagcggcggcataataggccagccgtgtaggcggaggcaccaattcgcggcgacggaggcaggccggcggtgaagtcgtagacgcccaacagcgggggcataataggccagccgtg

SEQ ID NO: 3699 - DNA, 1912 bp, Oryza sativa
  unsure (1)..(1912): unsure at all n locations
natagtttattactaccatatgacttgcaagcaaattagttcttaacatcaatancagctttctccaaaatgacatacatcttccctcccaaaataaatcacctaatcaagacatagccaggatttgaatctttttgagacggagaggatgcataccaataaagtgcaaacaaagtggagtatatatcaacctgcatccaaacgcttatatttcatacaaacagcccttcattggcaggacatcctattaggtaaataataacatcatataaggatcaggttgcatattttaaagaacctgatgaattgctacaagcctacagcagttttaaattttcaaatgacaacaaaatacatctactggacctagtttgtatgtatgttgtgctctgactgtttcgtgcctactacaatagcacaaaatggtacgctaatgtatacccttaagttctttaagaatcattgtacaaatttcttccgtgttgattggtaggaagagagaaaaaaaggaatgtatccaaggagagctggccaactcataggagaagtgagagctcatttctcctgtatcacaactcagtctcacaagcatatgtaataaccatcagcatgttttgtgcaattgtgcttattacagatttatgcattagcaagctttggaataggtattaccttcttcagaaatctgttcaaaacagcccagcattcagtgctatgaagcttctttagtcgagattgatgatgtctcaacatcttgaggacctcctgctgctcgttccattggggtttcactttgagcttatgattattatatgcaacaacacctgctattgctccagattgcagaaaagatggtgtaagagaaattaatgggctcaaacttgaacaagggtgtaagagaaaataaagttaaaccaataagagaaaaaacagtataatatacctatcaaataaccaattatatttataaaggtaagctgtgtatctgcaaagatagcagctgacagcaacaccacagtccaatccctcacaattccagtaacacgagctgtcagtgcactagttctggaaatgacaaggaagactgagggatttagggtgaaagtgcatatgcagtttaagaacaattttcaagttaattaattatgagatcaagtggtcaagatatatgcaagggctcacatagtacatcatggaaatcaagttaagcctctccctttttcttcagaaaaatctcatgaagatcagtctaagggcttctgtgacgattccacccatctggtaaaccacacagatcaagctgattgtattttcaccaacagatgccacaataaccccaatgctgatgacaggcatgatagcaagcattttacagctcgacaggcatgatagcaagcattttacagctcatttcttcaaggccaagggcagctccgaggagaaacacagctactacaatgctcaaacaaagagtacattaacatcatattttaaattaatagaaacctataacttgatcaaaaaccagagagctcacatacttatttccttcaacatctgtgcaaatgcaacagatatgtaaaggtacgcactgctccctagacagtgtgtcattgaaaacattgctccaattgcaatgaccgaactaacatatctcaaagtccaggtgaactggttgaattagatagaaatattgtagagcacctaaacatgtgctgctgggtagctacaaccaaatattgaaaatcaatcctttccaaaagagtacaagccaaatattgctgtgtgtggagattatgggtaccccatacccacacggcatggttatccgactagttataggggatannnnnnnnnnnnnnnnnnnnnnnnnnnnnnnnnnnnnnngcacatctctcaatnnggagcatcg

SEQ ID NO: 3700 - DNA, 741 bp, Oryza sativa
  unsure (1)..(741): unsure at all n locations
ggcggtttganatcaatggatnnnnnnnnnnnnnnnnnnnnnnnnnnnnnnnnnnnnnnnnnnnnnnnnnnnnnnnnnnnnnnnnnnnnnnntcgatacagcgtataacgccatcatcgggagaactgcacttgcgaagttcatggccgcatctcactacgcgtatcaagtgctcaagatgccgggaccgaagggaataatcaccattcaagggaacgcaaagctggcggtacaatgcgacaagcggagcctcgatatggtcgagcaaacgcccaacccacccgccacaactgagcctcccaagaaagtgagcaagacaaataagacgccgaaaccagacggcgccatcaagatcgttccactctccagtgccaaccccgacaagaccgtcaagatcggggcatcactaagcgaggaataggaaatcgcgctcatcaccttcctccgcgacaatgctgacgtgttcgcttggcagctgtccgacatgccgggggtccccagggaggtgattgagcacaaactcatggtgcgacccgatgccaagccagtaaagcaaaaactgcggagatttgcaccagaccgaaaacaagccatacgagaagagctcgacaaacttctcaaagctggctttatcagagaagttcttcatccagagtggctagccaatccagtcatggtgcggaaggccaacgggaaatggaggatgtgcgtcgatttcatcgacctcaacaagcgtgttcc

SEQ ID NO: 3701 - DNA, 735 bp, Oryza sativa
  unsure (1)..(735): unsure at all n locations
agcggtttganatgcnaggannnnnnnnnnnnnnnnnnnnnnnnnnnnnnnnnnnnnnnnnnnnnnnnnnnnnnnnnnnnnnnnnnnnnnnnnnnagtcgagggaggcaaggtagacttattccttactactactatagtacaatacaactatagggccatcaggttaagtcttttccaaagaaaaaggcccatcaccatcaggtaacttactcctcgtccgtccgtgtggggactcttcttcgtcctcaccaaacaaaccctagcctcttcataatcggagaaaaagaaagagaaaaccctaaggctctctcccctccggcggcgacaggacgggttctcgatcagggttgccagcgaacacgtctacggtacactcttcgatcgcctcgattctttcttccgattcttcgacgaaatcgcattgtatggccacctaatcttacctgtgtccctttctttctgtgttcttcttcttcatgggcgtcaagatggcggatgaaagcgagcggagcggtatggtaatcgacgacgtcggcggcggactgaatcttccaataattgttgcaggcaagcgtaagcgggagctcacatgggaagagaaggcgttgacagttcttgatattgtcgggtcccaacagcaccccgcatgccaacctgccgagcgtgattgcagcctcatagactcggagaaagattactcatgtgagtgtatatataatccacaactaatcgg

SEQ ID NO: 3702 - DNA, 733 bp, Oryza sativa
  unsure (1)..(733): unsure at all n locations
cgggggattgatttgaatggatnnnnnnnnnnnnnnnnnnnnnnnnnnnnnnnnnnnnnnnnnnnnnnnnnnnnnnnnnnnnnnnnnnnnnnnncaacgatgccggtggatgctggtggtgggggtggtgctcggcggtggaggcagtgggggtgtctacctcgggcggcgggggtggtggggcaccctggcggctgggacggcgtcggcgcttggtgacagcgcgcggcagcggggtggtggcgtcgctggtggctggtggcgctctgcgctcaccctggaggagggatcgatcgattcgatccagagagagatttctctctttgaatctgacaggtgggcccaagtaggggtgaaaacggtcaaggaaattcccgatcgaccgggcgccattttcgtttaaggggtaccgtttccgaccgtacctttttggctatttttaaattttggtttttctaatttctttctccatcgtattaatgtcgataccgagtagtttaaatgataaatatggtcaattaccggccgatcgagcatcgtttccaaagagatgctaccgattctgaccgtttccgatagttttcacccctaggcccaagggcaaaaatgtccataaagatatacatatggaattaagaaataagtgatacatgaaaaacagagaaagtggtaccaaataaactaattagcagtcctaatgatatattatagagggcatgcgaattaagtggta

SEQ ID NO: 3703 - DNA, 2031 bp, Oryza sativa
  unsure (1)..(2031): unsure at all n locations
ttcaagaacgcaaaataaactttggtaggtccagaaaaggttatacagactaccagacagatccatactccctactagacatcagtatcttatagattaccagtctaccagtacatataactaaataagtcttgcaggcagattttcagttaagcacgagttcaactcagctgaacaaaaaaattataatctatataccaagaaagaactgcttgagatgtaacagcttcccccatataaatcttcatactacatatcaccttaacacgcggaagtcaccgatacgctcaaacaattttctgcgctgtcgatgcttaaaggcagctgtccaaacaacattcacctgcagttcatagggaccttgctcaaggacacattcttcatcattgtgtccaagaacgagctcaaagattgagccagctccttcagaaacacagacattgagcaccagttcatcatccaaattgacggctacgaaacagcgagtcagatcgactgatccatcagctccaagaactctgttcctgccttccacttcactgtcatacaggatgattttgttctgatcatctccagtagtccaagcagtcactttgccagtgaaaaacttggatacaacccccttaattttgactgcaacagaagcttccacagctaattgaacaggactatacacaaaatcaattctactcaggcagctctctagcgataaagtcatcggctgctttgtatagcagatggcattgtgttctcgcacacctttgcagaaatctttgtcgacatcaccgtctctaatcttcaaattgaactcgaaatacattttgtctattgcacccagcgctcgattaggtcctgtcagagttagtgtgtcctcctataaatagattagggaaaatcatgtcagaaatgccaccagaaacactaggctcgataagtcaaatacagttcagacagtgccaacaatatgttaagagaaatttgggtacataatacatacagataataattttaggtctatgaagttatgaacagcctgtgaattgcatttcaaactcccatgttcaaatgagcaacatgccaatataaattcttttgtttccacttttttccagtacaaaacgtacatgatcccagagcactaccgttgcactggattaacaaaatagtataacaggtaaaagtaccaggatcttgggatatagaaactaaataagtaaatcaaatctcacaaaaaaaaggggaagtcatggattgattgatgttccaacagtaactgtcctgaccctcttagacagcaggaatggactaccaggcaatcagattcagtggatatatgatattgacagcaaggtttaagatctggcagtagggattttaatgtccaggaaacaggatttctatcgtatcaggcgtttcaccagccattatggaactatgcaaccgtccacatttcacttaacaatgtgagcctaattaacaggtcatttatagtgtagaatatcagacagcggattgaaaaggcaatggcatatggatttgaacaataaatagtattaatctagcaaggaggaggaacgaatcagtaacataccggcgaggtgatgatctggggattgttcctgtcacgcctgaacaaatagacacacctgaaatcgtactcatccctggccagcacagtgccaaataccctgatagggtaacccacatcagactcggccaccttgattgcaatcacattgacagagtccatctcccaccagtagtcggggaaagctagtgacttgataggtggtccacgtgcaagctttgctgcaaaatcaagccagagacataaatcaaaccaggaaagtaaatttttttaagacatgtacaataatcaaagaatgaacaagaaccaaggatgatattataacaaacaaatggatggatgtactcacactctttgtccaggtnnnnnnnnnnnnnnnnnnnnnnnnnnnnnnnnnnnnnnnnnnnnnnnnnnnnnnnnnnnngagactgagttcattcccg

SEQ ID NO: 3704 - DNA, 899 bp, Oryza sativa
ccgttcattgatgaccgctgctactgtccgaccccatcaatcgtcttcggcggcgggtagggcctatttggatgcatgcctgatcctaatacgaaggacgagtgtttgaaatttctaaaatcttggactcctccggcacgcaactaattcgtctgaaattatgtttttttgaatttagtcaaagtttgtttaaagttactaaaaagttgtttgaaatttccgagatctcgtaaatatgtaaaacgaaatttcaaaccctcgacggtggaatattttctgatgcaagatgacaggaaaagtgtgccacaattgttggctccatttatcaagcgacatcgaaatcacagtaccatcaatagatttattgggagaaattaccttacttgaaagttacagctttatataaggtggagtatagtggggaatattgcagggttgaatgtaattggtgaggtgatgaatataaaaaatggatgtggagattatggatacctcatatctatatgacagttatactttagtcggatatatggtaccaaatatagatagaatatttttatggggactcgggttagtttttaacttgtatgtcaaggaaatacccgggatcctagtcggttacgattgtattttatctataatcccatattccgttaggatatggactgtattttgtaaagcggattccttcccctatataaggagggtccgtgtgcctcttggggggcgggtcttttttctagtttatacaatcaataacacactcggcggaatcatccctggacaggagtagggtattacttcttgaataagaggcctgaacctgtataaaattccttgtctccaaacccaatcactttcctaacctgatagctacccccttttattattgcccaaat

SEQ ID NO: 3705 - DNA, 1659 bp, Oryza sativa
  unsure (1)..(1659): unsure at all n locations
gctgttncttgattnngtgattcgtgtnctactgcaagnacntcatcacgttcagaagtctggagaatctcttcgagattacattcgacgcttctctgagcaacgcaacaagatctccgacatcaccgacgacgtcatcatcgctgcctttactaaaggcattcgccacgaggacctagtcggcaagttcggacgcaaacctcccaagacggtcacacagatgtttgaaaaagccaatgagtatgccaaagccgaagatgctatcacggcgtccaagcagtcgggcaccacttggaagccaaagaaggatacgccgaccgcaggagggagtggaagtaacaaccacaaggatcgcaagcgtaagcccgaagaacttgtggcgaccacctctccatcttcccgacaacgttcccgcgtcaacaccttcgacaagataatgaactcccaatgtccgcatcatcccaactccaaccacgtggccaaagattgcttcgtctacaaacagttcgcggagcaatacgttaagaacgcacgtaaaccctcagacggagatcaaggcacatcaaagaagaaagatgatgaagacgatgccccgcctggttttcaagatcatcgcaaagaacttaatcacatcttcggcggacccctagcttatgagtctaagagaaaacagaagctaacagaacgggagatcaatgcggttcagcctaatacgccccaatatcttcggtggtcagagatagcaattaagttcgaccgctcagatcatcccgaccgagtggtccggtaccccctggtactagacccagtggttcgcaatgtcaagctccgacggacttttatcgacggtggcaatgcactcaacatccttttcgctaagaccctggacgatatgcagattcctcgcacggaattaaagccgagtaatgcacccttccacggtgttatcccaggattgtcagctacaccactcggccagatcactcttccagttaccttcggcactcgggagaattttcgcacagaaaatgtttgtttcgaagttgctgatttcgagacagcatatcatgctatacttggacgaccggctttagctaaatttatggccgtcccacactacacctacatgacgatgaagatgcctggtcctcgaggagtcatatcactacggagcgacatcaagcaggccctcacatgtgacaaagaaagttgcgagatggcccaaacccacgagactactcttgcccgcgaagagatccggctgactgcgaccacggcaagcgagggagaagtgcctgcaaccaagctgacgaagaccgaagaaagtgatgccaagacaaaaaagattcccttagatccctctgatcttgataagactgctgtaataggcgctgagttagattgtaaataggaaagcgcgctcatcacctttcttcagaataataaagatatttttgcgtggaaaccatccgatatgcatggtatccccagagaggtgattgagcactctttacatgttaaggaagacgccaaacccatcaagcaacgactccgccgttttgcacaggataggaaggatgcgatcaaggaggaattaaccaagctgttagcagcaggcttcattaaggaagtccttcatcctgactggctagctaaccc

SEQ ID NO: 3706 - DNA, 1788 bp, Oryza sativa
  unsure (1)..(1788): unsure at all n locations
nattcacgggccggctgcgagttactcagcttcttggactgttactcgggatatcatcagatccgactaaaagaatccgactgcttgaagacctcgtttattacaccctttggggcctactgctacatcaccatgccctttggattgaagaatgcaggagcgacctatcaacgcatgattcaaagatgcttttcaactcagatcggtcgcaatgttgaagcttatgttgatgatgtagtcgtcaagaccaagcagaaggatgacctgattgcggatttagaagaaacttttacaagcattcatgctttcaagatgaaactaaacccggaaaagtgcatcttcggagtaccgtcagggagattgctcggatttatggtttctcaaagaggcatacaggccaacccggagaaaatcaacgccatcctcaacatgaaaccgccaagctcccgaaaagacgtccaaaagctgactggttgcatggcggcgctcagccggttcgtctcacgactcggtgagcaggggatgcccttcttcaagttgctgaagaagactaacaatttccagtggggacccgaagcacagaaagcctttgaagacttcaagaaacttctcaccactccaccagttttggcctcgccacatccgcaagagccgctactgttatatgtgtcggcgacctcccaggttgtgagtacggtcctggttgtcgagcgtgaagaggaaggccatattcaaaaagtccaacgtccaatttatttcgttagcgaggttttagcccactccaagacaagatatcctcaggttcaaaagttactatatggtgtcttaattaccgtcaggaaattatctcactactttcaaagtcacccggtcacggtagtcacatcgtttccactcagggatatactttataaccgcgaagcaaacggatggatcgcgaaatgggctttagaattgatgtcttcggacatatcgttcaagccacgaacttcgatcaagtcacaagctttagctgatttccttgccgagtggaccgagtgccaagaagacatgccagaggaaaagatggaatattggactatgcattttgatgggtcgaagaggcttacaggcactggagctggggttgttttaatctccccgactggagaaagattgggctacgtattgtggatacctttttctgcgtcccatgacgtggcggaatacgaggcactactccatggattaaggattgcaatctctttaggcattcgccgattaatcgtccttggagactctcagttggttgttaatcaagtcatgaaagagtggtcatgtctagatgataatatgaccgcttatcgacaagaggtacgcaagttggaaaataaattcgatggactcgagctcacccatgttctccgacataacaatgaggcagccgacagactggccaattttggttcaaaacgggaagcagctccttcagatgtgttcgtcgaacatctttacgaaccgaccgtacccagaaaagagacagtcaaagccatggatattcaaggcgtaagcatgatcgaagctgactggagagaaccattcacaaaatttctgagcaaacaagaactccctcaagacaaaaatgaagccgagcggatttccaggcgcaacagactttacattattcatgagactgagctgtacaagaaaagtccatcaggaatactgcagcgctgtgtgtctttggaagaagggagacaagtggtgaaagatatacantctggtatttgtggaaatcatgctgctgcn

SEQ ID NO: 3707 - DNA, 6078 bp, Oryza sativa
  unsure (1)..(6078): unsure at all n locations
cgtgtggattgangtgcactgcgnnccacccgcannanntcatnacaatcacagcagataaagcctgagattttttcatcaacattgtgcatcgggttggggtacctaatcggatcatcactgataatggcactcaattcactggcggagcatttaaagacttttgtaaagacttcggcattaaaatttgttacgcctccgtggcacaccctatgagtaacggacaagtcgagcgcgctaacggcatgatactttaagggatcaaagcacgagtttttgaccgactacgtccctatgctggcaagtgggtagatcagctgccgtccgtactttggtatttacgcactactcctagtcgggctaccggccagtcgccgttctttttggtttatggcgcaaaagcaatgttgccgagtgaagtggaatttgaatcactacgatttcggaacttcaacgaggagggctatgaagagggccgagtagacaacatcaatcgactagaagaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccaggttcttatcgactcaagcgcgaagacgatactctcatcaacaattcttggaatattgaacaccttcgtcgattttacgcttaggcatttcgtttggatctttcctctttgactgctaacttcaagtttttccttgaagttttcagtcagggggctactataataataatggagtgtgatttttatcaattcaatttgcttacttgatttatcattgccctgtttggtctttcaacttagctaatgaggactgaaggtttttaatagcttttgcgggttttaggctcaataaggcttcacaaaggcttttaagaaatcagaagctaagtatggaacaccaagcatagcataaattcatcagtattgtacaaattgagcctccaccgtcattgatcatcaaaatcattgttatatcaatcagtatcagttttttcatcgttggacttatcaaacccagtcggctgaaggtcgacatcttggaatctctcaactacatcagcagcaatcttgtcagcggctttctgcgcattactgatgaggtcaagcgcagcttcttcgctcgtcctgtctgcaaagccatcaatggcatccatatcaacccttggataaagggatttggttatcaccaacgccagacttgctcccatacttccagcttctttgatgttcttgaaataagtatctggagcgactcttagcttgtcgaagatttcggtagcatcaagtgtactcgaaccggcgttattgaagaacatggcctggatgagtggagtagcggcattagcgactttatccctggctccttcaagcttgttgatcttgtcaactaagacatcaaactgtgcttgagatttgatcttgcggtctgcatcaacagattcacattaatgaatcagcatatagaagataatggctttcgaagtattgattattggtaccttcaacctcctttaaagccgaatccctctgtcttgccagctcagccttgtcattttccagagtttggatctgcttctctagttgagatatcttggcagcttgcactacattaacttcggttaatcaagattacagagataacagcgcaaatcagttgggcagagtttgcgcgaaccttttgatgagccactcagttcgaaattggactcctagagctcagcaatacgatccctcagatcgtgttcattcttcttggcaagttctctggcctcgtgcagttgactcctggtggcttcgagggttccaagatgaggactattctctctagggtcgcggttttcgcctcgttcctaagatgaatcagcgctcgagccagatggcaaacaagatggctgaggtcaggcgtcaaggaacttacatttacaatgcgagtcgcttggttgagtgcctttttcagtaggcagacctcttcgtcttctttttgccggtttattacaattccttgaggttgcaagttgtcatcccaccacttgaccagaatgggagggcacgaatcttcggttgctcgtatacgggggatttcttcttcatcaccaatcattggtcctaatgtattcactgacaaaggttagacaattgatcagagttattcaggtcaacatggtttcagacaaagtgtttacccgtattgatttctggacgaggatgagtggattcggatgcctttaaaggagatccagatctctggttattgctggcgttttgtccgcgagggctgtctgcttgggtttcgacttctggaatctcttggcttggccctgcgtccgactggtttccagtcgggggctcctgattaaatccggcttcggcttcggccgactggtttccagtcgggggttgatcaccggattctacattatcggttgccggctgattgtcactcggatgatccccagcagttggcccggtttctttggaagaacttgtgtccgtgttagtcgggtcagagtctttcccagacggatctatattagatggtttcctgcaaatttgattatcagtattattgccgcaatgggtgtgcatcaatgcaagagagatcgttatatgagttgcacctagaagacttcctgatctttggcacagggcgactggatgttttcttccttggagtagcctgttttggtagtttcttggttgtctctcggtctccaggcctcctggtggtatcatcggcttcgtcatcacttagaaccagctttctctttcgagaatctgactggccgactggatcagaagcacttggttgagtttcagaccgaattcttggtcctccgctcccttgcccagtttgatggcggggagatcggcgttgagcgattgggggatccaacttcatcaaagcaaactcctgggtgtaatatccttcattgttaactgattcaacaagaaaacaagatcatattttgagaaaggttgaagtgtatgaatacgtaccggtggaggaggattgaatgcattgaacggtacgactggcagcaagtgtgagtagctgacaacgatggcgtttgagaagatcttatacatcctttccttcatgaccttgaagtcaagagaatctggatcttcacggtttgggtcatgcttgccgtcaaattcaaaggctgtgcgagatctttctttgattggagctaaccgacacttgataaagtgccgggtgatttgttctccttaaaggccctgctctttcagctttatcatcctctccatcagttctactgcttgtgcagcttcatctcccgttggcagtgagttccaagtatcccgataaactggaggaagacaggagtactcgggaagaacaggctcggggttttgaacataaaaccagtttgcgtgccagcctttatttgaggtcttgaagggcatggagaagtatttttggcttagtgttcccctgagttggaaaccagcacccccaacgacgcatggtttgctcttatttggctggggcttgaggaagaagatgcggcggaacaaggcgaaatgaggcctaatgcccagaaaagcttcgcatgcatgaataaaattggcaatatgcactatgaagtttggattcagatgatgcaagctaatcccgtagaagttcagaatgccccggaaaaatcttgaggttggaagagaaaatccgccatagaagaaatgagcaaatactacgatttcgtgtgtatcgggggtcgggaatgcctcaccaaatgccggtcgccacccaatgatctcttttgctggaagaacaccgtgcgccaccatttccttcagattgtcttccgtcacattggagggcgcccactgactctcgaagctttctctttcttccgccatgaatgtgaactggatggtctgatttagttcgagatatggctagaaagggatggggaatcggagcgatggatgcggggagaaattttgtaaagtttttgagagtggattggagcggattgatgaaccctagtttgcccggcgcagttttacactgtagcaggaaatggggaaaatggcgagagtctcggcggggaagacaaagagacgtttttcactttggtattattagggtatcgggagtactaatgggcctgggcctgtacagtacttcagcccaatactataatcagcgtggcctgttgtgatccctaaggacttaggcactttttgctttggcaatttgtgttcacaatggtgtggcccaatgctgttaaaatcctttttaacgcgatttaataattctttgaaattattatgatgcacataaaaaggtgcccgacagaaaggtgttatatccttttttgtaagctttattaggttgcaaaagctgtttgggttgatttgagatgactggtttattaatagtcattcttttagcatgttatatgcttattttggttatggtaagggtcacagcctaagctattagactcattaattaccatgattttctatcatgtttggtgggtcattttatgagatttttacccggattcctatcaaacatgtctatttctggacctttgagtgtttatcactcggcccttcttgtattttttgtccttggtgtgttcaagttgagaagcaggtggctgggtatcttactaagtaccatgcgtgcttcgctataaaaccacttggttcttgactatatgtttagtttttcaactaatcacatagtcgggggctacacctaattaggtgcatctactcgatgcaccatgttttattttcgcccttcacagtttttgatttttagtactcggcaagctagagcaagttgaattgaagcactcggactattgttttttgtttcgagaaggttatttcgtcaactgcgaaggtctcgggggctactgtggagattatggataccccatatctgtatgacagttatactttagtcggatatatggtaccaaatatagatagaatatctttatggggactcgggttagtttttaacttgtatgtcaaggaaatacccgggatcctagtcggttacgattgtattttatctataatcccatattccgttaggatatggactatattttgtaaagcggattccttcccctatataaggagggtccgtgtgcctcttgggggccggttcttttttccagtttatacaatcaataacacactcggcggaatcatccccggacaggagtagggtattacttcttgaataagaaggcctgaacctgtataaaattccttgtctccaaacccatccactttcctaacttgatagctacccccttttattattgtcgaaatcttgtttcgacagttggcgcgccaggtaggggcagcgtcaagtttttgccgactaagtgcgatgggttccgtttctgtcaccaacgacttcgccttccctcccgggcaggcgttccggttcggcagcctcaactttatcaccaaaaactttggcaagatctctctccttgactcggattcaaaccagtcggggagagaccaggtccccatgccgttcggtattccgaactcggacaaagcctacgccaagatcatctctcccgagtcggcttcaaaccactcggacgagatccaatctatttttccacgaccagatcaagacgacgggtcctatccctcaatcctgatgaaacttcctgatgatttggccgctgtcttcacagtcaagacatctcccactcgaagatctaggcgagctccggctttagccccgatccgatctagatccagggaggttggcgttatacttcaacctcttgggacagtctcgacggaagagttggatggctacctcagctcccccggcgtcagttctcgaccaaccgagatcctcgactacgacgactttggctaccactacgaccacggtgacctcgacaacttcgacgacagctat

SEQ ID NO: 3708 - DNA, 2326 bp, Oryza sativa
  unsure (1)..(2326): unsure at all n locations
ccgtgaattgaacttcagttcncnnnnnnnnnnnnnnnnnnnnnnnnnnnnnnnnnnnnnnnnnnnnnnnnnnnnnnnnnnnatgatgaagatgcagtccttggcaagttacacctcaccaacgataccctgaatttcaataaaatggagaacacaaatggatcaaatagcttgttctaatatgcaagatggaacacataaatattttgtcaaatatcgattgttttaaaactgtagtaggaaaattcattaggacaaattttatatgtctgccactgttcatgcttatgctctaccaactgccatttcgtcgcctccaatgcttacaggctcatggaaatcgaactatgacaatttgaaggatgtaaaaaaaaaaagagaaagaaagaagaattagaatatggctagagtttctccaggctctagtagtagcattatatcagaattcagattcttcatacatgtattttttttcctaagaaaacaacaaactgaaaactatgatgttgtctcatatattctttaaaattaatttatttatttttgtgcatgggtgttggatttgcctccaattttagtaagatcaaactaacaaaaagttcagttatgcctgagaaaggaaaatactaattttagtacgatcaaacgaacaaaaaaagtcagttatgcctgagaagggaaaatactctcgtttaacatagacatcatcagatcagaacaggttatcccccagatctcagtaccttcagtttgttcttagcgcatcatcagatcagcacntacactgtgccaaaaaaatttgagctaatcccagttttctttgaacaaggttaatccctcagatctcagtacctcagttttgttcttagctcatcatcagatcagcacntacactatgccaaaaaaaaaattgagctaatcccagttttctttgctaactttatctgacaaataaaatgatctaaactcatatcacagtaataaaaagacccaacttaatatcaaactttaaatcctaaaggttttaaacctacgacattccaaattttttatcaaggttttgctaccttaataaattttactgattgaacactgaatgtctagatcgtacttcctttcgatgcatagttgaagccaatactactcaatgcaccggtagaaagtgtacattatagttaaaatgccagctcatgatagtgtataaagagatggggatttcggtgcattcacgtttgggagggaaggaaccgggatataaatttgcaatttgcagtgaataaacatgcattaattattggccccggcattaccatcaatctatccagtctgcaaggtgctctaccattgttagactctcgtagtctcgttcccgctgtcctgcacacacgcaaataacaaagaaaaaaaatcagagaatggggattagactcaaggaatggagatcagaaaggaaggaggcggcggtcaatggcggatggcgtgggcggagaaggctgcgaagacggcggcgcggtggaaaaaaaggggacggcggtcaatggcggatgaagaagcgtggttgtcgtcgacggagtgtgaggcggagtcgggcgaagacgaacatggcaagggagtcgcgtatgagatcggggcggcggccagtggcggatcggagaccgcgggatccagaggatctcaccgtggatgtttgcggtgcgacgaatggagggcacgacgaggaggcgagatggatggcgacctgacggtgatgaatcgacgtatgccggtggcctcagcggcagagcggtggctgaacggcgagacgacgatggactaaaatgggggggcggggaggacgctgtgtcggcgacacggtgggggaggacggcgatgggcgacgcggtggaggaggtcggcgatggcggcactggggttgacggcgtggtgggggagcgacggcgatggcggcgctggggtcggcggcgtggtgggggagcgacgcggtgggggagcgacggcaatggcggcgctgtatcggcgacgcggtgggggaggacggggatgggcgacggcggtggatgcgatggatgcggccgcggcggtggatgcgatggatgcgggcgctaccccccgatgcgtgaggatgagccgaggagttgggtggggaacgttgcgccgttggatttagcgatccgatggctcgtactccgcgtatctgccagggttggagtcaccgcccccgatacgaaattttaaaatagtagagatatagtaatatttttgacccaaaacaaaaaatattaaaatatatttaatgttacatttaatgaaaccagtttagcgtaat

SEQ ID NO: 3709 - DNA, 4840 bp, Oryza sativa
  unsure (1)..(4840): unsure at all n locations
natccctctaccanaatccgtcgacaggctgtaccacgagaccggcaagagaccatcgccgtcggcgcgaaggccggcaccgtcgcgtttatgatctctctggcgcggcgtcttcctcgtcgacgagctccccgtgctctgggacatcccgctgacggcgccggcgaaggggaattggaataacttcctctaccaattcgatcctactccctccgtttcatactataagactttctagtattgtccacattcatataaatgctaatgaatatgggcaatgctagaaagtcttataatatgaaacggaggaagtagctatttccgcgacgtcaccgtgtctcgaaacagacaagtatgttgagatggaaatctggtcacgaacagagccaatgaataataatcctaccccagtttcttacgtggattgggtgcgcgatctcaataaaccgaagaaattcaaagaaatcgatcgtggatggaaggctacaacatatagcatgccaatgccggtgaattgttcttcttcgtgctgctgtgatgatgattggcagattgactgtgaaatcgatgataattaaacacatcagcttaagcgacagctgtcgttctaatctgagctgcagcgacgacgacgaaaacagagagacaattgaaacaatattcaaaaaacttccaattggaaaccccaccataattaagcatggatgaagatgtgattttcttgctttctataactagccccatgaaaacggataggttggaagttgtgtttgctgttgatgtgaggaagggcatgcttcaaggattagcaaagcttgatgttcgaccgaagaacttggctatcatggtcaccttatgcaccagcgagatttgcaggtatctagcctgatgaatattattacaggtaacttaattctctacgctggtaattaactttattgtgtgtttttatgcgtgatcaatatgtgtgattatgaatgccatgcttgccaattaagatctagggaattattgtgttggtaattttctggtttcagtagggtctagagcttaattcagaagccatggcttgatgacagtgttatgccacaaaaagattgtatctgtctcgaagtacaccaatccgttacattctgtttgcccccttaattaacaatcctcttttgttggctacattgttcttaattagtgagacagtctgatgtgcagatgcacaataatgttctctcatttgaagaaaagaacaataatgcacaataatgctactttactcgcttggatccattttagttgagttgtatttactatttatgcaaacccaactttgatggtaaaatacctaaaattattatatgtacgtagtatgtgccccctccagttataaatatttaatgcagttgattttgatcataaagcttgatcatttatcatatttaaaagtttagtgtaaaaatatgcaaaaatatcatgtttaaagtacctttaacaataaaataagtcataaaaaaattagtgtactttttttaataagacaaattatcaaatttttgtggcaaagtcaactgcgttatgaccagaggaagtaccggaatttctcttaacatacagttggcattgtcttaattgtattggacttgtcgagcttggtgtttttttgtgggcatttctgacatgattttccctaatctatttacaggaggaaccattaactttgacaggacctaataatcgagtacttggtgcactatacagaatagagttacatttaaagattagagacgatggtggtgttgaccaagatttctgcgagaagccgagaacacaatgcatcagctataaatttttagtggaagtagccacaaaatgtccggaccagtatgtgaacaagtataatcgagtggcaaattgatcttctgtatctgctataaaattatgtagctctgtgatggaaagcttgaaggagctcacaattccagtcaaatttctagtaaaaaaagaaaaggaaaactaaaaaaaaagtttaaactcaaagcccactagtaaatactactaatacaactaaggcccatattgggccgcccatcacggcccacgaacagcaacctaatcctcgcgctggaagagacgagacaatacgccacgcgccgcctgagccctcgcgtcgcgacaccgctcgccgcggcggcgctgctcctctccggcgaccacgcgaggagggagaagaggaggaagaaggcgagaagggagcgagctggaagagcgggagagggggacatctaggtcgtcgacggcctcatcaatggggtggggcatgccgacgcggccaccggcgacgtcgacgccgtcgcgggtgcaggcgctgtacgagctctgcaagcgcaccttcccatcgccgtcctccgtcgccgcgtcttcctcaccgtcgtccccgccgcccgaccacgccatccgcgccatctcctctctgatgggtaggtgacctgacctgacctgacccgccgcccaatcttgtttttgttcttgtgttcagagttcggactgcaaattgattgctctttcctctgcaaaatcgttcgtatgctgatgtattgaggaattggatgtgatttttgtgttcagatacaatcactcctgtggatgttggactcagagatgataatctcgaggatggaagagggtttgggttctttgaatcaaacttcctgaagaattcagcgagggttgctagatgggcgcaacccataacctacctgcatgtctacgagtgtgacgccttctctgtatgtggatgttcaaatgttcaattgggtcatcttcttgtaacacttctgtgacagagaatactactagaagttaatgaataattggatatcttctctgctaatctgcaattgcttcgtgtttgttctgtagattggaatattctgcttaccaacatcggcggttattcctctccatgatcatccgggaatgactgtgttgagcaaattactctatggttcgatgcatgtcaaatcgtatgattgggtagagcctgctgttctagcaaatggcaagccaggttatttttcataccctgtttcaaatatttgtttttatttatctactagtatatattgcattgcagagtgatgacttaatgaactcgttgtctctgagaatacaagtgtactgaaaacatttatttcttcagatggtttctacagtaccaagttaatgaacaatattggttgtagcatagtaatagtattgatactacccaaccctattggtcactagtgttgcactgttgctcaggcatcattttagattgctcatttctatgccttgatgatttttcgggttctggtatattaaggattttttttctttctcctgatgtgcagtgaaacttggaaagttacatacggatgatgttctgaatgccccttgtccaactgctgttttgtatccccaaagtggtgggaacatgcactgcttcacttcagtaaaatcatgtgctggtcttgatgtcattgccccaccatactctgaatcttctggccgtgtttgcacctattttcacgattatccattttctagcttctgtaagtgaaatccctcactgtcatcatattacatgtttgtgtcagattcatgtttaactaaatccaccattttggtggaagcagaataccagccatctctggtatttgttcaaaacatatattattagtcacagtgctgttcagtccttttctgtcaggaacagcaatcaccttgtacattatgttcatttatatgagaagaaaatttaatttgttgatatgttgtcaaaactcaaaagtgttcatattcactattctatgtcatatctgattttctcacggatcactccaactgcagcagctggacaagcaaaagtagtccatgggccagataattatgcttggcttgaggccttaatcgtaccggtgaatattaatatgcgccctggcacgtacactggcccaactatacaggtatggcctaatttctacatattattgttgatgttgtcttctgtagcaaccaaaacgtgcttgggaggtgagagttgagagttgagactgtttctgatggaagtaatatttgtctttttttctaggaacatctgccataatcaataaaaatgggcaggacagagcgtcaaactgtgtccaagtgccatctcacaaatacagttcttgtcatgtagtgatgtaaatgtaacatgttcatctttaacttttgatttatgttgtccttcattgaaaaggtgtggctatagtggtgacatagtcaaaacagtttgtactagctactttgtatcatagttaccaatcaaattctgcattctaaattgcttctggagatattgtaaatgtatttatgttaatgtctacatttttctttctatttctatgccttcagagaggctggttggcatggtgtcaatatggtctggaattcaaatattcaacaacccttgttaagatggtagttgagattcaatcaaaatttttagattattgtgctccattttgtacctgttctttccgtatttttattgggattacaaagcaaactcaatgcagttcaagaaagagttaaagtgtgaaactgacaagctggcagctcaaaaagtactggcccaatatgtatgggctgaacatgaactacaacactgttctggcccaatatatatgggccgcatgtgagtcacattactcttccgtcgntcaagcccattaatttgggctcaacacgcaggaccttgccttttttggcttcttgcgggaagttcaaatttttgcaccacattggcgcgggcgccactata

SEQ ID NO: 3710 - DNA, 2581 bp, Oryza sativa
  unsure (1)..(2581): unsure at all n locations
caaatattcaacaaaccttgttaagatggcagttgagcttcactcacaatctgtggattatggtgctccattttgtacatgttcttttcgtatttttattgggatcacaaagcgaactcaatgcaatttaagaacgagtgaaagtgcgaaactgacaagctgggagctcgaaagtccattctgggttctggcgatagtgttgggcttgggtaggaactcatcatgggccatctataactattcgggcccaatatgtatgggctggacatgaactataatactgttttggcccaatatatatgggccgtatgtgagccacattaccattccagacggcgcagccgcgttcaggcccatagatttgggctcagcacgcaggacctggccttcttgggcttcttgcgggaagttcaaatttttgcaccacattggcgcgggcgccactacacgtgaaagctacttgaattgggacgtccacgcacgatccgacggccatcattgcatggcgtcttcagccgatggcaagacacgctcaggctggtctcagatatactagatactagtactagattagcagctactagtagctaatttttgttaaaagaaaaaaagggggaaaaaagaggcaaaacgtggtaacatggattgagcagtaaatttgcaagaccatgaagcacccatttccattaccagaaatgagaagtttacaagttcttaaccctccaaaacaagagccaagaacatccacagttcacactgccagcacttgaagaccttacaaactaaaacgagctactaacctccactacatgtgtgaagcaaaccagggccaaataataggagctagcaactcaagccatcatcaacaaaacccaccacccaactgacaacagcaagcacgcagaaaaaacacactcagattctggagacgctgagccacgaaaatataaagcctgaggaaataaagtgtaatacttcctccgtttcacaatgtaagtcattctagtatttcccacattcatattgatgttaatgaatctagacatatataccgtttcacaatgtaagtaattctagcatttcccacatttatattgatgttaatgaatctagacatatatatgattcgacagcaaattaagtcttaacatcaataacagctatatgagggagtagtttattataaacttgcaggtaggtttgaggaaataaagtggaatagtttattactactatatgatttgacagcaaattaagtcttaacatcaataacagcttactccaaaatgacatacaccctccgtcccaaaataaaccaactaaaataaatcaactaattaaaacatagctaggatttgaatctttttgggacggagaaggtacataccaataaagtggaaataaagtgggtatatatcaacctgcatccaaacgctcatacttcatacaaacagcccttcattggcagggcatcctattaggtaaataataacatcgtataagaatcaggttgcatattttgaagaacctgatgaattgctacaagcctacagcagttttaaacttcaaatgactacaaaatacatctactggatctagttggtatgtatgttgtgctctgactgtttcgtgcccacaatagcacaaaatggtacgctaatgtatacccttaagttctttaaggatcattgtacaaatttcttccgtgttgattgatatgaagagaaaaaaaggaatgtatccaaggagagctggccaactccggcccggctaaaaaaaaaaaaagagctggccaactcataggagaagtgagagctcatttctcctgtatcacaactcagtctcaagcgtatgtaataactgttagtataatccttgttctagttagttatttggtttccttagacagtaagctataggctgcagctgttactcggttgtcagactgctgctattagtggtagtagtcaatttttattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaattggtatcagagctcaggttaaagaagtgtgagagagatggagggagtaccagctgctggagccaatgcttccaggtcgccacaacaccgcggccgccatcactcgttatcgccaacaccacggcgaggacgaggtcgaggcgctgctgttcgagaggttgttgtgcaacggactgtcagggaggttggcggcgctgctgctttccccaccctcacgcgaaccaactacacccagtggtcgctgctgatgaaggtgatgctgcaagcccgtggcctttggcaccccctcgagcatggtgaatgcgatgagcaagaagacaggatggcaatggaggccatnnnnnnnnnnnnnnnnnnnnnnnnnnnnnnnnnnnnnnnnnnnnnnnnnnnnnnnnnnnnnnnnnnnnnnnnnngccatttcaaaagccacct

SEQ ID NO: 3711 - DNA, 1293 bp, Oryza sativa
  unsure (1)..(1293): unsure at all n locations
cggggnatggtgncacctnnnnnnnnnnnnnnnnnnnnnnnnnnnnnnnnnnnnnnnnnnnnnnnnnnnnnnnnnnnnnnnnnnatgacgggccgtggtgacgtctttgctgagctcgatcgaagcatcaccggcaccgtcaaatttggagacagctccatcgtagacatcaagggtgccggtaacgtcatcttcaccggcaagaatggcgagcacaaggttctcagtggcgtctactacattccgcgcctcaagagctcaatcatcagcatcggtcagcttgatgaaagcgggacgcgtgtgctggtcgaggacggcatcatgcgtatctgggaccgccgccgccgccgccgtcttcttgccaagatcaagcggggacgaagccgtctatacgtcctccgcctcgaggttgctaggccgatttgcttggctacgcgacacgatgatgttgcctggcgctggcacgagcgcttcgggcacatccacttcggctcgctagagaagatgggccgacaagagctcgtgcgtggcctgcctcgactggagcatgtcgagcagctttgcgacacgtgtgtcatcaccaagcatcggcgcgctgcctttccaaaggcagccaagtaccgcgctcaggagccgctagatctcgtccatggcgacatctgtggccctatcacgccggcaacgccaagtggccggcgttacttcttgctgctggtcgacgatgccacacgatacatgtgggtggcgctcctagcagccaagagcaatgcacctgacgccatcaagaaaattcagatggcagccgagactcactgtgggcgcaagctgtgtgtatttcgcacggacaacggcggcgagttcacgtcgcttgagttcgccacctactgcactgatgagggtatccaacgtcatttctccgcgccctacgccccacaacaaaatggcgtggtcgagcggcggaatcagacagtggtgtccatggcgcgcgcccttctcaaacagaggggaatgcctgcggagttttggggggaggctgtcagcacggctgtcttcctcctcaatcgtgcagggtccaaaagcctcactggcaagacgccgtatgaagcttggcacggcaagaagccgatggtcagcttcctacgtaccttcgggtgcctggcgtacgtgaagaagctaaacgatgtgcgcaagctcgacgaccgcagcacacccggcgtcttcattggctatgaagaaggggtgaaggcatatcgtgtcctggatccaaggacacggcgtgtacgtctcgcccgt

SEQ ID NO: 3712 - DNA, 1803 bp, Oryza sativa
  unsure (1)..(1803): unsure at all n locations
agnattaaggggagattgttagtataatccttgttctagttagttatttggtttccttagacagtaagctataggctgcagctgttactcggttgtcagactgctgctattagtggtagtagtcaattttgattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaataaccatcagcatattgtgttcaattgtgcttattacagatttatgcattagcaagcttcagaataggtattaccttcttcagaaatctgttcaaaataacacagcatttacgattgatgatgtctcaacatcttgagggcttcctctgttgactttgctatcagcaccctgctgctcgttcccatgggttttcactttgagcttatgattattatatgcaacaacacctgctattgctgcagatcgcagaaaaaatggtgtaaaagaaattaatgggcccaaatttggacaagggtgtaagataaaataaagttaaaccaataagagaaaaaacagtataatatacctatcaaataaccaattatatttataaaggtaagctgtgtatctgcaacgataagagctgacagcaacaccacagtccaatccctcacaattccagtaacacgagctgtcagtgcactagttctggaaatgacaaggaagactgtgggattttgggtgaaagtgcatatgcagtttaagaacaatgtgaatggtgggaagttctatgagactttcattcatcttgggttctctaaataaagacacacaaagtgcaggaaaacaatatgataaagttaaaatagcaaacagttttcaagttaattaattatgagatcaagtggtcaagatatatgcaagggctaacatagtacatggaaatcaagttaagcctaacacccttttttttttcagaaaaatctcatgaagatcagtctaagggcttctgtgatgactcaccccatccggtaaaccacacagacccagctgattgtattttcaccaacagatgccacaataaccccaacgctgatgacaggcacgatagcaagcatttaacagctcatttcttcaaggccaaaggcagctctgagaagaaacacagctactacaatgctcgaacaaagagtacattaacatcatattttaaattaatagaaaccagagagctcgcatacttatttccttcaacatctgcgcaaatgcaacagatatgtagaggtacgcactgctccctagacagtgtatcattgcaaacattgctccaattggaacgaccgaactaatatatcttgcaagttcaggtgtactggttagaaagaaatacatttctgggtttctgatactcattattaacaggacaagcaagcagtatgccaggagttcagcgttacatgctagttaataaacaaatagtgaaatactttttctgaaggaacaatggcattgaattagatagaaatattgtagagcacctaaacatttgcttctgggtagctacagccaaatattgaaaatcaaacctttcgaaaagagtacaagccaaatatagctgtgtttggtggatgttagttgtgttaacttcagggggaaaaaacggcaggcagttgtggtaactcaactgttcaacagtcttctgtcaatgtaaaaccttcattatctaccatgtaaaact

SEQ ID NO: 3713 - DNA, 884 bp, Oryza sativa
  unsure (1)..(884): unsure at all n locations
tccttcaacctcagaaagtttaatatagtcaggcactcggccaataggcaaacagctaacatataatttcaagaagcattttaaaagcacaaaacactaagtacataatttcttacagaagaaaaggaaatgttctgtaaaccaaaataagatgggtgagaaaaggaagatttccacgtttgcttcccagatgtggtacttagaaattcttctacagaagatgtcatggtgattaaggtagcaaagagtaggatacctcaggttgatagatgctgccattcaggttgaaacagtggaaataggaaacaggacatcaataggtctagctccaaagcccccataaggggaatcgcttagcagggtcatagcattgtagtgcatctctgtttccagtactgcctgccaaccaacaaaaaaacagtggaagtacttaaatcaatgttgtcatatgaccatcagaacacaagaactaagagattgttacaaaccatttggccgaccagtgggttcgatgtaatgcaaggaatctggaagccatgggatttccatttgaagctacagagcacaaaacatccaagatttcaaggcaacgacttcaagacagtatgcgtttatcaactagagagctgacgatgaaatagtgggagggccagcaagaactagcacacctgtgaagtctatggctaccatgaaattcaattgacacccccctaatgagagagcacaagttagcattagattttgtccttaagaaaaaaagatagaaactcgccaccgctgcgcgcgcacacctaacctgnnnnnnnnnnnnnnnnnnnnnnnnnnnnnnnnnnnnnnnnnnnnnnnnnnnnnnnnnnnnnnnnnngagnagtccacttncccct

SEQ ID NO: 3714 - DNA, 920 bp, Oryza sativa
  unsure (1)..(920): unsure at all n locations
gtggccttgtttgacgtcnnnnnnnnnnnnnnnnnnnnnnnnnnnnnnncgggccgcccggcatggaattttttgctttttttttctttttcccttcttaatgtgatgtggatgactgtgatttgtgcgatctgtgtgatttgttcgatctgtgatttgtgatgcgatctgtgatttgtgaatgatattaggagatatgtgatatgtgaactatctatgattcgtgtatctgtgattcgtgctatatgttatttgtgatttgtggtgtgatttgttatttgttatttttataatgatttggagagattgaacatgagaaagttatttgtgatttgtggtgtgatttgttatttgttatttttataatgatttggagagattgaacatgagaaaagaaaaaaaagaaaaaaaaactttagtcccggttggtgttacgaaccgggactaaagatagacatatttagtcccggattcgtaatcctggttgaaaaaccgggactacagagggttaccaactgggactacaaaccctttctccaccagtggatggacaggaggaactccacagcgccgggcgcgccctggacgcaccgccggacgggagcaaggtcggaggaactccacgcacgcgaacgggagcaaggtcgccggccgcctcactcgctttctccgtcgttctcctcgccaccccggcgcgctcgcccgccgttgctccgcccaccggccgctgaccttgatccgtcattgaagaagaagaggagaagaaagaaaagaggagaaggagaagaaaagagaagggaaggaatgtgcagctaacatgtgggcctcacgaatatttttttaattttttttttgttgactaggattccacatcagcgaaatgatgangtnctgtccaatggaaggcattcatgccacgc

SEQ ID NO: 3715 - DNA, 767 bp, Oryza sativa
  unsure (1)..(767): unsure at all n locations
atatatacttatcaacatgttctacattaaagtgcgaatttcatttgtttcatgataaatattgataagccctaagattttattttttttctttttactcctagctgaattgtaacgaaaaataatattgaaaattacttagtaattcacgcagcaaagcgcggggaatcccctagtttaaaagagaactatatgcacttgctgctcacacaggcaaaaagagctatgtttccaatataacagtttattacagttggtaggtactccagtaaccaagtactgatgctgcactgctttggcatccttggcaagacttttgatttatctctggctgtcaaattaggtcagaaccaccctgtcctagtcagaagagaatcagccaggggccataggcatcatcaagtatatgatcatgaccatgccgcttgtcactgatagtctgggttcaacagaagtaagcaatcctagtctagattggaatatttgaataagaaatacgtttggaattttagatcagtacaaaccccttgtgtgtcaggatccgggggcatgcgaatatcataaaaaaaaaagaaaacaccagaacaaactttctcaaaaagggagctaacaacttgttcataagagcttgaaatgtggcatggcgttagtcaatccaaagggcatgactatatactcaaaatgacccatgtgagtgctaaaagctgtcttctaaatatcatctgggtgcatgcgaatctggtggtaccctgacctgatatcaatcn

SEQ ID NO: 3716 - DNA, 755 bp, Oryza sativa
  unsure (1)..(755): unsure at all n locations
atggccnaagatgaactgctannnnnnnnnnnnnnnnnnnnnnnnnnnnnnnnnnnnnnnnnnnnnnnnnnnnnnnnnnnnnnnnnccattctcgcgaaccttccacacacagactatgagcttagaatttcacccaaggccccgggccgaaccggcaaaggggggcctgcgcggtctcccggtgaggagccccacgctccgtcatctggcgcgccaggtaaggggctctgcgtgtgtttttctaagctctcgcattctttcgtgtgcgccaagcttttcctgttcagcccaatggccgaacaagcaaaggcgcacaacctctctccgagagttagcggtgacgacgggcagccgaacccacgccgtcgagctcgtactccaccgcccccttcacgccaaagtcctaagcgggaggaggcgctcgagaaggtcgaaagatccgcgacttccacatccaccggtgaaggggaaaggcggctagatggggagcgtcgcctcctcgtctacggcgacggcagcacgccccaaggcgcgctccaagctgcgggcgcgctcctacgtcacccggccattgtccctgacccggagtcttcagcccaacgttggctggacgacgtggccaacttggtcatgacggcacggcagcgcctaagtgctggtgggcggtcctccgtcaccaagaacctctgcgctgctaccaccggcttcgtgtcgtcaagcaaaaggcgcggccagcggcggctgttgcttcgca

SEQ ID NO: 3717 - DNA, 2481 bp, Oryza sativa
  unsure (1)..(2481): unsure at all n locations
acgtgaaactggggcgtgtcctcattgatgggggagcagccctcaacatcctttcccccgctgcctttgacgctatcaaggccccggggatggtgctccggccgtcccaaccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtacggagtagcgcgcggaccacctcaccgccgcgtccaagcccgaggaaggcgacgagaggcttggcacctccgcccccgccgccccgaggcagcggatagtcacatgcgacgaggtcccggtcaaggaggttgccctgggcgacggcccgtccaagaccacacggatcggtggtcttctggacgttaaataggaagacgcgctcgtctctttcctgcgggcaaacgctgacgtcttcgcatggagaccggcggatatgcccggggtccccagggagctgattgagcaccgtctcgccgtgcggtcgggcgcaaggccggtccggcagggtaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcgaatgtgcatcgactacaccgaccttaacaaggtatgtcttaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgtgtgttcggtgtacctgcgggcaagcttctcgggtttttggtctctgcccgaggcatcgaggccaaccccgagaagatacgagctatagagtggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcaccctcaccctgtgccggctttggcccggagagagcanggaggagaggcccccgagccgaacggtggcccaagggccccgacgaccggagcaggccctctgcccgcttgtcagacggtgcctggtgaccccgacccccagaatggcccgagggccactgcgggaaggccgcacctatcgccctctgacccggaggctaaccctgtgccgactcgacccgaaagagagcaggagaaaaaggcccccgagccgaacggtggcctaaggcccctgacgaccggagttggccctttgccctgcttgtccgacgacgccaggagcccccgacccccaggacggccccgaggccactgtggaaagcccgcccctatcatcctccgaccccgaggtcgtcggcacagaagacgagtgcactccgcgagcccacttggacaaaaagcgccccagggatgtggcccctagcaaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgaaagggtactggacgggtggtgaaatgggcaatcgaactttctgagtttgatttgcactttgaaccacgccacgctatcaagagccaggnnnnnnnnnnnnnnnnnnnnnnnnnnnnnnnnnnnnnnngacactactcnnnaccagcg

SEQ ID NO: 3718 - DNA, 904 bp, Oryza sativa
  unsure (1)..(904): unsure at all n locations
cgtggcnnattgtaaaggannnnnnnnnnnnnnnnnnnnnnnnnnnnnnnnnnnnnnnnnnnnnnnnnnnnnnnnnnnnnnnnnnnnnnnnnnattttgctacgttaagatgcctttcggactgataacagcagggaatactttccagcgcacggtccagggcgcacttagtgaccagctcggcaacaatgtcgaggcatacgtcgacgacattgttgtcaagaccaagacaagcgactcattgattgacgatctgcgggagacattcgacaacctacgacgatatcgcctcatgcttaatccagagaagtgcacgttcggagtaccgtcgggcaaactgctcggtttcctcgtctctggcagaggaatagaagcaaatcccgagaagatcaaagcaatcgagaacatgaagtcgccacaagactcaaagaagtacaaaagctaaccggatgcatggcagcactaagcaggttcgtcgctaggatgggagaacgaggacaacccttcttcgctctgctgaagaagaaagacaaatttgtatggacacaggaagccgaagaggcattcgttgcactcaagcgctacctaacaaacccccctgtacttgttgctccccaacctaatgaagaattatttctttatattgtcaccacgccatattccgttagcaccgtcattgttgtcgagagagagaaaatacaacgaccagtctactacgtcagcgaagctctccatgacgcaaagacaagatatccgcagattcaaaagctgctctatgcagtaatcatgacatcaagaaagctacaccactactttcaagcccacagagtcacagttgtctcctnnnnnnnnnnnnnnnnnnnnnnnnnnnnnnnnnnnnnnnncgatttccatgggcgcagcg

SEQ ID NO: 3719 - DNA, 1538 bp, Oryza sativa
  unsure (1)..(1538): unsure at all n locations
cctgtgcaaagataggctactgcacctanccnnnnnnnnnnnnnnnnnnnnnnnnnnnnnnnnnnnnnnnnnnnnnnnnnnnnnnnnnnnattcaggacatgatacgcattcaaaactgcctcaccccaccattccttggaaagccctgcagtgtctaacatagcattcaccccatctcagttagagtacggttatttctttcggccaccccatttgattggggtgaatagggaggcgtcctctcatgaataattccaaactcttcgcaaaaggatgcaaactcattggaaaaatactccccacctctatcagacctcaaccgtttgattttcctttcaagttggttttctacctcagctttatagattttaaagtaatacaatgcctcatcctttgttttcaatagatacacatagcaaaatctagtgcaattatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacgcaagtatggcacttggaacctttgaccaaagtgaattttggaattaaactcaggttagctaagcgcgtcatacaaccgaaattcacatgacagagtcgcgaatgccacacattagactaatcattctcgctaatatggttcacagcattatgattattacacatgtcattcaaagaaaagcggaacaagcctccgctatcataacattttccaacaaaagtcccatatttaggtacgacacatttattggacttaaacacaagtctaaaaccttctctacacaatagagagccgctaactagattcttctttattgaagggacatgctgcacgttcttcagctgcacggtctttcccgaagtaaactttagatcgaccataccaacaccatgaacagccgcaagcgacccgtttcccatcaacaaggaggaacctctcccgacctggtaagaagaaaacagagaaatgtcagcacatacatgaatattagcaccagtgtccacccaccaatcaggtgaatgaaaaacagagagaactgtagataatattttaccgtaccccgatgttcctccgccctcgctaatgaccatgttggcagactttctgtctttgcgctcaggacagtccttggcccaatgcccagacttgtcacacacaaagcagtctacctttgcctttcccttgtctttcttcttaaaattggttgtagccttggatttgacatcaggcttaactttcttgttatcgtgggatgcatgagggttcttcttctgtaccatattggcactagaacctccctcaacctttttgccccggacgtcctttgccctcgccttctcctcaacacccaaagagccaatgagatcagaaacactgaactcttgtctcttgtgctttagagaagtggcaaagtccgaccaagaaggtggtagtttggcaataaatgccacccgcacaat

SEQ ID NO: 3720 - DNA, 1096 bp, Oryza sativa
  unsure (1)..(1096): unsure at all n locations
cgcgtggcaagttcggctnnnnnnnnnnnnnnnnnnnnnnnnnnnnnnnnnnnnnnnnnnnnnnnnnnnnnnnnnnnnnnnnnnaatcttgtgtgttctaattgtcgatgcattaaggatttagatcccatcctaaaattttatacaatgtcacatcgaatgtttaaacacctgtataaagtattaaaataactagttgcacaaattgtgactaatttgtgagacaaatattttaagcctaattgctacattgtcacggttatggataccacatacctaatagcagttgactagatcttggcaggacccaccacataccatgtcttgtatggacattgacctcagatatggatgaagttccggataagaaaagacaaccagagttctacatggaaacgataaggactacttagattgtatccatattggtctccctagttctacttggacaaggggacacatatgggtataaatacaagaccccctagaaggagaggggagacggacaatatagacgccacaaagccacaagccaatacaagccaacatacgccaagacaagtcgccggatatcgacatcagagatatgcctggattgaccctatccggtacctacagaggccggccatagggatctagtgctatctctgatctcgtcgggcactgattcgaggaggaagactaccctgttgtcgactacgtgatgatactccagtcccgctatgtcgacaacagttagataggctaccccaaatattgtactggtgtgattatggtgaataagagcaataccggcttcggtcaacgggatgtagggttattacctgacaatttaggggccagaacttgtataaaaatcactgtctccatctcttttacctcagtcttgcgtatatcctagtaccaacgatccctataccatgcaaataccggaatcgcgacatcaaacgtccccatacataatttaataatgtggtgctacagtaaacatttgctaatggcgtgttaattaggcttaataaattggtatcgcggtttannnnnnnnnnnnnnnnnnnnnnnnnnnnnnnnnnnnnngctctcttcntgtcgcgcg

SEQ ID NO: 3721 - DNA, 770 bp, Oryza sativa
  unsure (1)..(770): unsure at all n locations
cggctctggtaagaaagagtgtttgaggctctcttcctgatggaatgggcgaaggcgtgcgtaaaccccctgtcgccacctaccccaggatctgatcggtctgtgactggtcacagcccggataaccaggcgcgttgcatggcgttacatgcggcgtgacgcgctcgtccaaaccgcaataaatgtggttaggtgagccctgctatgctcacctaccccgtatacgcggcgcaaaacccacaaggggtcggggcgcctcggccctcgaggccgagacgggagcggtccgacccctcggggagacaaagagaagggcggccgtatcaccctcgggcccgacccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcccgagatgttccatctcgactgccacagccgcatatccacctcatgcaccgcaaacgggcgaatgggattagtggaagcgtgggcgcgagaaacgagggggcaagatnnnnnnnnnnnnnnnnnnnnnnnnnnnnnnnnnnnnngacccaatctnnacgcatct

SEQ ID NO: 3722 - DNA, 6443 bp, Oryza sativa
  unsure (1)..(6443): unsure at all n locations
gggggtacctcccaattatactccctcgggggtgtaaaggttccgacaaaaacccttaaggatcccaggtaccctttgcaaggaataaattgggttcataaaatttggaacccaagcattttgttttccttcacaaggtgcaccgaaagatgttccattatgtcaaagaaagttggaggaaagtacatctcaagatgacatagggttctcacaagttctgcctgtagtttatctagtccctcgggatcaatgatcttctggccgattgcatggaagaaggaacacaaccgctggatcgggtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacccgggttaagcagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgttttttccttcgatgtgctcttctcttttcgctttcgaactttcctcttttttccaaattcgttggttattcccatcactaagttgtgcacctctgtccctgttagctctgtcgggggtccggctgtatctctgtgtccattgaaattctttctcatattcctatacgggtgataccttgtcagaaatctcctgtgacccatgtagaccgtcttgtgtgaatgcttcaaccatttgcttcttggttccttcatacactccgaacacgcccattttcctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaatacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccgaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggtagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacatatcctttaacagctcaaggagttctgtaaaactcttgtccgaccagccattaatagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacaccctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaggaaaaataaatgatgatcgatatgttgagaatgaatggagaataatgtgttttttaccttgaattttagtaaaaaatcgccccccttgccctcccaaccgatttgtgaacagtacaatggtcgggatggaaagcagttggcagtttgggggtatttatagacccaacacacctcaaacgggttagataaaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacctgtgacgggccgcggccagatgcctcaccggtgacggcatcccgtataacccgtcaaaggtaatggtcaatactgaccaattcgtttgcccgtcacaggtatcccgtcagaggtgtgaggatctggcgtagtggcagcacccaaggatcaaacatccatatacacatttccaaatactgaaataccgggggcaattgcatcctcctagtttttatttatttgactgctccacgccgggcattgctgccgtcttccctttcctgctgatccgtaattctctgcatcaagaagagttagctatcatatactaatatatatacttttgaaactggctactgacaaatgtcgctggttaaaaaaaaagtttgaaaagtgcaagatatatgcacttatatggctgttgttcaagtatttccaattcagtttattgaatgacattttctataaaagtatagtaactgtgcactgctttgctgtcgcacttgcttgagagagagagtcacctcacagacattaattcaggctgttctgaaaacaaattattgggaacgtctatatgcggcagttttcaggaggtatcgatctatttcctgtaaaaacaaaaataatccagtgatctataaaaaaattaattaatttctttaaaaataacaagaggctcacaaaagcctgccgtgcagtatgcatatatgggaacgatgcttttgtaagcattgcttttctattaatttttatatgtggctgctgcatatatatcctatgcagtcaagcacatcctattcctctctttctcaaattaaacattcaaaagattttttttatctgtggcatcaaattaaatatatgcaaggttattcgacttggcttcagtaagttatgtaatgaagcaatgcaacctgtttcaagtgatgtgtcgatctactgatccaaatctacttggtactcattgtaccattcatgagtatccctacacttttctcctctaccggctatgttctgcggtgagactggctaactaagatatcaacggagtaattccagactcattcatgagttaacatcaaatacaaagctaagccttgcaattgagcaagccaggcagtgtcgctcatgcgctgcttgcatgcctttgaagaagaaatctgattgaaaatagtcgaggctgcaaaaactcttctcagataccaaaatattaatcaaaggactactatgcgtgtgagttcttttcacatgattctcattacttttaagagagatattcgttatatctcttgtttatttatcatacggttcgggtcatctctcctgatgcttgaacattggcctaaaaaaatgtgagctgcacatgccagttacatagaaagtttccaaatgtgactatgcaataaaaaaacattttaaattcagcaccggtcaccctagtgagggaacaaacacttcagatctttgtttatttatatgttctcctagtttgctgaacaacatgctgtttcgtcaaacgattatcttcaacgctgtcaaacctcaagttgaggtgacaaatccagaggccgtcgaatgccaggggcatatcaacatttaataccggttcgctctaataatattttcttggacagccctgatgtcctatagaaatatacatatagaggttgggactacctctattattgttaatcatactccatgagacagcaggggtcttgtttctcatgtgtaagcccttgggctaatgcgtcaaaatttctcaaaccaagatgagagcttgctaatctaagcaataagactcaattaactaaccaacatgatgatagtcaccaaaataaatcatcaagtgttccaccacaagcaagcgcagggggcaattttttgacccctcaatgataaattccgaagctgattccataggctcgattgccttcagtgagcctacaaaacaatgccaattgacaacttgagctcgacagcggcaaacacgatgtcaacgtgtgttttaaatctgcaagagatttgttccaaaatttattgtgcaacaaattcaatcccttgaagcaccactctgcaaatccagatgcataatttcctacacaacatctctgccattgctgagcttgagttgaatagatcacttatcacggactatgcaggaacaccgatcaacagctctaagttagagtgctatgcaaaatggctggggcagtaaattagatgtgcattgcttccactatgtctcctcatatgacattggtgataaaatgttatgagggtgactaaaatatcttcaaaatattatattctccaatgacgagttattctacttgatgtagttctactctcgctttcacacgtttgcagcgagtgtcccacatggccaaggtggtcaacactgggagtaacattgtcttgatccaatatcaaataaacgatattttttccctcctctatctttcaataccttaccaccatgcatggtgttaaccgaactatgtgtggtactaccaagtatcatgcccaacgcttatctatcaaagatttagccatttaaatactatggttagcctaattatgttggctaccttccctttctgttctctccctctctttcaatggaatcctagtcgattaccaagagtagaacaatgccaattcaaacacatattggagttgaaatctcaccatgagattcctcattggaataaatgaaaaatgttattttaatatgtatgtgcaaacatctccccctgttatctttaaagagtacattcctctctaaaaacaatctccttcatggatcatagagtccaaataaaaaggaagcattacctttggtgggttgtcactagtggatgtgtacctagtacagactatgctccacctgattgatctcgcgatgaagcgaagtcaacacttagcacttggctcacaccaacaatgaatgaagagggcggttgaatcttgatccaagttaaaccctgatgtggtgggtttttatcatgtctttcgcttttgcccaggttaagggggcaagcttctggggaaatctataggaaaaagagcttgaaagggctacctattctgtcaaaagtcaagttctagtgtggagccacatgccaccccatgaagtattaacaagggcaaataaaaaaaaagaagaaaatactaaatgccagtgaggaattcttagtttacactaaaggtgtggtgactactttccaagttctaaagggggagagtgatcaagccgatgaaatgtatgatcaaaatatgtgtgcaaaaaaaaacaatctggaagaaagagaagaagagaaaaaaataaaggaaggctcttgaatcaatgggtcactcttccctgatctgaaggcggaatgtagtcacttcccatcctcagcaaaagtaatggcacaatttccaaagcctatcacccataaaccatctcaatgattagccatatcccatacccctactgggacaaaggtggaagacatgaggcacataactgaagggaggcttggagagagttcttcggcccatgatganctnctgtncctagtngtnggtcatnnancaanctcatcacat

SEQ ID NO: 3723 - DNA, 2829 bp, Oryza sativa
  unsure (1)..(2829): unsure at all n locations
ngcgcgggnngaataggtgacnnnnnnnnnnnnnnnnnnnnnnnnnnnnnnnnnnnnnnaaccaaatgttggttcggattatcttgctagcttgggtaatgatgcaacaatcattatagccgaaccaagcaacggttcggagtgtgttactagtttagacaatgatggaatagccgaaccaagtgatgattcggattgtgttgctagcttagagaataatgccattgaagatatagccgaactaaatgacggtttggattgtatcacaagcgaaagtgaaatagcattgtcacctaagaccgagtcacaaatcggtcgtgtggatgttgaaaagatgatgacaatgtcttgcggaatagtagtgaaatagaatccaaagtagccatgcatacatatcaaaggccgtatcctgaacacgtagattcggtcccatacccgcaaggatttgaggtgcccaacttcacgaaattcacaggtgagaatgctatgactacaatagagcatatcggccgctttattgatcaatgtggtaaggccggtagtgatgatttgcttaagttgaagttgtttcccctttctttgtcaaactttgcatctacatggtatagtttgcttgctcctagttcaatttctacatggtcacaaatggagcatgagtttcatggttatttcaaagatgcaagcttgatggagcaaagaccgattaatacttcatcggtcacttgtgaaactatttcgggtacacctatgctaagaccggaattgttaggaattctctccctattaatcctattgatgttgataaaaagaaagggaaaaatggtattggtaaggatcctcgggccaagacacttaggatcaataatgcgaaagccgaaaatcataaagttgcaaaggatgagtcatctagtatccaaaggaccaaaaagccgaagctcacttttgatatgcttatggctaaatacaagaaaggattagccggtcaatgatttgacaaccaaactagtgattcgaaaagaccaagatcatctcgtaggaagagatttggtcaaacatcaaagcaatcggagccatcaaccataccaactccatataaacctccaattgtgatgccatggtatccatatccaatgtcactatatgggtatccttttatgtattacatgccatggatgcctcaattctctacgccgtttcatcaaggatgggaggaatcacctaaggcagtaccaagtcattctaactcaagacaagaccgtttccacaaaagaatcggtccggtggatcaaaggtgaaaaaggcgaagaaggtgtgggtgaggaaggaagccaaagctccggaggtcgttgctatcaaagaggagtctcaagatgttcatgtacctactggagatgcgatggaaattacgcaagcaaaggagatcgaagccgacgccgtgactgtcaacattggtggtctaaccgagatagctggcgggtctaaccgcaagactatggccggtctgaccaaccctcctggccggtttgaccgacggcttgtggccggtctgacgggacctagaggccggtctgacggaggggcattagagaagagtgagaaaattgagagcaacacagnaggttccacttcgaccaaaaatatgaagaatcatcatttggctcctggaaaacaaccacagccgaagtggataccttccggcttatctcgctctcaaaacaggaggcttcagcgtcttcgggccatgggtaaaaaagaaaaggagaccaaagatgtggagaacaaaacatgtaacaatttagatcctcgaacgacatctaggcaagtgtggagacccaaagaggtaaaagttaagagaccggtgatttcccatagtagagataaatccaatttgatgagagaagaatcatcggtcattagagataagtctccttcgcatgatgctatggatgttggtgcggtgttcatcttgccttcgaaatcgtgcagtcgagaaagccgattttgcttgaggggcaagacattaatatgctcatgaagaaatcaagagaagatgaacggcgatggatacaacatcacatctttgagccgccgttcgtcggatgctaaggcaaggtatgggtttattgtgtttaccattatatgcctatgccatgttaaaacattgcttgtgtcagggttacgggttaggtataccccttacccttcgatatgcaccacatatcgacatggcatacccgcgcatacacgggcattatctgcatatactaaggaaatcttccacagtgtttaagtcctactcggacaagacagggtcgtcaatatatcgtgtagggtccgatgtctccgagttcgacttggagaccacttgatttgcgatataaaagggatcccctgggaggacctaaaggatggaatctgatagccaacacaacccccacagcctacgaagtcggagcctgcaggagccaaatcgccggggatctagtcgaatcaacttaattacgatctcgccgcttcatcgagttccattgttccctttgtaacatgtggttttccatcatataatcccatattcaactggattaggactattacctatcaaggggcctgacccagaataatttttgtcttttattgcttgatgtcaaactacgtagatccttgtaccaacttaccacaataccctatatattcggtctactggtatgacccgtcgacagtggcgcgccatgtaagggggcttggtgctcaaggntttactactatttcatccagctttgttgacaacagcgtaaacaccaaccttaaccactggttttctgctttaaa

SEQ ID NO: 3724 - DNA, 1658 bp, Oryza sativa
  unsure (1)..(1658): unsure at all n locations
ccgtgcaaagtaggccgcttccnnnnnnnnnnnnnnnnnnnnnnnnnnnnnnnnnnnnnnnnnnnnnnnnnnnnnnnnnnncttgtctttccgacaagaaccacgagccgacgagaacagcttccgaagcgacaagggcctggtgtcctatccacaaaaccaggaaacatactttgcaagcctgctgggtcttcctcaatgcccacgccgaaattcgcgcctgtagagagcgtggaattcagcgcgtttctccaactcgtgatgtctattgtcctattcacaagacaaagaatcacgacctctcaagctgcaaggtttttctcagcgccataaagatgtcatctcctaaggtccagccatcaagcgtatcccttagagaggaagacaagagacagggaacgacgctgacctcagatcgattcgttggtgcgattgacatcgactcccacgaaccatcagttctacatctactcaaggactatggctcgtcatcaacgagtacaccatgcgaggtattggctatcgatgggaccagcacgtcagcacgcgctaatgccgaggcggagaatcaagtagttacaccggctcagcgcatcagtacccttaacacaatactgagggaggcaccttacgatcccgttctgaacgacgatcttgcgtggtggcaggaacggctacgagaatcagtaaccaacctcagccacacgttcgaaggggctgctgctgatgcacacccggaacagccaccaactggcggcgtcgatggcgaaaaccccgaacagcgggagtcaccctaccgagcaaccccttcaccccgcggcactggcgacctccgcgatcacctgaacggccgccgagaagcacgtcgcacacagggcaacgggagccgctctcgacatcacatcccttcacggcatcacgataatgaagaacgaggaggccgctcgaacgaagaccgagaccgtgatgatcgcgacaatcgtgagcggcgggcgccgggcaataccagtcgaggacgccgccataatggcgaagacgacagagatcggccccgggacaacgacggagggcgacgatgggattctcgagaacccggccgatgtcctcgtaatcctacaccagaaccaagcgattcttcgtcatcgtcatcctcttcttcatcctcatcgtcagatagacatccacgaaggacacacgatcgccgacaacccactgcccccagcgctgggtgtagagctttcggtcgttccctgcgtgatgtccgatggcctgagagattccgacccggaacaatagagaagtacgatgggagtactaacccagaagaatttcttcaagtctactccatagtactttacgctgccggagcagatgacaacgcattggcaaattatttgccgactgcgttaaaaggctctgcacgttcatggctgatgcatctaccgccctactcgatttcttcatgggcagacctgtggcagcaattcgtcgccaacttccaaggaacttacaagcgccatgcgatcgaagacgacctacatgcgttgacacagaactcgggtgaatccttgagggaatatgttcggcgcttcaacgagtgcagaaatacaatccccaagatcaccgacgcttctgtaattngcgccttcaagtctggn

SEQ ID NO: 3725 - DNA, 1057 bp, Oryza sativa
  unsure (1)..(1057): unsure at all n locations
actcagcatatccagactctgacctccacgtttcacacatcttcggaggctccacatcgtactcttcatagcgagaatacaagaaagtggaacgtgaagtctgttcgacatggcagggggctgcacctaatatgaagtggtctgaacagaagatagaattttcggaagaagagcatcccaagactgccgttatcccaggacgctatccgatcgtggtcgagcccactattcggaacatcaaggtcgcgcgggttctcattgacggtggcagctcaatcaaccttctcttcgccagcactttggatgcgatgggggtcccacgaagcgagttgacgcctaccaatcaacccttccatggaattactccccagtcctcgtccaaaccattgggcaaaattacgttgcctgtgactttcggccaagcaaacaacttccgaaaggagcagatcacctttgatgtcgctgaattcgatacagcgtataacgccatcatcgggagaactgcacttgcgaagttcatggccgcatctcactacgcgtatcaagtgctcaagatgccgggaccgaagggaataatcaccattcaagggaacgcaaagctggcggtacaatgcgacaagcggagcctcgatatggtcgagcaaacgcccaacccacccgccacaactgagcctcccaagaaagtgagcaagacaaataagacgccgaaaccagacggcgccatcaagatcgttccactctccagtgccaaccccgacaagaccgtcaagatcggggcatcactaagcgaggaataggaaatcgcgctcatcaccttcctccgcgacaatgctgacgtgttcgcttggcagctgtccgacatgccgggggtccccagggaggtgattgagcacaaactcatggtgcgacccgatgccaagccagtaaagcaaaaactgcggagatttgcaccagaccgaaaannnnnnnnnnnnnnnnnnnnnnnnnnnnnnnnnnnnnnnnnnnnnnnnnnnnnnnnnnnnnnnnnnnnnnnnatccatngaanttcaatcccgcg

SEQ ID NO: 3726 - DNA, 2599 bp, Oryza sativa
  unsure (1)..(2599): unsure at all n locations
ctgtgcaaataagaaccgncttctannnnnnnnnnnnnnnnnnnnnnnnnnnnnnnnnnnnnnnnnnnnnnnnnnnnnnnnnnnnntctcggtgaagtcgtgagaaacaaagacgttgtcggccgcattgcgaaatggggggtggagctaagctagtgggatgtccactttgtgccacgaacaaccatcaagtcccaaatactcgccgacttcgtagctgattggactatgcccgacaacaaatcagacaaccaaatcgacaacgaaacgtggacaatggcgttcgatggtgcactcaacagccaaggagcaggggcaggattcatcttgacatctccttctggagatcaattcaagcacgcaatccacctcaacttcagggcaaccaacaacacggccgagtaagaaggactactcgccaggataagagccgcaaccgcatttggggtcaaacgactgatcgtgaaaggggactccgaactagtcgcgaaccaggtacacaaagattataaatgctccaaccccgagttatccaagtatctcgcagaagttaggaagcaggagaaaaggttcgatgggatcaaagtccgacacgtataccgcaaagaaaacgtcgagccagacgagctagcacgacgcacgttcagacgagaaccactcgaacccggcacttttctggacatcctggcaaagccatcggtaaaagaggtcagcggcgaagttaacccagacacccccgacatcagctgggaggccacagaagcagaccgccgccgtgccgatatcaaaaccacagacgactggcgcaccccacttgatcaaattcatcaacagcgacgagttgctcgaggacgatgcagaggccaagaaaataacccgtaaagcaaaaatctatggcacgatcggcaatgatctatacaagaaagcgccaaacggggtacttctcaaatgagttccgtccgacgacggcagacacctcctccacgatatacacgaaggcatctgtgggtcacacgccgtcggtcggacgttggtcgggaaagcttttcgacaaggattcttttggccaacctccctcaaagatgcatgcgacatggtccagcggtgcgaagcctgtcaatttcacagtaagcacacaaagctacccgcgcaagcgctccagactatccctctcacttggccgttctggtgctaggggctagatatactcgggcctttcccatgaggacagggcggctataggttcctattcgtggcgatagacaaattcacaaaatggatcgaggcgatgcccacgggagaaatcaaggccgacaacgccatcaaatttatcaaagggatattttgcagatacggactaccacatcgcatcatcactgacaacggctcccagttcatcagcgccgatttccaagattattacatcaggctgggagtcaagatatgcttcgcttcagtctctcatcctcaaagcaacgggcaagtcgagagggcaaatggcatagtgctacaagggatcaagacccgtgtctacgacaggctcatgtcacacgacaagaaatgggtcgaagaactcccatcagtactatgggccgtacgcaccacaccgacaacgtctaacaaggaaacaccctttttcctcatgtacggctctgaggccatgctccccagtgagctacgacatcaaagtacatgagtacagaagtactccgacgaggatcaggaggaacagcgaaacgacgatgtgaatctactcgaggaacatcgcgaacgagttgccgtccgagcagccggttaccaacaggccctccaccgttatcacgagaagcgcatccgagcacgcatactttcgacgggttcaaagccaagcagggcgaaacaagctctcacccaaatgggaaggaccttacatgatcacgcaagtcttgcggccaggcgcattcaagatagcagatggcgacggccgcgagttggcaaattcttggaacattgaccaactacgtaaattctacgtataggtcaatatcatccatacctgtaagacaccttacagtatcaataaagcctatgttcgggcacatattacaattacagtgttcatgcctgatgatcccttacccagatgatacctagcgttgaaacctatccttatgtccctttacaccgtcctgacaaggcctccgaggaacctaagggatcctcggctggggacgcccagagccgataaggtcttgtcggatcctgtagagacgaaagaccatgtaagacctggtcgtgtaagagttctcgccgtgcgtattaaccaagccgtgtaatcggaaaattaactttccaacttcacggctgggggctaggatcagtgctttctcaaccaaggcaggtcaaaggtctaagagccttgtcccccgagaagtatcctccgacgacaaggctgggggctagggagagtgtacgactcaaacgactgaccaaagtcgtgaactgaggaaacactcttacacactatatccagagtaagaaagattcaccaagatagatttcttccctacttcgcanaatacttcttacaattatatacaaatccagaactttattacan

SEQ ID NO: 3727 - DNA, 2020 bp, Oryza sativa
  unsure (1)..(2020): unsure at all n locations
cgtgcgctatgagttgttgatcnnnnnnnnnnnnnnnnnnnnnnnnnnnnnnnnnnnctacttcgcaaaatacttcttacaattatatacaaatccagaactttattacattctttccctaagatatctgtcacagggtacgaatactaccaagaaggccaacgccagtccatagactggaaaaccttctccgctaacggggccatcgacttcgccaggtggtctatctccgcaggagtcctctgagaatgagtgaatccttcatggagaaactcgaggtgcagttgcggacgatgatctcgtacacaagccaatacatgccctcctgcatatcggctcgatcggcggcattcctgtttcagagcctcgtcaatccgcttgccaacgccctcaagctgagtacaagccccattcaaccacgggatatatccggctgctgactcctcgggatccccgcgaggtactcggagctctctgcaaacttgggccatggacgtgcagcaactcttcaggtatgagttgaaccacacctcacgacctcaaagtgtttccacggcctgctccttctttacttccaacatggctctctcgagttccaccacttcaaatttcgtcttccaatattggatacgacgatctcggtcagcaagtgcgttctcgaggtctgttcgacatggaaacgactacgttaggctgctcttctctctcgagaacacggttgatcaagtcggaggagcgaaaaggatgaaaaggccaccaaccaaaggaagtcgtcgccgtccccgctctcccgggtacaatgtcattcacatcgtccagcaacgcgtgtccctcaaacgcaagaatcggagggatcactggcgactcaggttgcccgcgctgctggacaccctcgtcatcagcatctctacaaaggacaaaaattcccgaggtcaacatacaagggcaaactagaatgataattgcacgtattctgaggcggtccaatttcaagttttacacagcatgtcttggaagtacaagaagacctactcttcaaatagggggagaacagattccccagatcaccgacttcttccatcacctccttacgcgtggtactagccgccccctgatccaagatctcgcgcagatcgagttcaggacgcgatagctttacgcacgcaaggacataacacgccccagtgtagatcccgttcgatgtctcctctgcgaccctggccgcatgcttggaggggatctccgtcatcgccgtcaatagtaccgcaagggaggaggtcagcgaaaattcgtcaggattcaccgggatggtagacttgatgccgcactccccggcaagctggtgcaggccagtgtaggtgacccgcaacgagccctgaatttccgacaggttgtgcccgagttccgacatgcggttctcgagcccctaccgttgtcgctcgttgccggccaccagttccctcatcttcgtgaggtcttcatgagcttccgccaactcgcgcaccaaccggtcagcacgcgcgttcgccaacgccgcttctgaccttgcctctgcaacctcgtggccaatgctgcgggcaccagcttctaggaggcgccccatttcgacttggagctcctcccaggcgaggatagcagtgggcggaccacgacctgccgcgggatcgctgactgggccactaggcgtcacctcccggctcccagctgcgagtacgacatccgtcgaggccgcggtaggcgaggcgctggaagcccctcctgacttgctctgcgcggcctttgcccacgcttccctatgggacgaccacggatcatacaacgcttgaacagaatcatgggaacttaaaaacccaactacttacttctcgccgatcgtcacaagacgttgtcgtcgcggaggcgggggagatgcgtccaaagcctgaaagacaannnnnnnnnnnnnnnnnnnnnnnnnnnnnnnnnnnnnnnnnnnnnnnnnnnnnnnnnnnnnnnnnnnnggaagagcatntcatccccg

SEQ ID NO: 3728 - DNA, 1051 bp, Oryza sativa
  unsure (1)..(1051): unsure at all n locations
ccctttagcttttgatatgcgccacatattgacatgggataccggcgcatacatggacattatctgaatatactaaggaaatcttccacagtgtttaagtcctactcggacaagaaagggtcgtcaatatatcgtgtagggtcagatgtctccaagttcgatttgagaccacctgatttgcgatataaaggggaccccgtgggaggacctaaaggatggaatctgatagccaacacaacccccacagcttaagaagtgggagcttgcaggagccaaatcgccggggatctagtggaatcaacttaattaggatttcgccggtttcatcgagttccattgttccttttgtaacctgtggttttccatcatataatcccatatcaataaaattagggttattacctatcaaggggcttgacccagtataatttttgtctttaattgcttgatgtcgtactacgtagatccttgtacaaacgtaccccaataccctctatatccggtctacgggtatcaccggtcgacagcttgatatttagcacatgtgtgttttgcttatcaaatccatattatacatacatgttgaaaatgccagttctaagtggtggaattggtaggttggcatataatatgtttgaagtatgatttggctcatcagtctttaatatttatttaaagccaaatcgtatgtgtttttatgggtcaccatataagatatagatttattgcaccatgaaagttttgcttattagtaattcggctaatatcaatggtcaatgtgatgatttgttttagagttattttatttaggaacattggcattgttaatattttgcatacacgctcaagccaattacttacatttgtagtttattggaatctatgcatgtgacacatatgactttggccattcattattgattatacttcaattggctaagtgttttgatgccatgatgattattgttttaaaagccatttgaattagtnnnnnnnnnnnnnnnnnnnnnnnnnnnnnnnnnnnnnnnnnnnnnnnnacaannccccatct

SEQ ID NO: 3729 - DNA, 743 bp, Oryza sativa
  unsure (1)..(743): unsure at all n locations
cgatggtcngattaggtgtcnnnnnnnnnnnnnnnnnnnnnnnnnnnnnnnnnnnnaattgctcttgtcgatggcccggtgatcacaaggtcatctacatagaccccgacgagtagagcagagccaccattgtttcgtcggtacatggcgtgctcatgcttgctttggtcgaaaccgagctccttcagagtacaatcaagcttcgcattccaggctcttggcgcctgccgcaggccataaagagccttgcgcaggcggaggaccttgtcttcttctccggcgacgacaaaaccagggggctgcttcacatacacctcctctgccaaatctccattgagaaaggcagacttcacgtccatgtgatggacgtgccaccctttttgggcggcgaccgcaagcaggagacgaattgactccatgcgcgcgacgggcgcaaacacctcgtcaaaatcaatcccaggttgctggacaaatcccctggcgacgagacgagctttgtgcttgaccacctttccggcctcgttcttcttcaatttatagacccatttgagtccaattgggcgatggccatgtgggagatcaacaagctcccaaatcccattgcgattcaccgcgtccatctcttcacgcatggctgctcgccatgcatcatcaccctccggctctgcaaacgagcatgggctcacaggtccagcgagggagcaagacgcctnctcgantncccgtttggcatccttggtgcg

SEQ ID NO: 3730 - DNA, 1192 bp, Oryza sativa
  unsure (1)..(1192): unsure at all n locations
ccacaacttgtaaagatatgcacgatttgaatcaaataagttaagaagttatgcaacactttatttatttggagcacttttttatacatatttattttttaagtacttattttgacaatatactaacgtggatttgtatataagcatatttatatttttattataataactaataactaaaagtcaattaaactggatgtaaaaattattatatttcggttgagatttgggaaggtgaagaaaacaaaaaatctttanagttaattggatgtaaattggatatgtagtataattcttaaagattaaattcaatattataaggtaatatcggtaggattactatataatggcatacttatatatgcttagctaagttgatgcaccaaaatactaaattgtcaagttcttgtactagaacgcacccacttgtcaagttgtcgtacttgaatgttcaattctcaagttcttgcacgatatcgcatcgacccgccaaatttatgtattgtgggtgcaatttactcttaaaagtttatatacccgattcaaatttaaatttggatttaaatattttatatatagaatatttctatacataaagtttatgcgtgcattattttcctcttttagtaagtttatacacctaaagtttacacatctaatgtttatccacctaaattttgtagagcaaatgtttataagtcaaaagtttatatattcgattcaaattcaaattcaaattcaaatattatatatatatatagaatatttctatacataaagtttatgcgtgcaaagtttatgatataaagtctatgcacatgaatgaaagtattagatttttttctattttttactaactttgttttttttttgaaatttatgatgaaaggagagaagggagaagagtatggggggaggggcgctctcccccatacccaatgatacccaccacgtggcgcaagccgctttcgcgtgacgtaaattgtgaacagtgaggcggcgacgacaataacagagacgcccaggacgatctgcgcagtacgcggcttgggcgcgtagacgacacacacctaggcacagcgagcgaagaggaccaaacaagcgcaacggggaccgggcaaacgcgagcagcggcagggaggcgaaacgtagcaggagcggaggagtgcgcgcctgcaacctcaccgcccgc

SEQ ID NO: 3731 - DNA, 913 bp, Oryza sativa
  unsure (1)..(913): unsure at all n locations
cggcgcagatacataataacgcattcaaaanttagatntatgnatcgctaangtcgcgcttcacaaattctacataancgttgaccccgnctctgtttcttttnataaaatattaaatacgctcctatccccnnccccncccccnccncgaaggttttgattgcactagcacataccgcaagnacnncaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgaaatacggaagagagaaaaaagataagtttatgcctatgtggtagcccccggccaaacctgcaacgccgagggaggggcggagttggcccaagcccgagacctgacacccgacccccactaagggagaaaccacaaaggtgttcgatgttcaacggtttaggaactttggcccttatccccttggccagcacaacggagcccagaccgaagaaccctgataacttatcacgacccttccaaaattgggaaaactttcctaacccaaacaacctttggcccctggttaataacaaagtatccacctaagaaaattgtgc

SEQ ID NO: 3732 - DNA, 3388 bp, Oryza sativa
aggataaaagtcaattgtgtggggtgttaattgacagtcccctctcctccaagggggccatggtatttatacccataggtatccctttgtccaagtggacttagggaaccaaatatggatccaatcgaggaagtcattgttgtttccatgaaaaattctggttgtctttctttatccggaactccctcgaggtcagttcccgtataagacatgatatgtggtggatcctgccgagatttagttacctattattaggtatgtggtatccatacccctgacagtagcccccgacttcaatgcaaatgaacgaattcatattctcgaccgctaaccatggaataactgttatcgagctcaagtgaccgttctcggtgagttcagagataacgttagacttcttttgtcagcctcgggaggacacctaaagggtttgtctgagtcaatctccgacgtcaaccaagaaagtacagagcatatgactaagtctcctgtcttgctataatcgagaatttggattgaagtcaagaaattttatctcggcgggtacaccatctcttcattccgtattccttgtcgagatccaccaactgttctcgagcaatcgagaaggcgtagaatctgcgacgaagccttgtcaacatttgtcgtactcgccttagtcgatcttggtgtacaaccatagagacatggagtcttcgataatgtcgaatagaattttcctgaaatcaatactcagaaaagaatattagatagaaatagcccccgagtgaacgctcaaagggtaacatgttataatatgtatggaaaaccgaaaatgaattaaacttacagaccaatgttttgtatatgagcgtctactcttttaccgacttcgatcagtcagtttgttgagttatacactctccctagcccccagccttgtcatcggagaatcgttctcggaagatatggctcctggacctttgacctgcctcggttgaacaagcactgatcctagcccccagccgtgaagttggaaaatccaatttccgattacacggcttggttaatacgcacggtgagaactcttacacaaccatatcttacatggtctttcatctctgaaggatccgacaaggccttatcggctctgggcatccccagccgaagttcccttaggttcctcagaggccttggcaagacggcgtaaagggacattcggataggtttcaactctaggtgtcatcgaggtaagggatctcagggtaaaacacctggtgatattgggtacctgatatcaaactttgtgaagtagaggtaatgggagaatcgctacacctctggtcgaggaccaggtagtagtcgtaacccgaccacttgaagtggaaatagtgggagaatcgctacaccgctggtcgagaacagctagtagtcgtaactcaaccactataagtaaatgtacgagagatcgctacgattgactggttgagaaccagtgaataggtgtctctcgatcatttgaagtcgtggtgcgaggaccgctgcgttattgttgtagtcgtacctcgaccatctgaggttgtggtgcgagagattgctacgtactggttcgaggaccagcaaacatgtagaatcatctttggaacaccaatggaagttgcggtgcgagagattgctacgtactagttcgagaaccagcgagcgtgtagaattatctctcgatcgaggaccagcgagcgtgtagagttatctctcgaacaccaatggaagcttgcggtgcgagagattgctacgtactggttcgagaaccagcaaacgtgtagaattatctctcgaacaccagtagaggtgctagagttggtttattacatgtgcgtctcatgtggccagcatgactcacacacccaactcgtagcatatccggatgttcgttcgcaatcatatcgggtgatcaagccgacgatgttcgcgataattatccgttaacaaccttttctcgagtagtccagccatggccggtgctatgagataggtcgtcggtcttcgttggcaggttggacgcgacgactctgcatttgtcgaggtcgttctcgataatgcggtgtactcgaccacaacctactcgagtgctcaattgttcctgaaaaatattttctagaaggcaagacatacagcagagaatatcgagtatgtattcgaaaaactgcatggatcttctagtattatcaggatatagcgagcagaataaatatcaggcattatgtaaaccgtaaacaagtatgatttatatggaagaaaacagagcgagcccccagcgttagaccatagtctatttaacatcggggacacacgcacaatagatattgtatagaaaacatgctctaggtaaacataataaattatagatctgacaatattgtacgatctgaataggtacgataaattgcatataaaatattgcgtacctttgtagatacatgccggatgtatctacgaaattagtagattaatttaaaaaaccaatctaccaattaccttgttgcgtactcgttcgacatcatatgatctgacatcttctggtatgccgcgaagcttaaggcttggatgatctcgatagaccaagttgtcgatgatgatgagcgttccgatctaatcggaagatgtacttggacaggttggatctccccacagccgaagtcgtcgagtagcttgttgtcggagaatccatctctcaaacccatctcgtcgaaaccttgaagcaccaaaatccccctacctggcgtgccactgtcgacgtttgatgtctcgactacggtatttgcatggcatggggatcgttggtactagggtatacgcgagactgagataaaagagatggagatgaggatttttatacaggttcgggcccctgaattgttaggtaataaccctacatcctgttggccgaagccagtattgctcttattcatgataatcacaccagtacaatgtttggggtagcctatctaactgttgtcgacatggcagtctgaagatctgactcgtagtcgaccataggtagcctttctcctcgaatccgtgcccggcgagatcagagatagcgctttcatctcttctgacagtatccaaagacaccggagggtactaacccagcttattcctgaagtcgatattcggcggcgtgtcttggcttatgtaagcttctatggtggggcttctatgtcaaatgggttgggtgttgattgtccgtccccttttctctagggggccttgatttatacccattggtatccccttgtccaagttgaacttgggaaaaccaatttggatacattcccggtagtcattggttgttacacagaaaacttttggttgtctttccttatcaagaaccccctaggggtaagtt

SEQ ID NO: 3733 - DNA, 1079 bp, Oryza sativa
  unsure (1)..(1079): unsure at all n locations
cttcttcaccgccnngcctcgagtccggtgagcggcaagaagcactttgcaacacgccgctcctccctttccgcnngaagcagcggcgcacngctcctcnatgtcccgccggcaccgccgctcgcttcatgtcgtccccggatggcaactcctcgtcgtggccgacaagaccacgcccctcgattggtcgcacccggcactgcgctgctcatgcagactgacctggcgagcttcgggttccgcttcgtcgccttcctcctcgtgcatggccacgcccgcaaggccgctgcctacctcttcgcagtgctcgctatcgagccgcccaaccggggcaccgccaccgccacaacgcttgacaactcttctcccctccctctcctatccttctcgctcgcatggatctctaacacattgcgtcttctgctgctgctcaattcttcaggacaaagccattggcatgtgacccgacgagcttgcccaagctcccgccgagcaaggagtacaacgccaagctccgcggcaaggaggccatcaggcaaaacacgacagccatcggaggtaagggctccatgtccgtcaagccggggaggaacgagccgtcgaaggcggcgccggcgcaggacgccattggaggaggagatcaccagcgcgtgtctggtgcacctgaagagcgtgagccaccactacagctcgctgcgccgctgactctccgtcgtgcctggagagaggagagagagatgaatagaggggagatggggagaggaggaggaggaagaaaagggatgagaatgacatgtggggccaacattggccccaccatttttttaaatttgtgtgaaactgacatgtgggtcccacgaggtttatcaggatcgaatagccacgtcagatcgagactgagtcaaattagccacgtaagcgccgcgtcaaccaaaaccgccatcgaaacggttgagggatctaatctgtaccggttttgatagttgagggacccattatatctggtcttgtggttgaaggacganaatcggattcgttgaccagtgatgngctntgtcagtcagtcatcaatttccact

SEQ ID NO: 3734 - DNA, 19314 bp, Oryza sativa
  unsure (1)..(19314): unsure at all n locations
agataattaaagcggccaacctgaaaattggacccggccgtcggcccaagaggttcgagtggcaattcttaaaccagcggccgccagtttctcggctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattgaaatacggaagagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggagacgccgatcactcgatacggaccctcccacattggtgagagcttgctcagtccagcacgcgtttggacgcggcgtaggacgaggtcatcgacgcagagtgattgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttctgcgttggcgcgctccacttggccattgcttctggggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtctaaatggacccaggatatcgagcccccagacagcaaacggccatgaaagaggtatggtctgcagggcctgggccggctgatgggtttgcttggcgtggaactggcacgccctgcaccgccggaccaagtcgaccgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttggagatgcgctggacgcgttcactcccttcgtggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgctcggtggggtctgggctcgcgaggaagcgagccttgagagttcgtcggcgaccgcgttatcccgtctgggcacgtgccaaagctctatcccgtcaaaatggcgctccatacgccgcacctggcgcacgtaagcatccatctgcgggttagagcactggtactccttggagacctggttaacgaccaactgagagtcgcctaacaccaggaggcggcggatccccagtccagccgccactctgagtcccgcaaggagtccctcgtactctgccatattgttggttgcccgaaagtcaaggcggaccaggtatttaaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccttctcggttatgcaagatttggccgagcgggtaggacgtaaccaccgtgacctgacgcgcctggaaataatggcgcaacttcctcgaagccatcagaatagcgtaaagcatcttctgggcctgagggtatcgggtcttggcgtcccggagggcctcactaacaaagtagacgggccgctgcaccttttggcggggccgatcctcttcgctaggggccgcatctccagggcgcttttcgtccgagaggccgcgcggggcgcactcggcttctgtgtcgacgacctcggggtcggaaggcgacaggcgcggccttcccgcagtggccctggggccatcctgggggtcgggggcttctggcaccgtcggacaagcgggcagagggccagctccggtcgtcgggggcctcgggccgccgttcggctcgggggcctctcctccctgctctctcccgggtcgagtcgatacagggtgctcttcgtccgagaggccgcgcggggcgcactcggcttctgtgccgacgacctcggggtcagagggcgacaggcgcggccttcccgcagtggccccggggccatcctgggggtcgggggcgcctggcaccgtcggacaagcgggcagagggccagcttcggtcgtcgggggcctctcctccctgctctctcccgggtcgagtcgacacagggtggggatgcgcggagcgagggtcgtcctcgtcgcgctccacgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccggagcgtttgaggagcttaaataggggtagcgccttctctcccagcctcgatatgaaccgacttagggcggccatacagccagtgacgcattgcacatccctaagcttcctgggggggcgcatccgctctatagctcgtatcttctcggggttggcctcaatgcctcgggcagagatcaagaacccgagaagcttgcccgcaggcacgccgaacatgcacttgtcggggttcagctttatgcaggtggtgcggagactttcgaaagtttccgctagattcgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctacgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcaccttctgcaggaccggccttgcgcccggccgtacggcgagacggtgctcaatcacctccttggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatctggacctcgtcgcacgtgatcatccgctgcctcggggcggctgggacggaggtgctgagcttctcgtcgccacccgtgggcttggatgccgtggcgaggtggtccgcgcgctgctccatgcaagcaagcgcgactttgaggtcgccatggacggtgatggggccaccggggcccggcatcttcatctggagataggcgtagtggaccgccaccatgaacttcaccaacgcgggcctccccaggaccgcgttgtagggtagactgaggtccgccacatcgaagttcacccgctccgtgcggaagttggcggaaccaccgaaggtgaccgggaggtcgatatggcctagcggccaagtgtgccccggcgtcacaccgatgatcggctgggacgaccggagcaccatccccggggccttaatggcgtcaaaggcagcgggggaaaggatattgagggctgcacccccgtcaatgaggacacgccccaacttcacattgcaaacggtgggggaaaccaccatcgcgatctgtcctccccgggcaacgcacggtgggtggtcggtctgatcgaaggtgagggcaacctccgaccaccgcgcccgccgcgtcgcctcatgggtaggggccacggccagaagctctcgcttcatggccttgaggctccggcgagaagcgtgagcacacgctcccccatcaacggtggcgacggtggcctcaggctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccacgaggtcgtggagggaggtgttgtgcacggtgcaccacttgccggtcgggcgctccctactgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcagcgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctaaacgcgtagatcaccgcgtgtgcagggatgcacagtatagtgttgcggacttgacaaaaccgctgaatgtacgagcgaagagactcatcgtcccctcgctgtaccacgtgcaagtccgcttcttcacctgggcgcggatatgtgccctggaagttcatggtgaactgctggcacaaatcctcccaagagtgcaccgacgcgggtggcaagttcattagccaaccccgcgcctgtcctttcagggccatggggaagaaattcgccatgaccctgtcgtcacccccggcggcctcgatcccagtcgtgtagatctggaggaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgttggcagcacggcgatcattgcgccggcgctcgatattgaagcgggcatctggccccctacgcacatcttcttgggttggaggcgttgacgagggaatggcggacgaacggcgggtaacggccgccgctcgccgcgccctccgcctcgacgacacggagccagcagtagcaacgccagtggccttggtggcggaggaccgccagtcggcgcctaggcgctgctgcgccgtcatgagcaaattggccacgtcatctagccaacgtcgggttgaagtctctggatcagggatgacgggcgggtgacgcaggagcgcgcccgcagcctggagcgcgccctggggcgtgctgccatcaccgtagacgaggagacgacgctccccgtctcgacgtccttctccatcgcccgcgtgcggcgaagtcgcggatctttcgacctcctcgagcgcctcctcccgcccaagacttcggcgagagggggacagtggagtacgagctcgacggcgcaggttctgctccccgtcgtcaccgctagcgctcggagagagattgtgcgccactgcccgttcggccatggggctgagcgggagaagcttggcgcacacgaaagaggacgagggcttagaaagacacacgcgccccctacctggcgcgccagatgacggagcgtggagctcctcatcgggagaccgcgcaggcccccctttgccggttcggccgggggcactaagtgaggttcttcgccctcgatttccttaacgtatgccgaaaacgtccgtatacacgcaagtataccatatcgatatgtgacgtatatcgaagggtagagggtataccttacctgtaaccctgacagtagcccccgacttctgtttaaatgaactcgtgtaaccgatcgtgacttttgatgtcgaggttgttgttgttcttggtgtgaggaccgagagacaaggagtaatcgacaacaccaagtgaagctcaacggtcatgagtgaatttaaattgaagtccgaaaaactgccacgcgtaacggacctagaaattcccggcggttatctctctcctttccttggaattcgcaccgtcggaagtgcgactatttaagggagtttcggggatccattttgaagtccgcctgttgtgaaaaaactctccagcccccaagcgttactcgtcttctccgctcccgcaaaaaccctagctagctcatctcggtcctttctccggcgatctccggcggcaatggacctcgacaagtatacctccaccagcgcgtcgttgaagaaactacaggaggatggcgcccttcccggtcgcgggaccatggagagagaagcaggaggtattgaaccctagcctttcctaggtcgcatggttgcgatcgaggactatattctctgtggttttcttcctccgccttctgaatttcttctcttggtcttgaatttctacggcctttctttggtccatttgaaccctaattccatcgccttcctcagtattttttcacatctttgtgaggcctacattggggtagagctgttccttgacctctttcgtttctactacgagttgcgtttgatggaatccaacagggtatccggatgcgtcggtttccgaccttgggatggcctgaagtcgcgctatatccccttccagtgcccttcttctcgtagcaaatggcgggcgaggtggttctatcttcagatagaaaattcggatccagtcttcgttgttcctgaggaacaaccagacaagatttcgtcttggaccgcaaaacccgccttgaccccttctcttcagtccttcatcgatgccatcgatgacctccgagtacgaggtttgtcggggtatgaaatcgctgccgacttcattggtaggcggatccagccgctctaggctcgagcccacccagcctttgactattttgggctggaggacgcgacccggatttctcctcggggtatttttcttgtatttaaattgacttccttatgtgtgtgttcctcctgacttatcgaattccgattctcgatctacaggtttgaacagcgaaaccgtggagcgccgcgtcggccaattgatgatcagcggcccgacaacggcaagcaacgtccccgtccccctttgcgagaagggggcagccgaacgcgaggctgccatcaatgtaagtgtactcggtggcccttttgcatttttcttccggaatcgcattgtgacttcatgaagtgtaggctctccctctgactgatatcatcgggccgctcgtggatcatcaggcggcggcgtcgctgaaggaggacgtcgccaaggaggcgtccgatgttgctgccgctgcagccacaacgagtggcggcaactttccaaaaagggggaggaaattctcctccgtgatcggaaatcgtcggaagacacccaccccctcggtaagctctcctggtccttcatcgcgtagtcagaaaacttccacctcacatcatgcccgttatactctaggcctcggatgcgtctcccctgcctccgcgacggcagcagcttgtgacgcttggcgagaagtaagtggatgaatttgaggttttctcacttcgtcaaactcttgcagcctgtctcaattgcggcctttcacagggcggcgcgggcgaaggcggcgcaagacgaatctggagggacctctagcgcgtctcttgctgtggcctcgacagatgtcgtggtcgtgcccaggagccgcgaggcaacgcctagtggcccagccagcgatctcgcggctggttggggtccgccggctgccgtcctcacctgggaggagctccaggtcgagatggggcgcctccttgaggctggtggtcacagtattagccgcgagatcgcggaggtgagggcggcagtggcgtcgtcggtgaatgagcgcgccgaccggctgacgcgcgatttggcagaggttcgcgaggacctccagaagatgagggagctggtggccggcaatgagcgacaacggcaagggctcgagcatcgtatgtcggagcttgagaacttgtcggaaatccgtggctcgctgcgggtcacctacactggtctgcaccagctcgccggggagtgtggcatcaggaccaccatcccggcgaatcccgacgagttctcgctgacgtcttcgcttgcaaaactggccacggcgatggaggcgatcccctccaaacacgcagccatgatcggagaggagacgtcaaatgggatctataccggggcgtgccatgtccttgcgtgtgtgtggctggcgcatcctgaactcgatctccagaagatcttggatcagggggcggctagcgatgcgcgcaaggatgtgatggaagaagtcggcgatctgggggagtcaatcctcccgctttttgaagagtaggtttttggctcccttgtactctttagtcatgctttgtaagactctcattggttccaaccgcctttgtgtgtgcagtcatcaccttagttttctttagcattttgatctcgagtattttgttgtcgtttgtagagatgttgatgtcgaggatgtccagtagcgtgggcagcctgagttgccagtgatcgtttcggcacttgcgttcgagccatatgtgccgcagggcgatgtagatcaaaattcgcctatggaaacgggcatggcgacgacttccttaggttggttatttttgttttcatctcctttactcctccgtctggaccgacttgctttgctgtgttctcgggagagaagagcagtttgacttagtcatttccatgctgagcagacctcgagagtgcgcttgctaaccaagatcgtcgcatccaatattggaggacaaaatttgaggtagcggaactcgagaggactatgctggaagtgaagaaggaccaggccgtggaaacactccgaggtcgtgaggtgtggttcagctcgtacctgaagagttgctgcacatccatgacaagagtctgtagagagctccgagtaccccgtggggatcctgaggaatcggcggccggatacatctcgtggctgaatggggcctgcgcccagctcgacgacatcagcaagcgtattgacgaggccctgaagcaggagtgccgtcgatcgagccgatatgccggggggcatgtattggcttgcatacgagatcatcgcccgcagctacacctcgagttcctccacgaagggttttctcgttgtcggagaaatcctacggagatagatcacttggcgaagtcgatggcgccgctggggagaaggtcttccagtccatggactggcgttggccttcctggtagtctccgtatcctatgacaaatgtcttagggaaaagtgtaatataattttggatttttacgtaattgtaagaagtatttgtgaaatagaaaagaaatctatctaactaagctttcttactctggacgtagtgtgtaagagtgtcttcgcacttcgcgacttcgatcagtcgtttgagttatacactctctctagcccccagccttatcatcggagaattcttctcggaagataaggctcttggacctttgacctgcctcggttgaacaagcactgatcctggcccccagccgtgaagttggaaaattagtttccaattacacggcttggttaatacgcacggcgagaactcttacatgaccagatcttacatggtatttcatctctataggatccgacaaggccttatcggttctgggcgtccccagtcgaagttcccttaggttcctcagaggccttgtcaagacggcgtaaagggacatgaggataggtttcaacgctaggtgtcatctgggtaagggatcatcaggaaggaacactttgattgtaatatgtacctgaaaataggctttattgaagctgtaagatgtcttacaagtatggatactattgacttatacatagaatttatgtaattgatcaatgttccaggaatttgccaactcgcgaccatcgctgtctgcaatcttgaatgcgcctggccgcaagacctgtgtgatcgtgtacagtccttcccatttgggtgagagcttgtttcgccctgcttggctttgaacccgtcggaggacgtagtcgccgatcgaaagcgtgcgtgctcggatgcgcttctcgtggtaacggcgaatggcctgttggtagctggctgctcgaacggcaactcgttcgcgatgttcctcgagtagattcacagcgtcatttccctgctcctcctgatcctcatcggaatacttctgtactcgtgtactttgatgtcgtagctcggtggggagcatgtcctctgagccgtacacaaggaagaagggtgtctccttgttagacgttgtcggtatggtatgcacggcccatagtactgatgggagttcttcgacccacttcttgtatgtgatatgagcctgtcgtagacgcaggtcttgattccttgtagtactatgccgtttgccctcttgacctgtccattgctctgagggtgagaaaccgaggcgaagcagatcttgactctcagcctgatgcagtaatcctggaaatcggcactgatgaactgggagccgttgtccgttatgatacggtgaggcaatccgaatctgcaaaatatccctttgatgaatttgatggtatggtcggccttgatttcccccgtgggtgttgcttctatccacttagtgaatttgtcgatcgccacgaataggaacctgtagccgccctgctctcgtgggaatggcccgagtatgtccagcccctagcacgagaacggccaagtaagagggatagtctagagtgcttgcgctggtagctttgtgtgtttattgtggaattgacaggcttcacaccgctgaaccatgtcgcaggcgtctttgagggcgattggccagaaaaacccttgtcgaaaagcttttctgactaatgtccgaccgacggcgtgtgactcacagatcccttcatgtatgtcgaggaggagatgtctgccgtcatcggacgagacgcattttaggagtatcccgttaggcgtcttcttgtatagatcgttgccgatcatacagtagatttttgctttacgggttattttctcggcttctgcgtcgtcctcgggcaactcttcgctgcctatgaatttaatgagtggggtgtgccagtcgtctgtggtctcgatatcggcaacggcgcgctctgcctctatagcccaagagctgatgttgaggacgatcaggctatctttgccgcttgcctctttcactgatggccttgtcaggacgtctagaaaggtgccaggttcgagtggctctcgtctggacgcacgccatgctagatcatccggctcgatgttgtccttgcggtatacatgtcggatctcgatcccatcgaaccttttttccagcttcttgacttctacgagatacttggataactcggggctagagcacttgtaatctttatgcacctggttcacaactagtttggaatcccctttcacgaccagtcgcttgactccgagtgcagctgcagctctcatcccggcgagtagtccttcgtactcggctgtgttattggttgccctgaagttgagatgaattgcatgcttgaattgatttcccgaaggtgatgtcaagataaatcctgcccctgctccttggctgttaagcgcgctgtcgaacgccattatccacgtttcgttgtcgatttggttgtctgacctgttatcaggcatagtccaatcggctacgaagtcggcgagtacctaggacttgatggctgttcgtggcacaaagtggacatcaaattggcttagctcgactacccattttgcattgcgaccgacaacgtctttgtttctcacgacttcaccgagagggaaggaggatacaactgtgaccctgtgggtttggaagtagtggcgtagctttcttgatgtcatgattaccgcgtagagcagtttttggatctgtggatatcttgtctttgcgtcgtggagagcttcgctgacgtagtagactggtcattgcaccttctctctcgacaacaatgatagtgctaacggaatatggcatggcggcaatatagagaaataattcttcattaggttggggggcaacaagtacagggggatttgataggtagcgcttgagtgcaatgaatgcctcttcggcttcctgtgtccatacaaatttgtcttgcttcttcagcagagcgaagaaaggttgtccttgctctcccatcctagcgacgaacctacttagtgccgccatgcatccggttagcttttgtacttcatgttctcgattgccttgatcttctcaagatttgcttttattcctctgccagatacgaggaaaccgagcagcttgcccgatggtactccgaacgtgcacttctctagattgagcatgaggcgatatcgtcggaggttgtcgaacgtttcccgcagatcgtcaatcaatgagtcgcttgtcttggtcttgaaaacaatgtcatcaatgtaggcctcgacattgtttctgatttggtcgctaagtgcgccctggaccgtacgctggaaagtgtttcctgtggttattagtccgaacggcatcttaacgtagtaaaataccccgaacggcgtgatgaatgttgtcttctcctcgtcctctttcgccatgctgatttggtggtagccggagtaagcgtcgagaaagctcaacaactcacaaccggctatcgagtccaccagttggtctattcgaggaagagggaagtaatccttgggacacgccttgttgaggtcggtgaaatcgacacacattctccatttcccattggccttccgcaccatgactgggttggctagccactctggatggagtgtctgtccaacttgtgtatagggcaccatgttttcttcgtgtcgctgccttgtgggtctgggcgcttgggagggtccgcgtattctgttgcgagaacctccgcttgagctttccttttcccactgttgcgatttttcttcttgcttgactcaggtgcttccttggctagtttcttctctccttcggtcttcggtttgtcgttcttgcgtctcagtgcgtcgtccgcgtgagcgcatcgatcgacaatttcgaataatctccgagttgtcgtgacgcgcttcgttgccaactcctgggtagtatagcgatctctgacactggacttgaaggtgcggattacagaagcgtcggtgatttcggggattgtatttctacactcattaaagcgccgaacataatccctcaaggattcacccgggttctgtgtcaacacatgtaggtcgtcttcgatcgcgtggcgcttgtaagttccctgaaagttggcgatgaactgctgccacaggtctgcccatgaagaaatcgagtagggcgggagatgcatcatccatgaacgcgtagaacctttcaatgcagttggcaaataattcaccaacgcgttgtcgtccactccggcagcgtagagtactgtggagtagacctgaaggaattcttctgggtcggtactcccatcgtacttctctattgctcctggtcggaatctctcaggccatcggacatcacgcagcgaacgactgaaagctctacacccagcgctgggggcggtgggttgtcggcgatcgtacgtccttcgtggatgtctatctgatgatgaggatgaggaagatgacgatgatgacgacgggtcacttggttctggtgtacgattacgagggcgtcggccaggttctcgagaatcctgtcgtcgtctcctgttgttgtcccggcgccgatctccatcatcgtcgtcattatggcggcgtcctcgaccagtatcgcccagcacctgccgttcgcgatcatcgtgatcgtggcggttgtggcggttatcacggtctcggtcttcgctcgaacggcctcctcgttcttcgttatcgggacgtcgtgaagagacacgatgtcgggaactgttctcgttgtctcgtgcgcgtcgcgcctctcagcggccattcaggtgatcgcggagatcgccggtgccgcgaggtggaggggtggctcgatgaggcgattcctgctgttcagggttttcgccattagcaccgccagttggtggctgttccgagtgcgctgcagcagcggcctcttcgaacgcattgctgaggttggtcactgattcccgtagtcgttctgtccaccgtgcgacatcgtcgttcagaacgggatcgttgggggtttccctcagtattgcgttgacggccctgatgtgctgggccaatgtagtcacttgattttccgcttccgaattagcgcgcgctgacgtgctggtccagccgatagtcaatacctcgcatggcgtactcgttgacgatgagccatagtcttcgagcaggtgcaagactgatggttcatggggatcgatgtcgattaccccaacgaatcgatctgtgatcagcgtcgctccttgttccttgtcctcatccctgagggggatacgtgactgttggaccttaggaggtgacgtcttcatggcgctgagaaagaccttgcagcttgagaggtcgtgattctttgtcttgtgaataggacaatagacatcaagagttggagaagtacgctgaattccacgctctttgcaagcacgaatttcagcgtgtacgttgagaaaaacccaacaggcttgcaaggtgtgttttctggttttgtggataggacaccaggaccttgtcacctcggaagtcatcctcgtcgactcatgattcttgtcggaaagacaagatttggccgcattgggatccttctcgggatcggatgtcgtcgacgttccgttctccacttcggcgggaggatctttcgacatggagtcgtcctgggttgtagccactgcgttctcccttccggtcattgatggaccagccgagatcggcaccgtggtgtaaaccgggaagatgatttcgccgacttgagtccacaccagcattgttgaagtaggaactccttggttgaggttggtgttgacgctgttgtcgacgaagctggatgacatggtagtagaaccttgagcaccaaatccccctcttaacgaccaaatttggtaaattctatcactattggcatcgaaggtgaagatcagatcgaggtggaatccaagatgaagatcgttgcggaaacagagtaagaatcagctgcagtccaaatcggctaaggtcaggtcggcagagttcgagtcggacggggctagccgatacagccgattccgataatatgactcggtgtacgtcatcgggttcaagttgatgtgcttcaagatgattgccatgcatggatagagtcctgggaaggcaattgtatctattaattaggatattctatttaatttccttagagatatgtttgggcaaaagcctgccgtaaagacttatggtatcttagagtttgttagagataatagtcgtgtctgttatgaacgtatcttgtaattctcgggtataaatagacccgagtcctatgtaaaaagaacaacacatccaatacaatctcggcgcatcgccaccctttatgctttacttttatttcgacgagttcgtgctctcgggttgagctgcatcggtttcgaacttcaacaagaggtaaagcttgtcatgacgacttatgttcttaggattagtgcttccatctttatgacactctaatcttgtctatataattcatcgagttatcatatatctcatataatcttcgataatatcttcatctaatctgtaaccggctaacatctgttaatggaaggcagccgattaggttagacaatgatgttaacttagattatgtgatatatctaccactctatgaaacttccagcgtcttgattgtctagatattgttcttcttttcatacttaatgctgcatcagttgagtttgatttattaagtcgtgcttagaattgcaatctctagcctgctttctggttgccgattagggtagtatcggagtttcagccgatcttatctgatttaactacttttattctatatgcttgattgacatgttaaatctgccctttatgttaagattttaattgcatctaagtatattaagctactgtttggtatattctacctgctttaacatcttaatatagagtggtatcggagtattagccgatacatgctagatccatttgatcggctatgctataaatgtatataatcccactattaatatatatttcgatctaagtgatttatactgtctcggcaaggcgaccgatctatcccaatcacttgatttaagtatatatcgatataaggattatatatcattaatatctacagccgatcaagtagatttagttctgatttgcttattgatatttgccgatcgatgtacgcatgacatcggcttgaaataaatgatatgtcatcggcacctagccgatcggctatcatttataggattaactgtggtttctttgttctatttcttgttgattgtaggatcaaatcaactggcacgctcatacacccgaaggagagttttggacctgcactggagttaagcagatctcccaggcctcgtgttttctgtcaacaccccctacctggcgcgccactgtcgacgggggatacccgtagaccggatatagagggtactggggtacgctggtacgaggatctacgtaatacggcatgcgcgcgggccaccttcctagttttatctaacgatgtataatattggatccaccaatttaactgaaaataaaggggtatgtcgacgtttgatgtctcgactacagtatttgcatggcatagggatcgttggtactagggtatacgcgagactgaggtaaaagagatggagacgaggatttttatacaggttcgggcccctgaattgttaggtaataaccctacatcttgttggccgaagccggtattgctcttattcatgataatcacaccagtacaatgtttggggtagcctatctaactgttgtcgacatggcagtctgaagatctgactcgtagtcgacgataggtagcctttctcctcgaatccgtgcccggcgagatcagagatagcgctttcatctctcctgacagtatccagagacaccgtagggtactagccgtgcttatccctgaagtcgatatccggcggcgtgtcttggcttatgtaggcttctatgttgtggcttctatgtcgattgtgttgggtgttgattgtccgtcccctctcctcctagggggccttgtatttatacccataggtatccccttgtccaagtagaactagggaaaccaatatggatacaatccgagtagtcattgttgtttccatgtagaactctggttgtctttccttatccagaactccctcgaggtcagtttccgtataagacatggtatgtggtggatcctgccgagatttagtcaactactattaggtatgtggtatccataaccctgacaggatatatgttttgcttttttattataatttattggattttctttaatttataagagtgtcacatggcggctcgagagcgtttatagggagtttcatggactttactatataaaggatagatacctaagtatcacatttgatacctacggagtatcatgtctgatgtcatactaaattcgatactttcggtaccatactaacatgagcatgatatctaagtattggatctaggtatcatgtttggtactggaggtatcaaatcgggtatctacggtaccatgctggtatcagttattccgttgtcatgctgacatcagctattccattgcgacggtaataccgttacgtagtctgtctacctagtaaactttaggcccacgaaaactggaactgggcctaagtaggtcgaaaagttgcccatccaccgtgggaataagttcatctaaggtcccttaacttgtcaacgaatccgattttcatccttcaatggcaaaaccagatacaacgggtccctcaactatcaaaaccgatgcagattaggtccctcggcggttttggctgacgtggcacttacgtggctaatttgactcggtctcgatctgatgtggcgcttatgtggcaattcgatccgaaaagataataaaccccgtgggacccacatggtaatttcacacacaaaaattataaagaaaaatagcggggcttacatgggccccacatattaatgggccccctttttttcctctttttccccaaaccccctcttttaaattttttccctgtcctattttactttggagctcaccccggttttcttggtcccagggcttttttacttagggaggtttccacg

SEQ ID NO: 3735 - DNA, 10138 bp, Oryza sativa
gtgaagggcgcattaaatcaggttctgggggttaaaggcggaagatggatttggttgacaagttaagggaccctagatgaacttattcctccaccgtgacaggcctagccgctaggcccacatattcagcaattcagataggccgatccaaccgcgtacgaaaggacaagtactcgtggtgtctgtcgttctcttctctgatcataccaaaaggacaaaaacttggattagtgctgagctggcgctgttcaaacgcgcaaccaagcagatgccacccaagccaagaggaaaaatccaggtataactagggcctcgttcattgtgaacattattgacctctgctgtctttgcaaggagcaggtgatgcttataatttaaggcgccgttcggaatttttattcgggactctagcagaaatgagaaacgtatttatattttttttattctatcagaaataggactgtctccagtgaacttggttgtgttcgttcgagattgggaaaaccttttccgacacaaaacaaaacgtcagattattatataattaaataaatattatcttaaaaaccacaaaattagattagtataatttttaagtactaatgcactgtttagcagtctgcggaacacgcacgtgagagacggagggggtagaagttggaaaagtgtaggatagaactcagccttagtgaaggctgataaattcacacgttccaaaatggcccaaattgaacctagttgggagtaaataatgagttggactgtaatttggagggaaaaaaataatgcgaatgatgctggattttcgtaattggatttccgccgaaatggaacggtgcaggcaacgttgccaacccatcatcatcatcactatcgtcgtctgtgcatcctttggggtgtttaaatcggatatacagactcatatttaaagtattaaatataggctaatgacaaaataaattatagattccgcctgtaaatagtgagacgaattttttaagtctaattaattcgtcattagtaaatgtttactgtaacaccacattgtcaaataatagactaattaggcttaaaaattttatctcgcaatttacccgcaaactgtataattagttttttttctatgtttaatactctatatatgtgtttaaatgtttaatgtgacagatgtaaaattttgcatagtaactaaacgtttaatactctacatcctcctgagacgcagcgcgggctgtccatgtcagggaatgttgagttagttgtgattggtcgctggcgtggacgccacaggccccgcacctaaacatttctggcacgcatcgcatcgttcggttcgacccgcagccgattcgcgcgccacgtacataccgactcgtcgatgatacgagagccgtgttaggcgctgtcagcgcgtggcccccacctcacatgcatgctgctctcccgccttgtggaattgccgggcccgtctgacctcagccggtcagcaaccgttagagacggagctatgaaagccgatcaaaaaaaaaagattaggtatagcttattttcatcacacgtacatttctaaatataaacttaaacatccacatcggtttaaatttaatctaaattacagtaaagtaaacgagtgataccgctcttcacatctgataattgatgttactgtttacttaatcatcatcattaacaacagcagcagcaaccacaatgctaacacccttattgatatacatatacaagcctgagagatttcaaacaggaacacacccaaatgcttgcttgataaactagacttggttaactaggctttgttgggcagtgcaaattgggaactaatcttatgcacataaaataaaatacatggttaattaagtgttagttaaaacccttaaaataatatcaatatgatttttaccaactttattatagaaaaattttgttaaatatacatcatttaatagttcagggaacatgcgtaaaaaaaatgaaggagtgaaagttagataaggtgagtatcgaatatacatccttaggtcatcaccaatgcgtagcctcgggtcgtcccctcgccgacggatgtccagctccgtttgcccgtcgtccccccacgagagagcgcgtccctcagctgggagacgtgtccctcggtcacttttggctgacggacgacacgaagcgacgcgttaggggcgatgggctcctgtggacaccgtagctccaccaccaaattcccctttcacccctctctcccccccccctctctctctcctgttcccctcaaggtcgagccggaggaagagtaggaggcggcagcagctgccgtggtggaggcgcggcggtgacgctagaaacggggaggacgagggtggaagttgggccaaaagggagagagaagcggtggcgcaccagatctggcgacgacccgcgacatcaacgggcggagggacggccgcgccgtcctcctcgtcctcctccgctggtcagagtcggagcgccgtgccgtccttctccgccggcgccgcgcccgccaccgccggccccatgcccgcatccgccggtgccgcaaagagggagagaggccttgagccgacgatgggagagagagagggtgagaggcgtggagccggtgacgggaggtcgaaggcgtcgagccggcggaggcgtcggtcagctcctcgcctcctcggtggatgccacacgcggtagatgggagggagtaaatgaggggaagagagagaggggggagggaagagaagggtagtatagtaaaatatctacatgtgctttttggatagggatactgaggggagtttcccagggagtaccctcagttagtgagggcacccatagagtatccctgattagtgatgcccttaggtttcatttggcagtgctgcttagattatcagcaacatgtgaaactatacgagctattaatgtagattaattgaatattaagcatcacatacatacaaaaaaaatatttgatttttgagagaactaattttatgtagaaagtatttgaaataatataccgcttaataatttaaaaaccgtactcaccctatatactccgtatgagcgagttatcaatccaataagcacttttactgcttgaatcaaccacaaaatctctgattccataaagatgcccataactgcctgatacagacagctggcgtacgagattatgagccaaaacattttttttgtcaaatggcatacattaagtactactgttagggccaagattaagggactagcttggcttaaaataaaacggagagaaagaaaaggaggtatactccagctgctagccacatgatcacagcttgtgtacgtacgtacaggccgtctcccgtgtttcaaggcgagacatgcttaatttgctaatggactcgacgcgtctaagggttactcactccattactttgagacaaagattacttgctcgattagtttattaattaatgccctaatcatccaactaacaaacggctaaatacagtttcaaaagcagacgaacctaattacgaatcacaaagagagatgcctcacatatacatttgtaatcatgattggccggtcggcgaaaatgaaaaaaaaagataatgtgtatctcaatttctgtgtgaaatcatcagagatgtatcatggagagggcgaaatgagctataattgttaaactaggtgaggacacccactaagcgcgtcggtatggttcgatgtatgcacgttgcgacggggccctcactactgatcattctcacagattcaggtcttcaggacagcttaatttgtttatgataactcgaaagacaaaaatatttgagattattatcgaatacttgtcatatttgataaatgtactatgtttatattgaactcattttaagtttaacaaagtctatgcgaccggttggaaagtagacaacgcatcttgtagtgagcctattcaaatgccaaattaaggagattctgctagttccttgaaaaaatagaaaaaaaataatctatctttctaacatgggtttcttttcgatttcaatagaaaataaactgattcatgttaaaaccttcacacaaaaaaaatcacattataaaggagaaaatcccaagaaagaaaaattgaattgtcaaagtcggatgaaaccatgtgttccctccatgaaacccgtaatggaaggcaactcagttcatcttttttttcccctttggccagttgttcatcatcaccgctggttcgatcagacggacacgcaaaccaaccaaatccccgcgatcccagccgtccatttcccccacaatattctattcccgccctgcgaccatatagcccacctcccctccttccttccccgcatcaaacctctcctcctcgtcacacaccccgtctcgccgccggcgatgcgcagacgccaatgacgacgacgacgacgacgacgaaccacagcgccaagagcatcctcctcctcgcgctcctcctcgtgccgcacctcgccgcggcgtcgtcgggagatgcgctgatcagccagcgccgccgcctgctcgactaccacggcggcggcggcggccatggcggcggcgacgtgtacgtggacccgtcgtacacgttcccgaacgcgcggctccgcgacgcgtacgtggcgatgcaggcgtggaagcgcgccgtcctgtcggacccgcacaacgtgacggggacgtggatcgggcccgacgtgtgcgcctacgagggcgtgttctgcgcggcggcgcgggacgacccgcacctcgtcgtcgtcgcctccgtcgatctcaaccacgccgacatggcgggccacctccccgacgagctcggcctgctcgccgacctcgccgtgctccacgccaactccaaccgcttctgcggcgccgtgccgagcaccctcgagaggctccacctcctccacgagctcgacctcagcaacaaccgcctcgtcggcgcgttcccggacgtcgtgctccggctgcccagcctccggtacctcgacctccgcttcaacgacttcgagggccccgtcccggccgagctgttcgaccgcccgctcgacgccatcttcctcaactccaaccgcctccgcttccggatccccgacaacgtcggcaactcgccggcgtccgtgctcgtgctcgccaacaacgacttcggcggctgcctcccggcgtccgtcgccaacatgtccggcacgctcgacgagatcatcctcatgaacaccgggctcaagtcctgcatcccgccggagctcggcatgctcaccggcctcgccgtgctcgacgtcagccacaacagcctcatgggcgccatccccggcgagctcgccaggctcgagaacatcgagcagctcgacctcgggcacaaccgcctcaccggcgacgtgccggagggcatctgccacctgccgcacctccagaacttcacctactcctacaacttcatcaccggcgagccgccggtgtgcatgcacgtcaaggcgttcgacgatcgccggaactgcatccccggccgccccgaccagaggccggcggagcagtgccaattccaaaacacccaccacgtcaactgcgacgcattcaggtgcaagaagttcgtcctcccgtcgcctccgccaccggcaccatcgccgccgccgacgtctactaccaccgccgtcaccctctcctccaccaccttcacctcctactccatcttcaccaccaccatgtccatagcctactccaccttctaccccgacggcggatacttcaccaccatcgacatcgacgactccaacatcttcaccgactacatctcctcctccgccatcgacagtgtactacagctcgccgacgccgccgtactacgaggtttcaccggaggacaggtacctctcgccgccgccacctccggcgtaccacgagggcgccgccaccgccgtactacgaggtgtcgccggaggacaggtacctgtcgccgccgccacctccagcctaccaagaaacgccgccgccgccgccgcagtacgaggtgtcaccggaggacaggtacctgtcgccgccacctccatcaccggtgaagtggaagctgccggtgtacgagtactcatcgccgccgccgccggcagcaacatggaagccataaaattaaaatcgattctttcgggattttttttttcacacactatgatcatacatattgttaaatttgttgtatgttgagtaaaaaaagggatgctaaatcttttctgttactacccctccttcctgattttcttttgcttgaactgtatgtatttttcttcttttatttttttctccttctttgaatgaacagcaggaaatctgcttttcctcccattgatttgcttgatttacagataatccattgtgaacaaatggccatattctgatatacatagacagaaatgaagaagaaaagaatgagagattttatattctcatttgcattatgatggtgtctatgagttggcaatattatcctagaaaagttaagcatatactagtactgacaactaaataagcattggattctgctaactggaacagctaagattctgaaggctccagaaaagtacaactagcaatttgaacacactgaagaatggccaacagcttcatcctcttcaaaggttgccagcagcgacgcaatgttctaagcaacaaagtcagcaaaagttagcatagcaagggaagtgccggggaccatgtaatctgttaggccaatttgttagaagtcatcgcatcagaacattcatctgcatgatctctctagtatgatagcagcagtattattgcattgggacaggagaagttgacatcacaggataaatgtataggatatatagaacaagaagatttcatcagagaatgagaaaagagcaggaaaaacatttgcctggccggccatgcattcaggttgttggatggaatattttcaggaccagctcagagtagtatctgcattgatatctatcgttgatggagtgtataatgtaagtatgtaatacagtaaaaaaaaatggagctattgtacttgtactgttcagttacttcagtacatttttgtttatctctgtgttgccgtacagtgtactactacaatgcaaagggtgtcaccggattcgaactgtgttgatttgtttagtgcagagacttaaaaccgttgattttgacttaacccacgtcttgcgcttggcgcgtactaattaaataaactagctggatgattctaaaagaacttcgatagataatcgcctacacgaacaccaacgtgcatagaactttcgtcgctgccgccagctgcagaacagagtatgcgctgcacgtaactaattggaagaaaagaaaattatcttgctgtatgggagtatatgagtatatatacgagtgtgcatatgttcttgctttgcaggcagacatgcaaactgtcaggctaatcgatccctctcactgcacaaacgttgatatgcagaaatcagaatccaccagttcttgatttactgaccaatcaaaaatgacgatcaaatcaagactgcccttccaaacaaacaaacaagaaaaagttaaatcaaattcaaataaggggatcgagtatgcatgataccaaaagaaacagagagagagagagagagagacaaatgagtagatatgcagagagatggctgcctcttgccttgcagggcaaaaaggcaagcagagtttggccgtcctggcctgtgaacgaatgaatcatctgattaggtagtagtaccggtgtctggtgatcatggcgccgcgaggatgagaccaaatggttagtaggagtagcaaacgtagcgagcgatgaccaggcaacaaaaccaaacctcccaatttcccaaccaaccagcggcagcgccggcgcgcatgtgcggaggttgggttcgcatcgcctggtgtttttgtagcctagctagtagttctgacttgctgcgcgcgcacgcggcggagtcgccggcgccggcgcgattccatcattggggcttcgtttgctgttgcccctctctctctctctctcgccgtggctccgtcgactggtcggtgttttacatgtgcgtcgtcgagatttttctttttgtactgccacgacatatatattgggtagcggcagtacgtcgttttgctcggtcgggcgcaactaacaactgccgatgccatccatgtgagtgtttgacctcgctgaaggtagtgatattcatgtgcgactatagtatttattttactagtgtgctgaatgtgcggttgtatgctttaggactttgttcagtctcggttgcctggaacttgttgtctatgttggatcttaccgtgtgattgttggttttttttttttttgagaagatgatattcttctgtgattgggttacattccctgtcaatcaaatatgggccaccttgttcgttggttcctgctcggtgtgggccgtatgtggccctttgagagtccaactagtactttacgcattcgacagtaggaataagtccattttgcctccctctattcttgccctttgtcgaattacatccctcaaccacgaaaccgggtatattatctcccctaaatgttaaaaccagtacaaaacaactcccttggtggtttttgacagtggttttgttgacgtggcatcctagtcatcgaaaaaatttaaaaaatacgtgagggcccacatgtaagtggcatttctattcttcctctcctccaccactctcctctcttctttcccttctctctcctcgaacagagcaaggcaaggagaggcgccggaggcgcgggaggtgtgggaaccgccgaaggatgtgggcgcatgccgcgagggagaggatcgccggccgcggcgcccgcacggggagggttcacctgccacagcgtcgatctgctcggccggcaacgcatcctcccgctgtctattcgcgccgccgacctccggcaaaatacataagctcatcaagctacctttcgaagagcatgtcatgtgctgactgtcgagtgcaaaagattgagctttcacctaaaacacttggagggggataaaccggcaaccatccatggagcagtaggagtaacaactgaagatgatcatgatccatcccaacaagtcgccggagcaagtagtagcctctttcgagcttcgacaccacacgaggaaaaatcagacataaaaacccccatgaagaacaacccagcagtaacaaaagcatcccccctccattagctgcatgtccctttctggaattctccttttcttctccaaagagacaacgtgagacgcatggatgaacaattggcggtgcgcctactactgcccggactcctcatcggactcgccgtcatcgcggtcatcctccccgtcctcctgctgctgttgatggtgttggtgatggtggtgcgggtgtggcagttgaccagtggcactggcgccgccgacctggtggtagaactggctgagcgaccgggcgaagagcacgccaatgtggccgtcctgtgagtgtcctagctctagccccggcatggccgccgccacgtgggcggcgaacatggtcgcgaacccgatgtggcaccggcgaacgccgcggcggcagcccacatgtggtggtggtggtggtgcaacctggagagggcgcagtttggggaagggagggagggtgcgacggatgtcagcgccgacacccgtccccatggcagtgacgattgccggctccgcctgctggagcagccactggacggtttcaccgtcggacttgtggccgagctcccgcgttagctggaagatccgggcagcacacaacgccggcatccgaatccgttgtccctggccgtccaccttggtgtgccggtccttgttcgagctccgcttcggacctagcccctacattcttcttccccccccccccgacgccgtcggcaccacctgcatttgttgctgctgatagcggatcctttccctttgggcgtgcccttcattcttcgggcgtacccaatttttcggcccttcggggctctcctttgtccgaaaaagaaaaaaggtggaggaaaaaagaaaattgttgaggaaaacgaaaaaataaaatgccctttcatctgtggccccttatggtatttgtt

SEQ ID NO: 3736 - DNA, 4873 bp, Oryza sativa
  unsure (1)..(4873): unsure at all n locations
gaagaggcccggcccacgacgggggtaagtaagaggtgagacngcaaaatcctcctccccccccccccggacgccgccgccaccacctgcatctggtgctgctgaaagcggatcctctccctcggggcgtgccctcgcatcctccggcgggtccccacatcttccgcccctccggcgcctcccttgtccggagaaagagagaagggggaggagagaggagagtggtggaggagaggaagaatagaaatgccacttacatgtgggccctcatgtattttttttaatttttttcgatgactaggatgccacgtcagcaaaaccactgtcaaaaaccactaagagagttgttttgtactggttttaacacttaggggaggtaatatacccagttttgcggttgagggatgtaattcgataaagaggaagaattgaggaaggcaaaatggacttattcattcgacagtatgtccaatatgaactattctggcaggggaatacctatgcatctttcgaaagatttttatgatgatatcacacagatttttaatctttagattaaaatccaatagacacagtagaaggcaaaaagcaactaagaaacaccataatagacactaaattgccatatcttcaagaaaaagaccaaatccaatataaatttcaaaacttgcatgtgaagattcaaaaattacactataacttataaaagttacaatgtaagtttcataaattacagtgtaacttgcaagaaaatacactgtaaatttgagtgagagataagaaaaaatctctcgagtgagatatagcaaaatcgttcggggagatgatcaaactgaaccaaatttgcttctatccgctagttatgtcagctagcttttcacagcggtcaatttgttcctatccgttgtccgaacagaggaggtcccccgttggtctcgttcagaacacaatttgttgtcaatgcagagaaggagaagaaacaaatgagcagtgatatctcttgactttcgcttacacatagatagcaagcagtctagttgtggaccaatccggccttctgcacgcatacagtcactcacacgctactacgctatctttacatggagaacatatacatatattgcgacatagaagtgcatatgacatataattagtgtgcacatgtgtgcatgctgctgctgcatgcagcgctagattattcgttcgcagcaggtagcgaagttgtgtgatcagttttgtcaggcgtggtccggctcaccaggaagagcagcgagaacatcaggaggagcagcgaatacatggcggtctatgtcgtcaggtggactagcgaacacttggtccggatcatggtctacgtcatcatgggggctagagaacacgtagcggtggtccggatcatggtctacgtcatcagggggactagagagcacgtagtggccggcgcggagaggcctcggcagtctggccgccgccgtggtcttgcagccgtcgtagcactgcccgaagcaggcctccacggcgcccttgccgtctgcaaaaccaaaccaagaattagttgccgccactgatgtgtcacgatcaaattaaagttattgcgtgcttagttacccggaaggaggcggtggcaggagcccaaggcgcaggagagttggcactccatgtcgccggcgaggcgggacgacgacgacgacgagtacagcgtgggcttgtccggctggcacgtcttgtcgcaggcgtagctgcagtagtcgaccatgttgttctccctggccatgcagtccttgaagcagaagtcgtagcagtcggcgtccgcgccgccggcgaggaatgtcagcgccaccaccacggccaccgcgccgagtgcaacaactcgtcccgtcgtagtagccgccatcgatcgcttccaactccggacttccctgccacgatcgatgacaccggacgctgcgggcgccgcggattttgtagcgcgcgccgcgggcggctgatgctcacgccgggcgcgtgggcgtgggggagcgcgcgcgtgaaggcgagagtgcaagcaagcgagcgagagagcgagcgagttggtgcttcgatcgagtgggcggcgccgcggtgtgtgcgtgggtgtaagcagtgtgtgacgcttgcgggcaacgggcagcggcgcgcagcggcagcgcgtacgtttgttgttgcgggcggttgctgtgtcggggttggtgtgccgttgcgtggcttcgatcggggagggagcgcggttgcagccttgcaggggcggaaggcgtgatatgggcggccgttttcggtgtaacgttaaaattgtaaggcggtgaagggattgaaatcttggattacggaaaaaaaaggaacgtggagatctaccggcgaaaacagaacaaactcaagaaaatcgatggctacacggtacaagtcaaattgaggatttgccggtttcctaagcaactgccgagcaacgggaaaaaatcgtttataggtggcaaacaattcctttttttcccccaattgcacggcttacccacaccctcatatgcgtcccgtaacatactctcaaagaggtagatattcctgactacgaggatttgaaacatagtgcatggagtccaccaggacattcccaacccaataattagaatggtgtccatagtattaaataagttgtcacctagaacaaaaaatgacatggcaagtgaataaatgaggaaaaaaaaggaaaccatgtcttgcatgagacatggtttctacataacatccaagacatcatgtgagataagtagcattaaattaaagtatggaatagtggtgtttgcattggaagagtagtgtctagtactagtttcttgataatgtggaatttatggaaaccatgtctagtgttatgggttgagactgctctcaccgcacaattggtgctcccttgatggcaaacaatttatttggatgagaccttaagttcggtctcgggaaaaagttatggtagtactacatcactcgatttttttaaatggtagtcctggccggcatgtatgagctttagttatgaagatttaatagttgtgtacttgtgttggagaaaaccttgtactccctccctaaaataaatacaaggcgtgcatgcatttgaaaatgtcgtgtttattttgtttactatcaataagcttacaatatactcctatgtttagtgccacatgagtggtaccgttggatttatatttgaatatacttttttgagtgttaattttgtagatgccgatgatatatatgaaagatattaatgatcaaagtttgacagtagagaccgtatcaaaagattgatatgctttaggtttctcaacaggcaaataaaaatatgcaagtctgaactcaaaattatgaagtagggaggacacaaaaatggacaaaggccattgtaattttgatccaacggaagctatgtactaaggtgaaaaatcgaagtgtttaatatccctcctttcctagaccccaagccatagcccacggcagcaagatgaaaaatcaaagtgtttaatatacctcctttctagacgtcgcggccatggcccagataataagtacctcgacatataaaaaacttagtgtaaaatttagatacctgaggtactttctctctcgttgcatagttaaatgtcttcagtttataaaccacaacccaaaagtgccttccaagcaagcccaggcccggtcctgtcaatttagtggcctagagtgaaactagaaaaatgggccctttaatccaattataataatataacgatatttctaataaatttaatgcataaaaaaatattcttataaaacaagttatatatcttaccttaaaattttcttctaacatttaccgatgcgaagtcattgacgatggcatcaatatcaattactcatcaatagctcctttttttcaatgtatcaagtcctctatccttctcttctttttttcttttctcacttccagatgcgtgctttttgggcaacatgatttcactgtaaatttagaaatttataagtaatttatggaaattatatcaaactaaattcaattcatcattataataaaaatgagtgctggtaaattatcaagttgagatttgagagctagagaaaatgactattcactgccctagttgcacacttgcacagctggactgtaggatccctaaatcccaaaatcagaatttcagaaatcagaagagaagcaattgaagagtaaaatttgaatcccaaactttaaacatatacacttagtatacatcaaaggggagagcaattgggtacctccagtaactgaacggagagatttgcatgttgcaaccggctgctggcggccgccgaggacgacaccgtcgacgcgccctaaaccctcgcccagtcgcccctcggaacaagacgaggaacagaggaagggcggcagaacatagaagtagcgaacatgaggcgatggcggaaggaagccaatcgacgaaaatttcttcctgtacgtgtctcttcctctcctgggctagtttgggctaatgggcttcctaattcccatgggctattatctacagcatatatggggttgggccccttcacttcgtgggccctgtgcgaaggcacagcttgaccccccccctcaataaaaatataattgtttttaatcacttatgtaagttcgctccatatatacgtgtgtaaataaactgtcttactactctacgtagtcgttcggaacttagatatttaaggccacgtatcaactgtaacgatagcagcgacatgtattacagtaattaaatgtaaggtaattaaagcaaagaattggtaagtaactcacactaaggtataaggaatgtttaaagatatctcagca

SEQ ID NO: 3737 - DNA, 10220 bp, Oryza sativa
tgcgatttgtatgtgaaggaggattttttaggacaagcattgggtttagggcaccttaattgtgaggggacctttgtatgaggtatttttataaacccccccccccccccccccccgggccaggcctgagcaagccaaatggaccacacaaacatgggcttatggagaaaacacaaactaggaagcttttggcgtttttccatcttagttcaatggtatccacaagaccacaatcctcatgtgtgctcttaattagatgttactgattgaatgtgtgctcttgtatgatcatcacatgtggtatatatccagttgaataattcgtcttatagttttagatggattttccatcagaatggctttttcttggtgaggtctatatacctagctttaattaataatggctatatcaagagaaataaggtcctgtatagatgggactaaaacttttaagtccctatcacatcggatgtttgaaaattaattataaatattaaacgtagactattaataaaacccatccataatcttggactaatttgcgagatgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaagtgtatttggaagcttaagttgtcacttaaaattaaaattttcgtgtggtacttgcttaaaagagttgtgttaactaaggataatttggcaaggcgtaactggaatggcagcttgaggtgttctttttgtttgaagaatgagtctattcaacatctctttatgaattgtcattttgcgaagttcatatggagagcagttcagttctcttttagttttaatcttccagttagcatatctcatatttttaatgggtgtcttttgggagttgataagaaaaagagtaaactgatacttgttggagcttttgccatttgttgggcaatatggctgagtaggaacgatatggtttttgataaatcaccatcattttcctatatgcaggtcattttcaggacaactcattggctccggttttgggcacaactacaaaggtatgatgaaaatgaagagtttctgaaagttgcatgtcgaaagtcggagactacggttatgtaactttttactaattatggttgaggatttacaaatcatatcttactataaagttatcccccactaactccttaagcttaacatgcaaagatgccacatcatcatccactaacatgatgccacatcatcatccactaattaacaagatgccacatcatcatccactaacaatcatcacatttaaacatcacgcaaacatactatatctttataggttttataatttaagagcttttcaaatacaaacatgttaaattatcatccaacataattcacacaatgtttcaatgtatatctttattatgttttattatatcctatatacttatatagttcattaaatgattaatctatggtccaaattatctttctcctttttttctctaattaagtcatatcacattaattgtttttaacctttagatgattaatctatggtccaaactatttccctacttttcttcttccatgaagtcacaccaccttactttttacgtttgaatcaccattttacatactatttaaatttaaattatcataaaccacttaatttacttaatctgatgttatctagctatcttacacgttattttttttattgttatcatactaaattcccgcagtaatgcatggggttttacctagtagacttgaataattgtgatcaccttaagttaggctggattctttgttattctctacggtgtgttctattcatttggatttacactgtcttcttgagtggtactatgtaataattggctgtagctcttttgaataaaggccgggatattatattccatttttaaaaaaaaatgtggtacaaggacaacaggtttcgttgttttctgctaagattatcatgtccctttttatgctgtaggacaataggagacatttggcatcccttatcttgtgtattcttaggaattggtaagctcgcaaaactttaaggatgaaactgggtgttaatcacccgaagattaatgcatacgtttcttcgacttgcacataggatcgatatgtataagtttaatttggtcacatataataacgagaaacaaaaaaccaagattactaatcctgggaaaaagaaaaaaatgatcgcaattcagtaattaatccactaagtctctgcagtaatccatctatctattactagaaaaaatgcccgtgcattgcaacggaagaaaaaaaaacttatctcaacttcttaaaaaattgaaaacgttaccgtcgtccgtaataatgaaaaagggaaaaaacattaaaacaaaaaaaaaggaaagtccgattcaatttgcttccgtcgtccgtgaaaattttcgtctataatatcaattcttcgtccgtaaatccgatggaaatccaatcggacaatccaaacaaagagaaaaggaacgggaaaaataataaaaaacgcacaactcttatctcaatcctgtgggaagccgtcgacgccactaaatccacccgtgggaagttgccgtcgccgctggatccgcctgcgggaagccgccaacgccactggatccacccagcggaagccgacgctgtcgctcgcggtggggggagggcgccaccgccgctcgcggtggggaaggacgacgccgctgtcgcaagcggtatgagagggcgcctccaccgtcgctcacgcgtcgtcgcagctcgctcgtcaccgggagaggggtttgggagagagaagaagagaatgtgatgtcatctgtaaaaaaaaaagcaacaaaaaacatgctaagaaaaactgtcggaaagaaatgtgccatttttaaaaaatggttaaagaaaaccgcgcatgaaaaaaacaccgtttataaaaaacaagatgcttcgaaaaaaactataaaaaaacaccatttataaaaaaaaccagatcgaaaaaaatcatattcaacgcgagaaaaaactgttgtttctaaaaaaggttcaagaaaaccgtttgactcaacacgagaaaaaagaaccaccatttctaaaacaaggttagagaaaaccgtccgactcaacacgagagaaaaaaatgtcgtttataacaagaaccgctccgaaaaaccatctgactcaacgcgagataaaattgatggacacttgggttggataggatccatcgattttttttttccatctcctacacggtttttgtttccttatctattctccgaccttgcacgtctctgtatgtagttatcagactatttttgttaagtatagctactattcttgataacatatgatatgaaaataatactaaaaaataaacatatttttaattattatttagagaagagtgcacagtgactctattttgtgtagacttgaccagtggcgaagccaggataaaaattcacctatggcgaacttactacggactaagtactagtctagtactctagttgtataagaaaacacacatacataataaaataatggtacaatgcattaattaacatatagatattgtaaaataatgataataagtggatatttggatgattatagtatataaagaagcactaaccaatctgggtagcttttgaaattgggtgcagtcggcgtcggcgattattagatggctcttcctcttccatggcgcaatctgggtagctacagatattacgagctagtttagcattactactcgtaacaactgattgtctgattcaacaggatatagttgctaatgtgtgagagatcgatggaaccaactggtgtatcggagtgattaccgtggcggcgtccggcggtgtcccggcaggagacgattcgactgtcgacgagaggaggcgatcagccgatgcgatgaggcgatgaactgaaactgaagcgacgcggcgacggcggcaacaagcgattgcgattcccagtcagactcccggctgtccgcctcctagtattcttgggcggttgggccaatgggcctgcttcgttgtccacatcggcagcaaacaaaggcccagcaaagtagcaaacatcagcgcacaaagaaacgaaacgtttctgcccgctgctcgccccgcagcggagttaaggcagcggcacaccattgccatagacaacgatcgtaactagatctactgagtgccattgtcttcatcaccctcctggtagtaagcgtagagatcctccgaagcttcatctccgacctctgattaagtttgtatattgcaagggtgagtaccaactcagcaagccaccatagcaacaatgcacatgatagaatgtatttaaggaatagctgtggttcttttgcgtagagcaagttttgcaattcttttcagaagcctaagacctagcatagattgatcaaattttagccactggagttgactatgcgaggcaatgtaagatttaattgattctattattggttgtaaggatgagattaaaatagtatttgtttatttgtgcttgcttagattgtttcctataggataccctgatcttgaagtgttagccgttctgatgttcgtgaacttggacatgctgtacatactttgttggttgatctcattgctcaacatcagttaatgactgaaaactgccatgtcaaattgcccattattttaggaaagaaaatatgagccacctctcatacaagagacaaccttcacacaaaccctaagaaaaaagagatggaagaaagatgagattggacaaactaataaaataaaatcatttgggttagcatgctaagaggtagtatatatgtggtgtattatatatatcacatcttattttatatggataaaattagatgtgacaactacccctagtataaaacttgcccttatgttggcatgagcattgtgtaacccgtgcatcctatttagagttctttatgttgatattttttattcctaaatttattttctagattcttttctccttaatcattccaattatcatcgattgaaagagggcaaatttatataatttcaaggcaccagatagataccactctacccagttgggaagcttctagaatctgttagaggagatgttttcttttctctaattttttctcttatataatctctagatttatctcaaagtattgattgattaaatgattaattgatgattggctcatctcatcactcttgcactagttaattaatgcctgaaaaataccatgtcaaattgcccatcattttaggagtagcatgctttccatgcttcagtggttcagtgaatataacctgctgattgacagcatgattggatcctgtctcttttttggaccatcccatgttgcatcacacttgtgaaaactccagataccaccagaaatatccgtatcatctgacctggtactgataacatagttaagcaatcatatgaaaatcctgtgcattttccttttctccttgacagatatggctgccctgatattgagaaaatcgagagtttcaataaactctacaagcagaaactggatgagataatcgaacaaggcgaaatacccctggacctggatatcgaggcaagtcacccaatcaaatttcttactcacattcctgattagttgcatctgcatttcagagcaacttactgagaaccgatttgctcatttcaggtctcatcaccaggagcagagcgacttctagaggtgcccgaggatctggatcgtttcaaagatatggccatcagagtgcaataccttgttgaaggcgacgaccttgtcctgaagcagatcctgcggaagaatggcatcttcttgctcaagtctgttgacattcaggcagaacattgcatcaggaagcttggcagatgtcaaggagaaccgagctgcagctgggaaaggaaggtcattgaacaggaaacaaagggattggaggctgcaaacttcgtttaaagcggtgaagaaggcaaccctatacttggactaaaatatgatggcatatgtttggatagcagtggtttagaaccaactccagtattagtttaaattgggacgaaatctcacatactctctgatatacttgcaatgctggcaaaggatgttcagttctgtagttagattagggtctacttgatttgtggaactgaatgagttttgtggaggcaaatttcgttgtaaggcacagttatctctgagttacattctgagcagaacacagaataggatggcagatgtacgttctatggaatcactcattttgggtactgaatttttctctactattctcttctggagagtgatgaattctctgcagttgactgcatctgaaagctgttctcatgcaagtgttcatgatttatttatttattattcatcagtacattgttgtgcatgtttgttctctcagtcctcacagtcttacactaagctccacgcttagttactcctcttgttgagaaaccttgctgggctgaacggcgagagatcgaagatgctggcactgccgttgaggatgagctccgcgagcgcagcgccggtggccggagcgttgaggattccccacccgccgtgcccggtggcgacgtagcaacccttcaccccaggcatctctccgatcaccggcaacccgtcactggtgcacggcatgtagcaagcctgctccgccaccacctccgcgccttcctccctcttcagctggctggacaccctcccggcgatctcgtgcagcgccgcgatcgagtccggatcaccggtgatcgtcgccggatcattgggcacctcttcgtccttggttatcccacaaatgtacacctccccctggtgcaacacataattcaatatattaatggtggctagttagttcacatggatcgatttagcatttgagattaaggggcagtggcaatggcggtgcaccggtgggccgcgggtagatctccggggcgagcatcttggcgccgggctccggttggtagctgaggaacagcgcgtgcggcgtcatcttgtcgggctcacgcggccggagcacgacgctgtgccccttgagcccggacacgtcgaacacctccctgaccatctcgaacccccgaccatggcccgagcgcgaacaccacggcgtcggcgtccaccacgccgcggcccttgacctcgaccccgatgacgcggccgtcccggacgacgacgcgcttcacctcgccgatgaccacctcggcgtcagacgcggcgaggacggccttggtaaaggaacccgggtgaacctgcgcggtggtgtccgctgtcgcgagctcccgtggcggcgcggcggacgcggccgggtcgacccaatgagagagcttcgggtgcggcgccggagaggcggcggcggcgaggtccgggtgggtggagactggggtgccgtgtggcaatttataaggaaatattctaattgaaatggctatactgcccctgtccgtttggcttgcatatatggacgcggcttgccttgctccatcctcccatccgtactcccgcatacgtggcagcatctgctccgttcctagcttttttccgttggcccacacctgaagtacgatccctgtaaatcccgtgaatcccgttccaccaaacaggaaaaaaaaaagcggacatttttcttcctctcccagctacttcctcttccagactcctttatccccttgctgtttcccattgagctccacatatgcccattagttgccagggaagataaatctaatcctcatagttgatgcgtcagaggcggcccaaacgagaaccgcgccctggccgagccagcggccacggtctccctaaacaagtcgacgataaacaagagctcgttcggtggcgccctcaagctatggagcgacggtggtagtgcgtggacgagttggcgagctggtcggtcggggtggacgcgcgggaaggcacgctgggcgtcgtcgaggcatgcagcggccggagacgacgttgctattgctggtagtcctgcaagtgagcagtacactagcatggatgtgttatacctactgcactgcaagttcgctgctgagtaaaatccgaggttaaacgagagaattgcaaagaacacgagtaacttatcttacgttttaagcgtccgatgcatcaggtatgttggaaacaatatctgtcgttccttagtactactattttggggtggatattggtgtcctgatggtgtatgattaagtgaaaaaaaaattgttggggatgatgcttctgttgaaatagagtctagcgactaatgttggcgtcaagtgtaaatattatccatccaaaacacattcatatatagctataattaaatggttagttacctaatggatgatgataacccaccaataatgacggtattcaacgaatcgtactctcaagtgtgggacaacggaaaaaagctacgaacgggacagatgccgccacgtatgctgtagtacggatgggagcagaacgagggagcaggcaagccgcgtccgattgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaacagttaagtaattaaacaatattaattccaacgctatacaacataccctgttgtataggcccaaccattctgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggtttatctccgccacttctcagtctggtgccccgcaatgaaccatgctatacaaaagataaagccgttgcccatgctggcttgtggttggcacagttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcatgaaatattagtgagtcattagttatcccgaatgtgtactaatgtttctaagcagggctaagcaattatatctaatatctagttgaaccattataaataaagctcaactagtcaaattgtaataacccaaggtatcaaggaataaggtaatcaaatacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaattgatgaactactgtaccagtgaaagtgcattcaaggctctg

SEQ ID NO: 3738 - DNA, 1343 bp, Oryza sativa
  unsure (1)..(1343): unsure at all n locations
agaccgggcgcacgggctacggttcacaagaacggacggccgagatcgaaccaatccaaaacggacggccgagatcgatcgggtccacggcggctcacggcggacgaccccgatgacgtcagcggtgacgtcaccgacagcggcggcggctcggcggagcggacggctcgggcggcgcacactcaccggcaaacggcggcgctaggacgcaaacggagggcaccaagatgtagaggacaacacggcgaactcaccggtgaccaaaacggcggcggaagaccaacagacggcgacggcgacgaggaggaaacggcgggaaccttcgggtcgacaacggcgaagctgctccggtgatctccggcgacggcgaaggggcggacgaggacggcgacgacttggcgagcacgacggtggtcttcccgagcgacggcgacggctgaaacgacgccggcgcacggctggagcggcggcggcgacggcgaagctagggcacacggcgctagagcgattccgacgactagaagcgaaggcaagggtggcgacgggtagaggagacaccgggggtccttttaaaggggctcgaaggcggcggcgaaggcccacgacggcggcaacggcgaaggaaactcgcggcttgaaggaaagaggtcgatccgaatcgaactcgattccacgaacttccaaaacgatttagccaaagattccaaaggagaaaaggtagaggagatcccggagattgtttcccctcaaacaattcggccggagaaggaaaggaacggccggatttggaaaggaacggcggcggcgcgaaactagggtttcgggcggcggcggccgaaggtagacgatgggtccgacaggtgggccccacctgtcagcgagcgagggcgcgcgcgcggccggctgcggactgggccgaactgggccgaggagagagagaggggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaacaagatcttctcttcaagacttttaaaattatttctagaaattccatttaaacaacaatttataaattttaaaattttcagggtgtgacagattggctttggccatttggtggcagcaaggagctagcttacatttttgacatttcaagctagacatattgatgngctnctgtgcgatctgcaatcaatgcca

SEQ ID NO: 3739 - DNA, 7471 bp, Oryza sativa
  unsure (1)..(7471): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctaaggttaggcgaacaaatttggcaccacactttagctaacaatctataacattgccacatttttctaagataatgacacgtgggaccagagtgctagaaagagaatcttgccacaagtgtggcaatgaaccaaacgcatggctaacttagtcaaaaccgcctaacttgaggtgtggcaaagtgtgacaacatgtggtcaccaaccaaacaacccctaaatttcataaaactgcaattgttttgtcaattgctacaattttagatgggaatttcaataaactgcgacaatagcaaatgattttctttttcactgggctgactgaagatagccgagtaaagtttgttaagaagagagcaggaacagaggattacaaattcaacaacagagttttataatgcttaattgattataaggagagcaattcgacgtcaacaactacgaatggagctagcaagatttaatccatttagttgtacaaggtagcagaaccaaagcataaactgtacaaactatgataaacatgctcttccattccttggatcacggcctgactctggctggtcgcagtctttccgaattctgacgggcaacgtttaattcttgcgatggtagccttctatggaaaatcagaagacatggtacacctgtaaaacaaatcaacaaaataataaatccaagccatattagaaatggctaaactattatgcttcttcaaaaggaagtaattcagctaccaagggaaacaattaaatattaaaattgagatggtttgatgcactattgcctgatagtacaatcagaaattagttgattcaatagctcatcaatccaaaaatataatgaactttcaatcatgtaaaggccaggttttatctaaaaaaattatccttcaatcatatccaggtcaagtacaaagaaacactatactcaatgttctgccccgattacccagatactatactcgtctgaatcataactaagtgaatccatcagaagtcagatgcctcacatcatattcagcttgaagtgcaaatgaacttagcaaatgcccaaaaaaacatatatacactcttacagaagcaatgcataaacatcattgaagagtgccctgcaatgcagaatgcaccgatccatctggccaacacccaacatgggttgattgagactacaaaaaatcagcagaacagcatactgaccagcagctgattaaatgtaatagtttgcagcacacagccacaggtgcgaacagtagggcgttatcaacacagttggatttctggtatgttgttcacgtggattgcttacgttgctgaataatattattagaacaaaactttggttggacattcaatattgtatattctgatgacagtcaaaagtggtctagccatctaattcttaaatgcaagatcatggatgtaggtacatcattttcttgctgcttgcagcagtaacaaaaaattgcagcaacaagatagagccaattttcccaaggtatactaagaaccaacaaaagctactgcatactacagaagtataaaaggtgcaagtaagatctacattctgcacgatataaaagttactgttaatatatctccctctcatatcttgatggtcacaacaaataaagtttgatcatatcacacgtcagtaccatggaaagaacagtttttgaaatcaaaaggctcaaccattcaatgcaaggaggcaggtttatccacagatcagcatggaatgccataggtggagcttagattataaatgtaaccaagattgacttcagcagaaatgaagtgtttattgattacaactgccgcagccacaacagcttcggcagcaagacgagcaagcaaatgggtcactctgcaacatgttgctggctctatggaaattccaaggataagacttgtcatgactctccacaaccactgtagcatctgcagacacacacccttctgaagacaaatgactcagcacgacaactctagaggaaccatcatccacaaaaataagcatctgctccaacatttgggctcttcccattacaaactttacaaatgccagctcactgtctttgcctcgagcagcttgaaacacaaacttcctcagatgtgaatggacacattccgtgtagcctactagatcccagaactccactccaacattaactggtgtctcagaaggaactgactgtatttcaggcaaacaagatgattcagtcaacaggagcacacacatattacaaagtgaataatgcagtggcttaagattagtaccatgatatacaatgtttctaagcatgggaagcatctaagcaacaggggcaccagtttcacttgctcctcgacaccaaactgcaccttcaacgccaatgtcctgagggtccgaaccattgcacttggcttcacctttatcccatcctacgacacaaaaaaaagcagttacacaaatgcaatttcacataattgtgaaaaacagcaaggagctgccacaagaaacagccagcaaccttgatgacagtagaaccgatcttgagctggtgcagaccgacatcgaagtacccaagaacctttagccttggcgcattgatgatcttgacgtgcgtggatgctccggcgatcggctccagaagcagccgctccatgttgggggcatcatcgaggtgcacctctctgaccatggacatccatagcaccacgcaccggaggctccccgaccagatatggacgtatcttgggtagtcctgtgtaagcacgagcgcgaggctctcgagctcggggcagcgggggagcacggcgtgaagctcgcggtcctgcatggaggagtggacaacaacgatctcctgcaggttggcgaaggctggagggaggccggctgtgtccgggaactggcagaggccgagccagaggcggcggagggaggcgcagccgaggagatcgggtgggggacgccactcgatgggccatgatccgttcacgacggcgagttcaccgacctccttggcggcgagggaggcgaaccaggacgcgacgacgtcgggatccacggttgccaggtgcgcggaggcaaggcgcgccaaggcgactgggcccgggtgggcggcgagcgccccggtgacgtcgcccggagcgaggccgccgtcgtcaaggtggaaagggatggaggcccaaacacggcgccagcgggaaggagatcccggcggtgcggccggcgtccttggtgggaaggcgcgaaacgaccctgcgaaggagcgcgtcggggagccggctgatgcggtcctcttcgtccagcgagaagacggcggccgcgtcggcggcggagggagaagaagggtgagagttcccggtgaagaaggtgggaggcgggaggtaggataggacgacggcgagggtttcgtccatggcggcggctgcggcggtggtcgacggcggcggagggaggatggcgagttggtggggtcaggaaagggaagcggtgaaatggcgtgacgatgagtggtatgggccgaaaagcccggcattggtccaacaaatcgaggcccaaatagtgtgggccttaatccaaggccatctatatatgggccgaaatttcagtgaaaatcctttaatggatcaaaatcttactacttgttttcttccggcaaattcaaatttaaaacaacctacttggaattcaagccagataaccaatcagggctcccttcatatttgactttttttcgagacaccttagaattgtttgacccgtatttgtacatcgttatctaaattagaacatccttcgtagaaatgctttcgaacaaacgtcctaagaattcaaaatatcggatccttatccgaaaccgccaactaccaactcaatccttatccgaaaccaccaactaccaactcctccaccacacattccttttttttatctcttcttctcttttgctctatctctatcctcggagcttcagcactaccacgttgtcagaagtcgggagagatgacgaagccatcgtcgccggtggtagtggtgatggggtacgtaggacatcacaggatagggatttgtaggaggcgttggacctcaccgccttgccgatggccacactgcagtcatactgcagtagctgagcaagacaacatgaaatagggaggagacgctcgacttggcatctgacggagatcaaacgcggacgcgactggccctggccaaggttgcccgtctcacgccgtagctcgtccgtgtccttccctagccaatacattttccccgccgcatcattcactagttccagtggtcggagtagaaatagatagaggtgggttcattttgttagagtgtagtgatgttatactttattgtattaaggtgtttcattttgtttcgattgaatgttgcatgtatttattcttcgcattgcaattggtatgtttcgaatattgcatttggttgaaacacttttgttaaagctatgaaacattttcctccgatcgatgaaatgtataacattttcattaagtggtgtaaaatgtgaaatattttacaataatatagggtaacactgtccgatgttgcggacatcaagccatagtcggctcccatccttcatccttgcttatatgtagcgaatcaatttgcttattccaatcagagaggttgcgttgtccaagacttcgaaaatgtcggcttgcaaacttgtctatcacatatagcaacctgacagtatgtgtgatacaaacatatctggatttatgggatgttatgatttgcaataaactatatagtacaaacgaaatatccccgtcgctaaattttcccaaaattaatgaaggacaacattaacttttattctctccgtcccgtaatataaaggattttgaaaggatgtgacacatagggatgaaaactgtcggaagcctcaaccatttccgtaatcatatttttctcggaaacgaaatcgaaaacggtgaagtcggaaaagaaaacgatatcggaaatatcgaaaaaccggaaacggaacaatacggacggaaacatgtcggtacagatcggaaaccgataacaatacggaaacattaaactataaaaacatatattaaactttacataagtatgttatatgtatacataaattcaagcttatactatataaattataaattaacttcgttttagccatgttagagatttgattgaagagtcagtcaatgtgtaagttgtgggacatgccctataaatatcaacatatttagaatacggtaattaccatattataagaaacggtaattttcacaagaatatggtaaatacggaaacgataggtataacaacaaaaccatttctgtttttatttccatatttttttaccattttcatttttgtttcggtcaattaccatttccatatggctcggccggtagaaagtcaaaaacgaacgctggtcggccgggaattaccgttaccattttcacccctagtgacacatgtactacgaattcaacttcatactccctccgttccctaatataagggattttgacattttacttgtactgtttgaccattcgtcttattcaaaaaaattggaattattatttatttatttgtgacttactttattatccaaagtactttaagcataactttttgttttttatatttgcataaattttttaaatagacgagtggttaaatagtgtaagtaaaatgtcagaatctcttatattaggggatggaaggagtagtattaaaatatatcacgtcccttcaaaatcccttatattttgagacgtatgaggtacattttccaaatccataaacgattaatttatcgaatttaatatgaaccacgtacatgacgacccaaacacgaacatcaagtaatcttatagccgtcgttgaccggctggcaccggttaccggccggtaagcatggaacaatggaagtggcaagtggctagctatctacgtggccacatcgatgtcgcccttcacctccacctcgccgacggcggcgaggctgcccctctcctccatgacgatggcgacgccgccgtccttggcggccgcctcctcctcctgggcgagcacagcgtcgagtatccggagcatctcgtcgggcgccacgagctgcgggaagtggccggccgagtcgacggtcaccaaggcggcgcgcccgatgcgcccctccatgtagcgcccgacgcacggcggcgcggcggggtcgccggaggcgtgcacgagggtgcacggcgcggcgacgcggcccagcacgccgcggttgtcgccgaggaagatcatgcgcgccagcgcgtccgccacgcgcgggtccatggcgaaaaaggtccgcgccagcgtctccgcggcggaggggttgtcgccggcggcgccgacgatgagcgggacgaagcccttggcccaggagaggaagtccgacgagatggtggccagcatcgcgtcgatctccggctcgtcgaagccgccctcgtagtcatccgagttgatgtacctgcaaacaaaattaccaaagttgaaaattgtaatccggatggttccttgcgcggaattaagattgaaattaagaaaaacatctagattagaagtcgttaatttcatcattttgatctaatctaagcacgcagctggtgatggtcaaccactagcctaataattatataagcattttaagccggcatagacttcagataagataaaatgatagcttaattccatggttaatttattacagttacgaaactaaatatttgaaatttcagggtctactggtgggtactgttagctagaatattctaccggttgaatgttttaatatttttttataaaaaaatagcatgaatttgttcaaattttaaaattttcaattccaaattttcggaacttcgatcacccctggtaggtttcatgcattccaaatagtaaacctggcttaactgaaactcgagatcttcagcttaactagtttttgaaactgtgttcggatgccccctttctcaaccactctttctcgttttccgcatacacgcttttcaaactgctaaacggtgttttttttttgcaaaaagtttctatacaaaagttgtttaaaaaaatcaaattaatttattttttaaataaaatagctaatacttaattaatcatacgctaatgaatcgttctgttttccgtgcgttaagagatagcgaacacaggagtggttccttttgccatgatcgaattaatgatggngtnctgtnccactggagagcattcatgcctg

SEQ ID NO: 3740 - DNA, 31802 bp, Oryza sativa
  unsure (1)..(31802): unsure at all n locations
tgaccgtcccaagacctatatttgttaaactgccgacagtgaagagaaactagttggcagaactgccgaaccaaaaaaacggataggagggctacttgcttctattcaaccatgtactgatttcgatacatacactaaactatttgagtgccttgcacgcaagtataaatgaggcagcaccctttccaatttttcctggccaccgcaatagcaatgggaaaggnanaagtgccttctccccacacccaaccactcttggattcagtggcggcatctctcactagcttagctagccaaacaagaccagggagagaggtggtgtactggtagtatattgctagtaccaatgcatctagtatttatagagccgcaagtccatatagttgtatgtctcagttcactctcgcgtgcttcgtcctcagataaaatttaagccgacatagacctcagataaaatgatagcttaaatccatggtatttatggatttatataagacaatagaataatgatattttgattgttgcatgcataaatacatggtcactagtatgagagaaattgaacataaagcaatatgatgtaacaggtgataaaaacacaaaattttagttcacaaataacctatatattgcggctagacctactaccatgcatttttgttgaaaagctccatgatcctgatgtctctctaaacatgtgattagtactgtttggtaggctaatttgtagacaactctgaatttgctgccagctaatcaagctagaccaaccacgtctgtaaacatatatatgcagagtacctattctgtgagagccaaatgtatatacatgtactagagattatccaacgttttctagtttagcaattctatgcaaaggaattataagctgaccagatacatatagatcttttgttttaattagaggctgaattaattttcactataaaaaaatatctctcccatacacgttttatgtgatactctctctccattgtctcaaaatatagctacatttttagctagttcatacagtttaaatttaaactataaagatagctatattttgggacgaagagtgtacatcattatacctatcaatgtgaatttgattataactgtgtgatgaggaacttagtacttacaatctgtggctggcagcaggagagcatgtggatcaccaacgttgccttcaacagaggacaactcgaagtggactcatgtatgggtgtccaagaatagttcaatcttccagtcaaatgattgtctttataacttgttagtataactactccctccggttatataataattgacgttttgaacaaggatgaggataaacttttataactttgaccaactttaaaagtatttagtttcaagaaactagaacaacatatatagatttgtatttcaaagcactataataaaagtaaacatgcatttatttaatatatatatatatatattctaatagaaaaataaggtcaaagatatattttgtagaccgtgccattgtccaaaacgtcaattaaaatgagaccggaggaagtacaagtttgcattcaacggatgtcatcatgtctagttgcatttaacacaaaaaggtatctacaaggaaatagccaaaatgtgtggtgtggagtggtctactttttttcttatggaaaaaaaatataaattagacctaattatttttttgacttaagttagacctaattattaatatattaggaataatttccacaaataattaatgaggaggatcattctagaccacggtacatgactcaaccaaacaagcaagaacaaaccacctttcccgtcgacacggcacacgttctcttcaacaaatagtatcaacagatatatacagcgggtataaacacgtgtcattttgagcatgttttaagtcaaactttataattcagcttttaacatcagtatctttttcaatatttaattagatttgatgtaggaaaaaaatatgtgtagatatttgctccaagaagaacttccaaaatagtggcggagccaagaatttaacccagtgggattaattactactagtttatatttcagtggggcaatttctctaatttttctgaacttatacataaaaatcaagatctataggggtgttttttaaaaagttgtgggtcaaaacacatcatacatgctaatctttgtatggattatctccgatacaatgtgcaactagaacaacgaagtagaaagaacgtatagagagagagagagacaacgatgccatttcaatgcgatatattgcattttcatgaaactaacatttatatattgacatgcacatataaatgatgatttgcatgtatttgaatgaaccccactatggtcgtaaagaacaatagagctttgtggatatatgtgtcgcgctctgctagctggctactagctaggaggatcatggaaaagtggtagtttgtcgtttggcagggaaggtgtgaactgcgtggattccaaatttgcaatgtcgatatgcatgcactaataattagaaaacaacaaacttggcacatgcagcgctatcattgatctccactggtgcttactctaacattgtcttaattagacaaaaaaactctgcataattgtagatatcaagctatatatattatcttactttgctagtcaaacctagggataggccggatatgtttcatttttgcattatctgatgtgattgtacgtgttgttgaagcgtggcgcatatgtgtgcacctccgcgatcgctctgtcactcgtatttcttaaatgttcttataagaaggtactgaatcccttgatcttgtattaatgttttatacgttttggtaccttcccgtgagctgaagtatcgatgtatcacgttataattatatatcttactgtaaaaagtactccctccgtttcacaatgtaagttattctagtatttctcacattcatattgatattaatgaatctagattaatataaacatgtacatatataggagttttttttagtgctacatacatttttttatttcatctattctatcagctgatgtttttgccaaaattgtctttgtccaacgcgcgattagttgattaaatcaaaatctgtgacccctcttttctttcatggcaggtcagattccgataagaacgcagccacataatataatgatgtgtgcacctcatgatctcaaggggcaagatatgcacaaagattttctaacgatatcttattggtagcgatgcatgcctgcatagtctaatttggagccaaaaaggtcatccatggatggcaccgtgtacctaagatacaacaaagagatgacgttcacaagttgtacaactgataggagtagtagtagactggtcagagaggaggagctgggcaagctaggcaaggccagtcacatcttcatcacgtggacagcttgttcatgttcgatcagtccagcataagcgtccaaagcttaacttttcgggcaattaaattagtagtcggcatcaacgtgcgtcataccatagtcatatgttaggtaactactctctcggttcttgacctagaaatgtagctacatcttagaatggacgagacatatattgaattgaatcgtgaggatgctaaaaataattcggagtagctagctagctagatcgaacttctgtttgtgtttgtaactacttcgttttagcatgtcattataggtcgaagtgtcgaacaaaagaaaagtttatctctataacatgtagaccacaggtgtatggcatactaccaaacattattgagctaataagctgatcaaatcattgatctgacacgaaatcgtagcacaacgtggctaccaaacatatatactatcccctttgtcccaataaatttatttttggttcctttccatttatctcaaagcaagtttatttttagaaactattatattagagtttataaaaatagagaataattatatattgggagtaaataaaataagaaataattgtactgtgatttaaagtaaagatattttatcctcttcatttaaatttgtactaatatataggtataagataggtcaatattaaacttattttgagacgaaggaacacaccctttataggcgaccacgacgcacaactacaccacaagcagctgatagcccacccagccatatcaggccgaccgccgcgccgcctgtcgcgtcaagcttatagctacgcgacgccgccgttgctgctgcattctctcttctcagtcttctctccactccctccgcgccgcccctcgccccctcctccctcgcagtcgcagcctcgcgtacgtaccgttgctgtgtttgcacgtacggcgatgcgcgccgttggcgccttgcttgctgctgcatcttgcctgccggccccgcgcgcgcccacctgccccaccacctgctgcatgctgcgtctaccgcgcgccacggtgacgcaccggcttgcgcaacaacgctcctcgcgatgcgtacgcacaagtgatgtggctgccgcgtacgtgcgtgcagcgtgcgctctgctgctttcagacgacgagtcgatcgatcgatcagcagcgtacggcacgcgcgccggcgcacgcaatcctcaacagggccggcaagcggattgcaagttgtcagattttgggataactgcaggcacaaaagatttataacgggattggagattttgagcacacatttgatactccgtatcatctttgtgtgcaggtgcaggtgcagtcggcagtcgcatcgatcagttgcttaagagtcataaattaaacgtcgggccgggcaggaggattacttgcacatttttagctcgatgtgaggatccagccaaggaaaaggacatggtgtagacgtgcacgtgcaaagaatcgagggacatttattcggcggcgatcacgcgacgaaattagacgtcaattggacaagatatatctttctccttcgagattttcgatctgcttaattgaccaacgcactcgctattcatcgtgtgactgaaattagaagaagtttcagtcatatttttctttgataatatttgacggtcaggacattgtcttcaacctctaaattaattgggagaggaaggaagagagaaagggtggactgacccatggtggtgatagtgatagtgagccttgatgccacatgtaacttaaattacggtagataatctatagattagtatagggggtcgtcggcagggaaggggtaaagagacaatatggaagcgtttttagaaagatgacccaaggttttgcagagatgggtaggcggcgaggcgtcagagtcgtgaggatgaaggagggcctaggggagggggatccaacagttcaagccgccagagataaggaagaagaggcaacacgagatatcgacactggatttgaggaagaaaaggatggtggtagcatgaatccaaccaatatacgtataaagaaagagggtggtgagaagcggtagggaagtagtagttgacgtgatatgaagagtccatagtggtggcagctaaattgggagaggagagtgaagagagaggtgtgagcagtgtcggaggtatgatgcttacaatggctataaaattactcaagaatatcattattactgtagaaggtaaagttttgtgtcgaagaaatatgacataatagttgatcaaatatgctttaagtatagcactagattaaaactgagctttttgttggaaaaacaattagagcatcaccaagagactctcaaaatcaatgtcgtaattccaaatttttgatgttttttttcttaaagaaccaaatcctacaatgcccacaaaataaaaaaaaaccaaaaaaaaatgaaatcccatcttcgaaaatctcgctctccacaagtatggcactatgctcgtccccaatctgcaaggtcgcacgtgatcgtgtggagaggcaggtgaccgatcacccgaatgggcaagcaagagcaatcacgcggagggagaagcaaatgatttttgttggtagttttacagggttatccacttttttgaagactcaaatttagagtaactcttaaaaagaaaaatatttccataccttcaatactaattacagagtctcaacaaaacatttaggggattaaatttgagatagctcttggtggcgctcttatttagaccgaactacaacaaatacctaaagtgattccggcggttgaaaaatccactgaacagctgaccccgttgattaatcagtccctctatgttcttttccaccactcgctgcatttcgtccaatgcagacaatccacattcaaacagcaggcgaccgcagcgcgattgagagggggaaaaaaactgatgcgttgcacagcggctcagcccaactcgaacatctggttcacagagtcaaaaacggttttgatctgtacctggtcgtgtctgaggcaacatatatattcggcgccccgagtctttcggactgaaacgacgatacatggacatgggtaacaactaccaacacaactagtgggtaccaattataccaactatatagaaggtatagatacaagagctacagtacgcattgttctgttccactttgtttgcgtggggcgactggctgaacaattcagcatttcagccttatacacgaataattacagacaggtgcgaagaaacagagaacactgaaagcctgaagcctaagccgcttcatgatgccatatcaaggaatagacaccaggacctgaaaaagggaaaaaaaacgatgagattcttcgttaatccatttaacagaagcacacctcaagttgctgtcagctaaattggtaattaatcagcttgtttcgacagatttccaagaaattgatccattggaacgtatccttcaattcatatggctatcactgtttgactcgtgtgctcccacaattgcttcacatcactgagccctggtccatagccaatgtttctttcagtgtgtatgtatagtatagacacagcgtgagcttccttgacttcaaaagggtgaaacccaaatgtatctttcgttgtgaccttgtgggtttttctcttaaataacatccacacaatatcctgtcaaagttaaaacaggtttcccctattgaaaagtaagtttaataccatccacacaacgtcctgtcaaagttagaacatgttacctctattgcaaagtaggttaattgaatgttaacttggaaaaaagagaagacatgttgcatacgttgcttacgcacgaaagcagataatcggacatcaataggagctacacaaaattgtgacactactttatccaagaaaaaaacaatacaatagcattgatctatatccttatgataacaaggaaatcacatgaactctactgaaatacactgttaaagcaagcaattcaaacaagtcaaaaagaacatacataatcagcaccctgcaaaccaaatctgatttggtctaaccccaaacctagaaattatatactattgttgtagactgttgtttcttttcactaaaattcatactaagtcaaataaagcggtagtagtagaaggatgataagtggaactagtgaacgagtttgatgtccacaggacctgtggccaccaggcatgctcgttctatagcaatcaaagttgatcgtcagcaattaaatctcacacatagtgatccttgcccatcacctaacatgaacttccccaataatagtgattcatctacatcatcttgatctgactcctgagactcccaggcataccaacaacagctactctgtagcacacaaacttactctttatctagttgaaatccaaagcaagccccttcaaggcatcaccacactactctactgcacttgccacttttatttccaagatgcacctgctagagcaatcatcctctactacccaaataacaatcgtgtctgtcagtcactaatcaattcataaactaaagaacactgaccttacttcatatgcaaactacatgctgtcatcagttgcaatatcagcatgctcgtcagtgtcactactccacgatatgtccaccagaccaagctgttgtcagagtagaaagcccacagaagaccagaggaaagggttttgaacgtcaatcagctcactgtacaatgttttctgacttcaagcagtggcggacgcaagtttaaaatacagatggggcggcagagctagccctaattaggtgatggtacaacacatacaaaccatagtcgctggttcacggcattggcgcaacagcgcacggcacgaacatcgagaaagttaacaacgaagattggtagtcgaacaaacgtatataacttatatgtagagagataaaaaaaaaagagaaatgttgttagacaataaggggaaccactttcaatagctcggggggtataaaacgagatgaaaaattatttaggggtttaagtgcttcgctaaaatagttcaagtgagtaaaatggatttttttatatatttaccaatttaactatttactgtagactgtattatacgctaaagaaatagaaagaaaatcgaattttatgtatggtcaaaatggtactacttatacacgaattttcataagtgtttttttcctattattcaatagtagactaatgactaatgtgttagaaataggactaaaataaggttttggggtgtggggcgacacggactgtagctaggccggccgacccaccctgcccaatgggtgtgtccgccactgacttcaagtaggatggaacgaatctactcaggacaaaacacaagcctttatctccatagcattttgaacctgttcttggtccttttggtgatatagcttgtacaatttcaaggtcttgaaagcactaagtttttctgtttccgataatataagtgttatttttagagaataggccagaggcccagctttttatagaaagctattaaggtttcgctggggtgagaccagcttacagggcagttcagaaaggaaaaagggcacaacccggccagacataggttttcaacctccagtagcagaactcaaactacacaggtccaactctaaacaacagaaaaagctacaaggcgaacaaacaagctatggaataccacacctatccaacaccagttctggagggtctaaaggcagctacaccagtataatataagtgtgcctctggaactatatttataccgccttttctcataaggtacattgaaaactggaggtcaaattcagtatccaatttgtgggtaaatgtaccccaaggccccaccttgaatattttcatacttggcatgccaatcaagtatattcatctacttatcaaagttagtactgcacaaaatctatccacaatcatcgagggacattttgaggataacaatcacttggaaatccctcagtgatgtgaaattatgaatacacagagtctgcatatcagacagattctatatcataattatgcagctgacagttgatgtacaacactgcgtcacaatggtttcaattatcagtgttgaaagattcagttggactataaactacaagctccataaagatgatttgcagaaactggaactaatttacaatcaagtttggcagctgaaattgtaataaagagagcctatattgtatttcaaacgagtaacctcgtactggagtagtaatattctgtttgtattccgttataactttaagttctcctaagtccaaacggtagggaccattacagcataaaaacaacagaggtcttggaactattcatttccaggcaagacaatattaaaacttcactcttcaagtaattggaatcagcacttcatattcttcaattaagtggagagattatcatcaatcccatttgtcttttaaacaaattctcccgaacaacaaagaacatgaaacaattcaaagctattatactaaacaaaacaataacatagtgatcgtgtcctaagattacatcgcctaccaagccaagccatgagacagcgacaaaaaaaattgaaataaaaaaggaagcaaagtggtagattgctagtacctttacctttgtactaagagtcggctttggcggggcactcgaggctggcgttgaagtggcgggcggggaacttggcggagacggagccgacctcgaagacgagctcgtcgccgtcggcgcggatcccggtgatggaccaccaccggaagaaggccctgacgcggatgccgctgaggccggagatgcggcggtcgtcgagccggcccgtgaggcggtcgctgaaggaggcgaggtagctccccgcggggagcacgatccggcagctggaggcgaggtccacggcgaagtcccccgacccggagtccagcgtgtacccgcgcacgttcgccggcagcaagcccagcgggaacccgcggtgccggagctcgtcgtacgcggtgacgtcgccgtcgccgccggcgtcggagcggacgaccgggagggccgccgacgcgaggagtaagagcgcggcggcggcggcgaggagcgccccggtttgggcagtgggtgtcgccatcgctggctcgccgctgcttggttggggagttgggatggatgggcgcacgcggagaaggagggggtgacgtggagaggtggaagagtgtagagcaccatgacagttaggagagagttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttatagcgtgtgcggcgaaaagtcaaagatttttttcctttaaataatcgtttgcaacggtggcagttggcagttttggcactgagcaaagtaggcccggctcggcccgacctaattaggcccaaaaggtaaggaccagccagagtttttttttttaacttgtgcatcgatgtgtttcatactttcatgtcagagttgttcaagtaggaaaatgttgtgctagtagatgtacacgagaatatgacccgatcgaaaacaagtgaaattgcaacagcccaaagaatccaaaaggctttttctgaagacaaaaacttctgaattcagagagtgcagactgcagacaagacagcagaggcaccagctatgcccaaaaagaaatgggtggctcgaataaaacttttaagttcctattacatcgaatgtttggacattaattataaatattaaacgtagactattaataaaacccatccataatcttagactaattcgcgagacgaatctattgagcctaattaatacatgattagtctatatgatgctacagtaagtattctctaattatggattaattaggcttaaaaaattatctcgcaaattagctttcatttatgtaattagttttgtaagtagtctatatttaatactctaaattagtgtctaaattccctggatccaaacaccacctcaagcttaagagttctgaacgatagaaaacccattcaaacaatgattcccagaagctaccatgtttatggcaaacaaccatgtagctgaaagttttctactgtctattttcatagtttgcaatcagttctccctagcccattttgtgatcaactaatcccaggtaacagtcagaagcttaactactatttcctggcacatatttgatatttcagcttttggccaacagaaaaaacaagatgtgaaactaaaaggattcctagaacctctgtgtgtgcataaaacagtaaatatctaatctgaattagttgccaataaaacaactactcaatactaattcatacataaacaatatgatagcaataatctaatgtcagtttcgtaacgaacacttcttttgagaatgtccaagaagatgacatcggccacattgaacgattcgttttggccgtttcaagctttctatcttaagaatcttcattttgggacgaccaggaggcctccggatcttgggcgggcgaagaaccgcatatgctttgcttcctgcaccttgtgcaaaagaaaacgggaggttccattggcttctatctggaattgaatagattggctgggagtaagtttcccgatacttcattatgctgaagcattcatgtgcatacaagcgaggatcttcaccacaggaaagtagtgcagcaacagcatgtgcacatggaatgccatatatttgccaccgacgacaagagcagcacctggcttgcgtatccacaatgtttgttcgctcagatgagactatttcaaactccaccttgtttgctcgaaggacttgatagcatcctgaatcagcgatagcttcagaaataagtttctcggctgatggaacaagaattgagttgtatgatagcgccaagttttgccgttcaacaaaccagcaggtcagttggtgtttgatatgctccacagtttgcactataggaaactcatgacactccatggcccagttatataatatctcagttatcccaagattaaaatggccatatcggataccctcaaagtaagaaactgcccagagatttggtgggaaacgttggaaccatggcatgacatcttgaacttggaccatatcatttacctttgaatcaaattctgctgctgttagagcataaacagcactccagaaaatgttcagaagtttaggatttttgaactcgtcacggaaattctcactcacatatctcaagcaaaatccatgaaaagcagtggggaagtttacttcaacagcttcaaccacttgtgattgcctttcagatagtatcgtcaagacaggcatcttatccgtgttaactccaagcatcttcctcagttctgaaaaaaaccacatccagttttcatcactttcagcgtcaacaataccaaatgctagcgggaacatcatgttttcagcatcaacagctgacgcacatagcaatgtcccaagatactttcccttgaggtctgccttgtcaatttccaaaaggggtctacatgcatttaagaaaccatgaatagatgcatggaacgacacgaacagccgctggaagctattatctggtccagtccctttgtatattgcaacactgccaggatttgtctgtacaatctgctcacagtaggcaggaagaaagcgatatccatcctcaagggtgccatgaacagcagccatgcttctctccttcccacgccatgcctgcatataagaaactgctactccatgctgctctcggatatcctgcaatatctcttttggcttatactgtgggttatctcttagcgttgcctcaacggacctagcaacccaaccaacggtagcctggtgatgatgcaagtcacgcacaccgtcgcacgtgtgctccccgtgcaatgtgcgtacagtgaaagtcgggacaccatggcactttgccacatgcacacgccacgggcagccttccctcgcgcacttggcgatgaaccggctccggtcagatttcacgacacggagctcgaaatgcatagcaatggccatgtccttgacggccctccggcacgcgtggacatcgacaaactcttgcccgatgacaaggccttgctctacaagattctgctctaactcatgcgtgggatctacaagactctgctctagctccgccgccaggtctggttcaactaaaatctgatcgtcttccatcaatcatccacaagattacaaaatcacttatcgcgccacatagaaagtttgctcgcaattcgaccgctgcacaagattaacacaaaacacctagtcattcaatcgaaaagaaaaaatggcaattcaaaagaggtacagccaagttcaaaccaaattagggcaggtgagttcggttgaaagttgaagcctactccctccatttcatgatgtaagtcattctagcatttcctacattcatgttgatgttaatgaatctaaacatatatatccatctagattcattaacatcaatataaatgtggaaaatgttacaaatgacttatgttgtgaaacggagaaagtactttatttacttcctattttttcttcggaggaaaaaataaactattcagtggcggatagcgtggagcatgaggttgagctgaaccaaaagtgctacaaagagtccaccacgcatccatgaaatccgcatgaaacttaacgattgaaatgggatgaaacttaacgattgaaatggaggaaagaaatcaatcaagtccccgtggatctccaacctactgaagtgggcgtggacaagaaccgagtagggatagtagaagaaagagatgaataccttcaactcgattcaagttgaaggcgggggacgaaagccccgcttccgccgccgctccaaacccgcccccaggggcgtgcgcgctaggggaacggcgaagggggagtagcccgccttccgcgtgtctccgggactagcaggcgccggcgctcggaagtcggcggaggcgggggcggcgaggagaagaagaacggcggcggtccggctgggcagatcggaaagacgggtggagggggtggggggcattttggtcattcgatgtttttcagccttttttttcgaaattaaaattcgggacaccgttcaagtcgaaagtagcgatgtggttttttttttacaatttttatttacatttttttagcatacacatatatcaatgcaatctattttttaaaaaataaaatgaccaaaatgctactagttaggtgggacaagtattagaagtttctaaatgcatatgtcaactaaatttcatctagtcccacaaagataaaatggaattatgtgggttttttttttacaatttttatttgacatttttttagcatacacatatacaaatgcaatcagtttttctaaataaaatgatcaaaaatgcccctagttaggtgggacaaagtattagaagtttctaaatgcatgtcatttcatctagtcccataaggataaaatggaaaatagaatatcacacattaggtacttcttccatttcatattataagactttctagcattgtccatattcatatatatatatatatataccatttcatattataagactttctagcattgtccatattcatatatatatatatatatatatggggtaatgttagaaagtcttataatatgaaatggagggagtagatcgtagtgacaaatagatgacaacaaaattattacttattgcacattaaattatctaggctctttattttcattcaataaaaaatactacatgaccaatgagatcaagtcctatatgtaatcactataattaaccatagtacagaatatactgtgttgtaaccatgaatccctacggtttatggcaaacatatatttctactcacaagtcacaaatgttctccagttgcttacttgcttgcgatctgaatccatttaagaatcccatttgaaacaagcagattcaaaacactacatttagtcaaaatatatttatgtttgacttttttattaagctccaatttttcactgtctactattttaaaaattatgatttattttcagaagtatttgtataagctaaacatactctgctaaagaaaaaagaattaagtgagatcaaacgaaaccatgcgagcacaactctcgggacattttactactctctacttaacataatgaaaatgttatgttaagttattgagtctgtgcaaatgtattactccatctattttttaatatattatgtcttttggcacgacgtttcaatattctccttattcaaaaaatgtagataagtatcatttttttacttgttttatcacttaagaaactttaagcatgacttgtatcctttacatttatataaaaaaaagttgggtgaatagctcatttagtccttcaagtttcaccgaaggctcaatttggtccttcacgtttcattttgtccacataactcctctaaatatttgttttggcttgacatcatctttgggcccacttaatatgccatatggctatttttagtcaatatttctattagaaaatgtcccttttgcccttaatttatatacaactatatataaaaaggagaaaaccaagatgaataaataacattgtagatatacttcccattatttcaacatgtgcacatgaaacttaagccatttctatcggatacacttgctagtacataatttattttcgttttacataatttactatacattatctataaaaaaaatcaagcatacattttttctcttatatatgtgaatgatgggggtataagtgtcatttatcaagagagttgttagttcaaggataagtttgaactaaaatgaaaacttgaaggaccaatatgaatagattgaaacatcaaggactaaactgagtctcaggtgaaacttggaggaccactttggctattcacccaaaaaagtttatggtgttgtcttacaaaatagagacagtatatcattggttatcggtataatccacggttgagcttagtgctatcttcataattatccatatcatctagaaactacaaggcatgtccggctgtctgttctatggctgcagcacagccggcaccaacagtgctgcacacacacggcgcccaacagggtagcacgcacacggcgcagccgtagctgccgcagccagcttgccgaacaggcccactaaagaactcgtgtttttctatgattgcctgtagtgttgtatctacagtagatgatattggcatacagtcatccattgctgctaaggggcagtgctacagaggatccttgtcccttttagggcatctgcaaccaaagccacacctagagtgccctcactaactaaggacactctcaggggcactcatcttccaatggaggatacacctaagtagaatcttcaaaatctgaagcaactggataaaggtactctagcccacagtgggtgtcccaacacaaaagtccacactaggtattttcccatactaccactctcttctctttttcttcgtgcctattcttcttcgtcgcccctcttctcctccttttcttcgcctcgtagcctgtccttcccgcctcggcgccgttgccgtccttcccacctcggtgccattgtcgtcctccctctccctatctcccccgccaccgtcgctcgcctcactctccctcctctctctctctctctctctctctcaccgctcacctcactctcactccccctcactctctctctctctctctctctctctctcccgtcgccgacggctacgaaggtgatgagggccgtcgccgcagcgtcggcgagcggacaacggtgagcagcgcgcggatctgttcgtcggcaagcggcgcgcggatctattcgtcgcgccgcggatccgtcgacctcgccgtcgaagctcctcttcgccacctctctcctagatctggcatgacggcgctgcctactccggttctgccccatcgcactcgtcgttgactccgcctcaccgcatcgaggtgaggggcaagaaggggaaacaaagggggaggaggtaggggacagggcaccgggtcgctgcaatgtgtaacctcgagggagtggctccggaaaaagggagctgaagagtcagaggcgtgcgttcccctcgtgggggtcgcacctccctctagggacacgcctcgcggacggagggcagacagcgtgaagcgggggcacgcattgtacgtggccttataagtctttggttacagagaacatgtaagcagatatggttgtgtattgtgtattggtggacgttgtcgtttgttgtttgcattttgcgccccaaccatctcttcgtgaaaagacaattccttcctctccctttccttctctcatctaagtcagcaaaataatcattttaacaggactttacttcctagtagtattgagttatatgtccaaacaatagctcgtatactcgtttatcttaagattttcattctgaacatttttctgcctttgaattgaagagtcgtgagaaacgccaagggtcttccgactaactccacgagatgatgggctagacgatctgggttcgaaaccttacctcttctaattattttgtattaggtcatttcctaatatttgcatcttttttaattgaagaatcgtttctcttaaagattacaatcgtgatcggaattcgtccgataaacatgtactatgtatgacacgttgacaaaacaaaagtactagccactaggcagccgccaaaatctgtgcagacttcatcaccttgcagatgctctccaggacttccatggggctgacattgccgaccacggtcacctttttgttctccagctccaccttgaaggacaccactcctgatcatgtcaatcgagtagagagatcactatatcagagtatcagctttcagtaagatcgatgaacatagtgtttaccagtcacattcattcatgtaccttccatcttcaaaatttgcttctcaaccttcctcgcgcagcaatggcagtgcatagacaccttcagtgctactgtctgcagtgcaccgcagcagcacatgcagaaaaacacagcattaagttactgacagagaaattagagaggataaaatctaaaggcaagaaatgctttcgatttcagaaacaactatatgcattttttttttctgaaatgatgatttcataaacaaggtagtacgcacctttggttctttcacagctgatgatgatgcgttcggttcgtcttcaagatcagtgaccggcacaacctgttccaagtggctcctcagcaggccgcgcctctcgctgcttccctcgtcttcctccaggtgatgatgatcttcattggaatgcggaaaccaacggaaagccttcttcagacctcttgcagccatacggaagccctctgattagacaccaattaaccagcttgatcactcttcaaatattagcttatatagagaattgacagaagtcacaaggtagaggcatttatatgagttgttgatctgcattcatgagacagccaatggcagtcctgcagtactattaacattgtagcttaaccaagacaaatatgcctgaaggaagatcctgtgagatcaacaaacaaggaatccataaccataagtccttacaacctcactggtagtctggtagatctatccgtccaaccactcaccagttgatagaaagttagaaatgattagacaactattatgtaccaggttaccaaccagtactgcatctcgatatcacactggactcctgtagaatggctgggtattaggttacctgatcgatagatatttcatctgaatgacaaaaattatttgtaaactggccctgcaagacagtttcgtacccactcgaagatgtcttttcagctgtacgcacgcgtatttgatatttcagtttacagaggatacgaaaaaaaaaagatttcagtttacagaggataccaaaaaaaaaaagatggtggtctgttgtagagggactctgggccagaagcgggcccaaggtgcagcagcctgttatccttccaccgatggaagcgggcagtgatcgctgctctgtgaagccagcctcacgctgtgcctgccactttagggccggagaagcaaagcaaaggccttcgccaaagcccctccggcccactacgcaacttggaacgggcaagccagcaagattacaacaacatggggcccaggatcagaatccacaccaaacatccgcagccacctttagtgcccccgcttgggttacaggctctcgctactgagctcggcgaggcagggtaggcgagctgaatatttaacttggtttccctctttgtaaactgtcgaggtggtactaaagaggtgaggaataaagctgctactcactaccgttttgtcatttgtgggtgtgtcttttcatggatttggacccccggcagttcttcctcttggaatttgtggcctggttcggcctctttcagccgataatgagttttcttttgtctcgttcgaaatgagtttttaatttttcatctttacagattggttattttctgccgtgctgcacgtaacccttgattctagtaagttttacagaaataatcataatgtaaaattcaagtgttcttttttttttatcattggccactggccagtttgcgcaggtaaatcttcagtcctgatttttttttatcactggtcatctattcgctaattcggtccagttctcataaacctataatttatgtttttcttgtaatgtgcactgtgcagctcagcgactgatcgtcaggggaaaaggttgctcggtttactacctttgaacattccaaatcatagtataatggtagcatagttaccgttttccatgatactcctatctcggcctttcagccagctaaacatctccctcaaaaccagaagtgcaatggacaagaaaaaatatagtgaaaactgagagttttgttgctaccaagatggaaccggactgactcattcaagctgtaaacttgtcacaaatcgcacccaggtttacacattgttcaagagatacaaactgcagctataaagccacttgtgctaacaaataccactataagaggataggtatatcagatcgacacaaagtacagtcgctaaaaagatgtactaaaaaacccaaacttttatcaaccaacgcagatcattattccaagctctcttcaagaaccgcccacatcttcagacgcaaccaacgaatttgacatttctcaacgcatcacaaccgagcaaaacctaaatgttcatgatagagtcagtcacctatattatcatcaaaaactgaatgcgttctctaaatcattgctcttacaaaaggcttaccacaattcaagcaacaaaggccacccctgagtctgctgtgaagtgacaccagcacaaacaggcgtttataaccttcagaacagtataaatcaagttaaagcagacagcttttaccagtttgtctaaaaaaggagagatacctatcaatgaagttaagaaaaaaggtgcactagaatggttagagagtatagtactactctagtataatttagatccaagaaaaagtgtctgggttgtgaaaatacatgctattgtcatttcttgaggcaaaataccctgtaacggttgctcatgtagaagtgttaaagaaagggataatgatatggagttaataggagcagcatgcttttttgttatatgacctaaaatggcatctaaatcaagaaaactagtgtaacattcacaatcattgtcccttacaaatatgctttggaatcaatccaaacatatcgctaaggtataaacagaaggattgtaaaaaagacaatgacgttcatgaaatagggcatgtagtgatgttaaatttacaagttcatacactagattgcacccaccagaaaagtttgtgtaccaccaatgcaatttactcttaaatttaatgttaggagtaaaatgagcagcaaatgcataccatttgctaaaatatattgtgtgcaaattagtaagggaattgaaaatgtcaaaatagggcagtacctaacataacttaggacaagaagccacccaaagtgctccagatcaaaacaggagatcactaagggcttaaaaatatagcctgcataagcatacaccacagataagtttgcaggacataaggaaaattgtaggtatatcaaacaaatatataaataactgaccataagcagcttattcagatgctattcaccttacatggtgcttcactgactgaagttcatctctgagtatctgcattaaggagtaaatacatgagctgaaaatcatggcatgaaaacagtatacaccaggtgagattcaaaatgttattagagaatacttgcctcctaggcttgttctgacgctgatcaacctcttcattgacaatatctgcaatgcaaaatgtcaaccaaatatttatggaagcaacttacaaattgtaatataatataagagtcaacatcaataaaggtagtatgatgtaccatttcgaggaggggaagcccccttgttagcaatagattccctgtaagaatgaataaatatttttaattcccactttcaaaggaaaattcatggatgatacaagaacacagatccaggtaggttacataatactaatgcctttatatgtatcgcgcccaaattcctccaaagtatattcccattcttatattaacatttctgaatcaaatgtgtatccaacagtaatacttcttttagccattcgagtgatccacttcatcagttcatcaatatacatacacattctgaaccagtacgtagttgagtactttgaattgaaatacaaaaatgtacatatatcaagctgggggctatcacaactgcatttgcagctaataatactagtcaaaacaagtgataatgtttttgaagatgcatacatggtcagacggctaagtctaaagcagatgttcagcactttagtttacaccaagaggcgcttttcccacagaaccagagcagcttaacccatgtatataagctatttgtcgattatatcctttacctggaaggaactgacgatgaggtctgtcctgaagatctggagtaaaaggctggatccagagcaatataaggtggatatgatcctccaaaagcaccagctgcaccagttaacagtggcaacctaccaaaccaacatttcatgtgttataagacagaataatataaaaaatcatgcaaataaggcccaacagtcagtatatagtttataaagacaaagaacaaaagcatcatattggaatccataggaaaataaatcagaactaaataaataggagaaaggtattattacatcttcaacaaaacaaaaatgacgccccaaaagagtttatgagcgaatattacttgggaaagcaagtttcagctataaaatcccataacatattatattgaaagataaaacaaaagcatttgtaacaactatcaattcctgctatcatagtttaattaaacaaaagctagacaaagtatagctagaaatcaaaacaagacgtgctattctaagaacaagtgaaaatactgtttggtgtaatattgtcttatattcaccccttgcagttaagattacatccagttgttacaccacagaaaatattattgtgaaaagcaaatctagtgagacaatgaaatataccatgtcatttcgttatttcccattcccatctgctgttgagccacatagccagggagggccataccaacagtaggaactccaacaccaccaggatgctgactgccaaattgcatgactgcattaacgatgaaaacaggaaagacaatgagttcaagtgatggcattggaaattagaaagtcaaagcaatccgattattacaagaaaagatctgttgaattactaaggaagcaaacctggaaggagagctggagtgccaggaaaattttgttcgccctgggcaagaccaatagccccagcagccccaataacctgggctccaccatacataaaggaaccccttcctgcttcctgactgttggtttttcctgccccagatgatgcatttgatttgttcgaactaggatacagaccattctcaacactttcagttgatctaacaggtagatgctgagtggttgacgggttgccagtgcgatggttcaactgctgagttggtattctcattgcagattgagtttgcacttgccctgacttctggtgcacgactgatgtgtgactttgctggtgtgtaggagccctaggattttggtgaagagacgaagtggactgattgtttgaaggaatcccatttcctccttgagttctaacaacagaagattgaccatgattaactgtcgatgctgcaaatcctgatgaattcaacgatgttcctccactccttggagattgtctaacaggaccatcagcatgttgaaacctgtcacgtgcaccataatcccttctaactgctgggccagattgtacctttgcattgtcatccatcttcatagaagatggaaagactttattggaaccccctgcttgcatattgtcccttctttgagctggcacagagaaatctgggttggaggcaccagagggataaaatggtggtgacgctgaatttaagcttgaattcacaacattctttttaggaggggccatttctgactgcgcatttaaagtttggccactctctctgacggctgaagcacttgcagcagactctcgtgatcttgcaggtctgaacaagtaataataagataattatgtaaggcgaaaatcacaagcaaagctgtgcagccatgaaacctatttacagtcaagtgtccccagtggtgtgtgcagtattgtgtttttgttgggtagttgggaaggattcaaaataataatcacttactgtttccgctggaatccaacaacatctcggttgttctttgcaacagcttcataacgtcgaggtcctctccctctaacaaccttttggggtcggttttggtggttgttgttgatatcttcattataaccgcgatactttccacctctggcaaacccatgaccagtgccccgagttctacccccaccaccacggcctctaaagcgaccccttgacattcgcttatcctgcaatgcagaaatcctacctcaatactaacattgaagaaaaagctatcatttgcacattaaaggaattggacagatacctcatagtgctcctcatgcaaattcatttcctcaaatctgtcatgcacccacgcttgatcatctttagcgtcccataacttcctcccaccaaacattctcctgctttcagaagaaagtaaaaaacaaaatcagcacagttgaagagcaagatctcatttagcagccactactatccaatgacagactgcagcagggtcaaaatataacgataaccaacatgagccgatgctcaatagattagctgtagctactatatatttagcagacgcttgccaaccagagcatccatttgcagaggagatgcaaaatataattgacccaggaagctaaaacatatggtggaagaagaatgatgaacatgctctattgctgattgcacattgaaaatcgttagcatacaaacaaaaggtaagctcgcagctcactcttcccatgttggtcccaacaatgtggcacagtttttcatcatcatggaatcaaatagagggggtgacaaaccctctaatgaatgcccgtggatatttacaggttatggggttttctgcaaaatagaaattactagcctgccatcatgggttgcaacaggtgtgttgcaagctgacagtgacatgtcaccggtgagcaccatgtggaatcattttgcttctatggcctgtttgacccgagtccgcatcaactaagcaagttgttgcaccgaaatgagtgttttgtaggttattgcacctatttgcagtccatgcaccatgagtacaatttactcttcttatagctaaattccaacattctatgcccaaaaacgatcattaggcatttaggttctactaaatatgcagtgattagccttctcattatattaaaatatgtcctacatattgcatttctaaggagtattcataacggccatctcatggcaaaaaatgaatttattcaattcacaatcagcccaatctaatcccccaacccctcctcttttcttctccggtgttagctaaacttatgcattagagtacatgcttaataaacattggctcttgtcctactaaaaccctagcattgaaggaacaaacaaaattctatgtagctaacctccaggacagcatcttaagcatcaaaatttaagcacacacaaatctgagttactgtcaaaaacaagtaatagcaagaaccaaggttgggaaaatgtgtctgcattagctcccaacaaacaagtatctagcacgagtccctggatttcattgtaggaacatatttcatgtaggactccctgaaaaagtggtttcactggacccttactgtggattatcatttgtcattataacctcattcaaacttttcacgtttcctgatattttatcagtttacagcttgatcactatgttgattttagtttcgagcacgacgacccaaacatattcaaaataaatgagttcagatgctctggtaagttatatccttcattttctacatagttcattttcaaagtttaaaatttatactaagcttaaagttcagttttttcttgtgaaaggcttttgcctgaattgcatgtgataaatccccctgcgcttcctcgcctacctttggcatcgatgcctcaattcacagattcactacgttttgattatgcccgttttactttgctgaagtataatgcagctctggcttcctcgaggccacagccacagcctacggttgagcaatagcaattctaccaaaactatgggtacagcagataaggcataagtttttcaggaagaactcacctgcggcggccacgactctcctcttggaagcggtcatcgtgcatgtagaaggcgccggacgtgggtaccgcaaacggctcctgctccttcttctcttctccatccccttccaccgccgcctctccctccacgtcgcccttctccccatcctccccctgggcaccggcgacctccttgggcggctccgcgcggccgtcgtactcctcctcgaagccctcgccgacctcctcctccgccaaatcatcgtagtactcctcgtcatcgtcctcgtaggcctcgtcctcgtacacctcggctgcgccctgcccgtcgccgtcgtcgccgtcgccgcggtcggacccgatccgcgccctcccctcctcggacccctcgtcgtcgctggcctcccggcgccgcatctccgggagcagcgcgtcgtcggggtcgctcacgtactcctcgtcatccccggaccccgccgtctccgcctccgcctccgcctcctcgggcgtcagcggcgccgcggggggcttctcggcggcgtgggcctgctccggctgcgcgtccgccggcgtcgtcgggtcggccatgggcgggcgggcgagcgaagcaaccctagatttggctgcggcggtgtggtgagattttttcttttttttttctcctttttcttccctctctctccgtgggtttggtttggtttggttttgtgtggggaagcgagacgaaagagttcgaatcgaagggggagagggggggaggcgtggaacggaacgggacgggattacggacggggcagggtgagagcgaggcggacggggcgtggaacggctacggcacgggagggcaaagcgcgagttctcgccagttttttagatgtaaacgtctacagcctacaggtttctctttggtttttggatggatacaggagcagacggttgctcagtgcggatttataattcggcattgctagtcttggtgttaaaatattatagggttatgattttatccgtgccactacaaatttatttatttagataaatgttatatttaaaagggggtgcgacgtataatgtggtgagaataattacatcgtcgaattatccttacgaccattagaccgagtgattatacggttagaaattttctatgcacgctctttcttttaatcagtgcatgtacctacgttgtaacggggtccatataagtaagggtagactataagtgtgattgaggataaaacattgtattcggtggttacatacatacgctatgtgtgggtgcatgttgagagcgtcgtggaagaagtggacggaaggaagatgagttggcttttaagctagtagagatgtaggtaaaatatttcagtcactttgcattttactgggccatgtacgagcggcacctacggcctacaaggtagtatggcgcacaaaccaacagcctatgttggccgagctagcggcaattcaaggaataagttcacttttcatccctcaactttacgtcaagtttgtttgacatccctggtacaaaaccgtgtaacttgtatcccatggcagtattgacctcattttcccatgtttttgctcatgtgtcagttgtccggccccacttggtcaggttgcagtgacagtgaaagatttgtgcaatgacgacgatgcggagaggagtgtaggcgcaacaatggtgatgacgaggttggacggccaccacatcgccgctggctccaccatataccgccaaaatatttccacccacctgaacctaagcacctaatcatccacaagctcgatcgctttacatgatataagcaacaacatgaaacaatcatgagtcgatcaaatgatccatggtcgaagatgataaaaaaaaagagtcacttttgatctgtcatggatggtagaaactagcaagaaaggtgtgtggaatgtgagcataggacgacgaagaaggagatgtgtttgccatagaagacgaggatggcggtgatgacataggtagcgtacaccgtgctggcaccaaagttggcaaagaaggagatgaacacgtgctccttcacattgagcggctccgggttgagggtgaactctaacggccgcgcgcgcgcagaagaaggcatgctcctacagtaccaccgccatgaggcagccaagcggcacaacggcaatctgcaaggagatagcagtgatggtgtgcggcttcgggtagtaccagaagaattggttgagaaaggagagcaccgcgcacgacgttatccctagactgcacatccggaacatcagcaccaacaactcgtgggtgaagcccacgcatatcaaccgcaattgatgcatgttcttaaataataaaccatacctgtgtcggagacaccaccagggctgagggagcttaggcttcgggaggtcgttgacctcctcaattgttgccgcctcccgcgataggctcaccgggtatgtcagccgccttaagcccccttgcgatcttctccatgccggcaagctgctagggaaaagaggggagagatggagagatgggcaagaaaggggataggtggggagaggtggaagtctacttacgcgtgggctctatatgttttcttttttctttttgctaactaggatgtcacatcagacaatacttaacttaacttggcacatcatattgccttagacaaacttgagtagttttgcaaagataaggggtggagatttttggtattgcgatttcagggacgtaaattaaactcgtcgtaaagttgagggattggcaagtggacttattcgcagttctactaccgttaccaggcccctttttgggccgttcggcccactacaccccaatgtattgtcgtgggccgtgagaccaaccggatcagagaagcgtgctgcggtcagcgtcacaccgaaaccatgacctacacggctacacgcgcgcacgccccgcctcgcctccgcttttctttcatagcttcgtccatccatggcgcagccgtatcatcctcagtcctcgctaagctagctgcctccatgcctgtgacaagggagatcatcgccggagccggagccggatcggcggcggcggcggcggctgtactggcgttgctggtcgcggccgccggcggtgacgaattagcggcggcggtgggtagcagcagcagcatcatgccgccctgcttccacgcgtgcttcgaccagtgcgtgcagcgcgaggagtactggttctgccagttctcctgctaccgccggtgcggcgccggcgccatcgccatcgccatcgccgccggccgcttctccggcaccggcgactgcgagcacgcgtgcgcgctgtccatgtgcggccagatcgacccgggcagcaagatgatggccgtgtgccgcgacacgtgcggcaagagctacgccgccgccgggtgccgccgccggccgaccagccttacggcggcagtgtgattcaatatttcgaccgcgacaaacaggattgccttaagcatgacgaacatctcgaattaattctcgatatgatgttaaaacacaaatccatgcacaacatattaacacaaatccatgtataataatactcttgagatggctaaattattgtcggagttgtgctccaatttgtaataacgcaattaattacgcaaggtatatatacataccgccgttcgatcgaatcgaattaacagtcttgtcttgagtcaactatgacgtttgtttctcgctgattatctgccatacaaattaccatgcggctgatctactaagtactgacatggattaatcaacacggtggaaaactaattaagtgcccagttactgtcacttgaacacggattactgccttgatccctagctacttctgtcagaccgaataccataaacgaaaatgtttaatgattctgtatgggctgcttggtgctttcttgtgtaagtgttctctcatcatgacagatcaaaacaaactggatttaatcgattcgaactgatcagctgaccacgaagagagatcgattacccgcgcgagcgacgcacgcgaatctgttccccgcgcgacgccgcgacgcgaacaaaagcgtgaattcgcaagctgcatgcccagctgcacctctctgtctctccgatcgctcgaaacgaattcagttttcgaacattccgtgcacggcgtcgaatcccggagccctcgccatcgcccacgccctcgcgcgcacccggaacgcgtgaccccctcctcctcgccgccggcgcggcgcgcgtgcaatgcaagcgctaatgcgcgcggctatatataccgcgctctcctcaccgaagcaaagccaacccgttcacacctcaccgagcgagcagctagctagctgcggcgatggcctccagagcggcggcggtcgccgtcctcctcctcgccgtggcggcggcgccgctcttcgccgcggcgagcgcgcatggccgaggctaccttggtgccaaggtacgtaccgacaccccgacaaattaattggttgtccacattaagaccaaatttactgattaattgtatctgaattcttgtgtcgattagtcctggcctcctgacggcagcttgagctcatcaagctccggcgaggctgcagcggcggacgtcgacgacggccacacggactggaagtgctactcctcctgcatgagcaagtgctgtcaccgccacgacgacgacgacgacgacaaggccaatgccaaggccaacgccaccgccggcgccgccgccgtcgggctcgacgatgactacaagtgcaagaagcagtgcctcggcaactgcttcaaggacgtgccggccgtttgctaccacaagtgcgtcgacgactggtgcgcgaagctgccaccatgtacgtaataaactaacacttcgcaacgtgatgnggtnctgtgcaattgaaagtcaaaccaaangcccactggggggggggnggnnggtatacagataggagaattgaaanaatgtttnnnanacgcgtcnnntatattnatgagatcgggtaattgatagatataccgtacantcntttatatccagtcgacgttcggt

SEQ ID NO: 3741 - DNA, 752 bp, Oryza sativa
  unsure (1)..(752): unsure at all n locations
catgccaaggtgcgtcccgttccgtcccctttagctgaccttgatgaacctgatgtgggtatcgccggaacagagcccggatccccaccgtacctttcatggcatcgctttttggggtaaggacgggacatttccggcgtacacacctgcgcggctggtgggagccgtcggcatcggctgccgtccgtcccctggccggctctcggcaaaccggacgacccgagaagcgcgcagcccgtagctatcggcctatcgcgcgcggcgcactaggcaggcatcctagtttcaccgggttgcgctgtggtatgggcggtgacacccgtcgagctcccgacccatgcgagctcgcggcgcgcgctaaaaaaacgaagcgacgacgccgcgtcgctttcgggtatcggcacggaagcggcacgcgcgcgaccgcatcctcgtgaagattggtggcaacgggtttgaccgatcgggagctaagccggcgctcttccgctcttggacggctgggagaagttttatgggtgggtcagctcctggaacccggaagaagtggacggaatttggaatcggggatctttccgccatgtgcgtgtccagtcgccaccgaagaaaaaatagacgcgccgttttatccattgctttttctaaacgtgactgaaaggaggcaaaaaaaaaacaaattcttgatttatttctgtgtatttattggaggatgatgaggtngtgtnccagtgagtgagtcntaccttggacgg

SEQ ID NO: 3742 - DNA, 758 bp, Oryza sativa
  unsure (1)..(758): unsure at all n locations
cgtgttgagagcttgnttcacgngttcttagaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatggtttacgtctacgtgactatacagatacgtataaactaaacgatgacgttagagaaacacaagaaaacgtagacaaagctcaacaagatgctaataaagctaaccagtcaattgctgacctatctaatgat

SEQ ID NO: 3743 - DNA, 731 bp, Oryza sativa
  unsure (1)..(731): unsure at all n locations
gtgagtaaaagcatangagctgctactgcaagtagttcatcattatccatctataatctatcttgctatatcgaacgcctatatgtatacaacatgaatatgtcacgaggctgcatcgatatccgaattagctttagctggtgattatgataaatcgattaataagaaatacgagatcagagcgcatggaggaattaaacctagttaatttaccagggaccaggaggagtgctccgggaggcgacagcaggctgtagggctgcgtgcggcgcgtatccaaccgatgctcctgaagggttttcgacttgtgttgatgtatggaatggaatcgactgcaacggaatatggtaaggagtattagcccacatactctaaaaaaggtaatagcccaaacggcgacaagtttttgggccaaaaagttcatgtttggcccaaactttgattacctcatgggctcaaattcagcttaaaccaagtcaggccgatccacttggaattttgagctggtgttaattaaaccattaattcctctttgcagaacaactgcgcctcacctaagcccaagaaaataagaacggcatctgctgctcggatgactgttggctgcttcgatacaggagtactttttttatctgcacaagttagaagtagaactgtcagatattgcaagacttgaaatttgaagccatgttctgtcacttatcgttttctttccttaagctgaacaaatt

SEQ ID NO: 3744 - DNA, 838 bp, Oryza sativa
  unsure (1)..(838): unsure at all n locations
ctcttgctcttttacacttttatcttgatgttggtttgagtccccgtctctattttcatgtctatactattgctctatattcgttattgtatttatgttataaatatttaaataataaatggtatagttgttgacnactctgcaanacnncanncaaaangagaaccacanaagcggaaaggggggcncaaaaccagggaccnganagncngaananaacaccgacccggaacaagggacaaacacganaggggcacccaagaacaaacggggcggagggagccnaggcacagaagcaacggcagggagcanagggagaaacacagccaagcaacgctccggaccccccggcacgacgcataacagcgacatagaagcaatctcaaacaggcatttgttcccttttatgtcgaacgttgaattgtgagacgtagggcatgtgtaaatttttcacctaatcgtaaacattcagcgcgggttgtcagtgacattataggaaagtgtatagacatgggaatggtgaagccctgcatactttccttgaacaaggcattctactaatcatgtaccacacatctgacttaatatctttgtatgataggaatttggtacattaccaaaaatggatgtcgatgtaccccttacttcccttcatatacgacgtactttgctggatgtgcccaaaaagatagacattctaattgtgattatggcagatgatagaagttatgatggtatggaagttagttgtgtcaggttcactgttgattttcttttttgacagttgcatatgatatattgcaggggaaattgaagagatgtgtgagagccttataac

SEQ ID NO: 3745 - DNA, 895 bp, Oryza sativa
  unsure (1)..(895): unsure at all n locations
agaggggccttcgctaatgcaagagtaccctttcgcattccctacgaaggaaagaggttgtgattcgaaaacgcagcagggagaagggcaacgctgccaccacattgccagtatgccccagtgagtcagtgagtatgaagcacaaattttgaataattgcaatgaagattttaggattgggtaccgcaattgattgatttagtatacttgcttgggtgcttagttgcaattcattgctcaaatgctcaatttcagaatttaaacatgaagaagaggaagggtcctgctgttgatttaaagtcctttttggagaaatctgctgcaagagaaggcaaatcgaagccaaactcctggtgagggcaatttgaatccgattgatagtaatttaaatccttcttgcaatgagagtcagatgcaattagtcatttatcaaggtcatcatcatgagaatgagagtggtagtccagcaagtagtagcacaataccaattgatccagcgattagtgatatgccaggatcaaatgatgaatctcaatctagtgatgaagacaacgatggtggcttgtatgacatagagcatgatcctggactgaggactcctatctcaaggtatgatgtcaatgaccaagattcagttagaagggcatacattgcattggggccatgccgaccaaagatgaagaaagatgatttcccgcaacatagttgtgaaggtatgcgccgcttcttaccaaaatggtttgatgagttcaagtggcttgagtatagtgtgaatcgggatgccgcatattgctttgtttgctatttgttcaaagaaagcaatcatggtgaagatgcttttgtcaatgnantnatgnngnnntgtgccacgatccgacgatctaatnnnagctct

SEQ ID NO: 3746 - DNA, 750 bp, Oryza sativa
  unsure (1)..(750): unsure at all n locations
cgggtantttagttgttcactggtacagnnacncatcagaaagaggttagcagcgcagtcagcccgaacacccccgacattagctcggacatgaccgaggcagaacgcgccgttgccgacatcgaaaccatagacgactggcgcatcccactaatcaaattcatcagcagcgaggagttgcccgaggacgacacagaggccgagaaaataacccgtaaagcaaagatctactggatggtcggcaacgatctatacaagaaagcgccaaacggggtacttctcaaatgcgtctcgaccgacgacggtagacaccttctcctcgacatacatgaaggcatatgtgggtcacacgccgccggtcggacattggtcggcaaagcttttcgacaaggctttttctggccaaccgcccttaaagatgcatgcgacatggtccagcgatgtgaatcctgtcaattccacagtaaacacacaaagctacccacgcaagcgctccaaactatccctctgacttggccattctcgtgctgggggctagatatacttgggccattcccacgaggacagggcgactacagattcctattcgtggcgatcgataaattcaccaaatggatcgaagcagtacccacgggggaaatcaaggccgacaacgccatcaaatttatcaaagggatatttgcggataccgactaccataccgcatcataacttgatacggctcccagttatcaacgccgatttcaagat

SEQ ID NO: 3747 - DNA, 843 bp, Oryza sativa
  unsure (1)..(843): unsure at all n locations
nttgggcccttatccatgcactgtgtttcgcccgatgatccctcactctgatgacacctaaggttgaaacctgttcttatgtccctttacgccgtctggacaaggcctccgaggaacctaagggatcttcggctggaaatgcccagaaccgataaggccttgtcagatcctgtagagacgaaagaccatataagatctggtcgtgtaagagttctcgccgtgcgtattaaccaagctgtgaaatcggaaatcaactttccaacttcacggctgggggctaggatcagagcttattcaaccaagccaggtcaaaggtccaagagccttatcctccgagaaaattcctctgacgacaaggttgggggatagggagagtgtaccactcaaacggctgactaaagtcgttaactgagaacgcactcttacacatgacatcaagagtaagagacatttgtcaaagatagatttctttattcacaaatactccttacagttttttcacaaatctttcgctacattacatcttttcctaagatatttgtcacagggtacgagtactaccaagagggccaacaccagtccatagactggaagatcttctcggccaacggcgacattgaccttgcaagatggtctatctctgccggagtctccgagaacagagcaaatccctcccgaagatattctaggtctaggtncgggtnntnnggtcgtgcagaaggaatcaccagtnnnnnnnnngngggggaaaaaaaaattaaaataaaataaaacacaantacaaataccagaggaatnaacaaataaaggacgatgaacagaaggacaatagagggaggagga

SEQ ID NO: 3748 - DNA, 744 bp, Oryza sativa
  unsure (1)..(744): unsure at all n locations
ctgggtttggagacgatggtccctagcnncannaccgngcaaatacgttccttgttggcatttcgtcgaacacctggttggcgtcgccttgctactgccgccgtcgctcaacccgtgcgccgtcaccgncacgggtctgcgtccccgccgccagcggtcagcccacgggtcgccatcgcagccgtcgtcacacgtgcgtcgcccggccactgcccgcacgcctaccgacgccgacgtcaacgcagccgacgccgacgtcgacgcaaccgacgcccgtgcgcctgcagccgccgccgttgcccgcgcgcagccgccgtccgcgtgcctgccgtaattgttcgcgcctacaaaattcgctcccctggaaagcgaataatgggtcgcccgcatgcgaaaatactaattttcgcacatatctaggtgcaggcagacgtctaaccacacgttaagattggttttgaccgcctgcaaaaaaattttctgtagtagtgagaaatcactgctcgtacgtatggagacgctgccagatcaaggaactctgtataagatcaactataaatccaaaattccaaaccaacgatgcaaaccatgtttggatcatatacagcatataacctagtgttcagtcttgtggacatttacacaacaaagttcttaggcacccatgtttggatcatattacaggtttaacctagtgttaagtctgggtgacatttacacaacaaagtcctccttacttgcatt

SEQ ID NO: 3749 - DNA, 778 bp, Oryza sativa
  unsure (1)..(778): unsure at all n locations
gtgtgcaaatcgataacagatggcacagnagctcatcatttttgtcattatacagaaatatgagtatataccccggtctggcctaactagcccgacggtggggtagaggtgcgatcacactggactcccaccaatatgtctgagagtaagggatgtttggttggttgtgtttctttgccaagctacaatttagtcatgtcacaacttcctaggcatgtgtttgtttcgccgtcacaactatatcatgccacactttcttaacctttggccgacttttttttaagataatagaagctttattaagactcaatcaattacaccaagatggtacaatccaactgagccaacccccggcctttgtataaaatgcacacatctaaaaaggaaccataaaagaaaaaacctcatctcaagcacaggagtgtgaaggaaacataaaattagtggttatcaatccatagactagaccaccacccatgcacctagataaaaaaattactgcgccacctggtccaaacatcatgataccactgcaatagtatcccggtttgtggagtatattccaggtgtgtagccaccgagtaactaaagtaataacctgcaaaggagaagacaccattttgtatcaaacaacaactcattcctgcttagccaaaatggaccaacaaagagctactgcgcccatcaaaagatgattttttatgtctttaggaacacgtaaaagccaaagcccaaacatataagttacatttcgaggagattttaaatttgaagccct

SEQ ID NO: 3750 - DNA, 744 bp, Oryza sativa
  unsure (1)..(744): unsure at all n locations
atgttcaagtacgacnagctgtacagnannncatcaacgatgattggggagtaattccatggaagagttgatcagttggtatcaactcgttttgcggaattcccatcgcgtccaaagtgttggcgaaaagaagattgattgagctaccaccgtcaatgagaactcgcgctaccttgatgttccgaatagtgggttcgaccacgatcagatatcgtcctgggataacgacggtcttggggtggtcttctttccgagaactctatcttctgctcagaccacttcatcttgggtgtagccccctgccatgtcgagcagacttcatgttccactttcttgtattctcgcttggaggagtacgttgtggaaccgccgaagatgtgtgagacgtggaggtcgaagtctggatacgctgagtccggttcgtgaggagctgtctcttcgttcgtctcgacaacgtgtactcacttgcctttttcaaatgccatgtgcttctcgagcgactttttgaaaacaaggcaatcttccagagaatgtctgtccgtcttgtgtatagggcaccatgatttctttgggtcgctgctttgggggtctatgcgtttgggagggttcgcgtattctgctgcgaggacttccgcttgagcttttcttttcccggttttgcgatttttcttcttgcttgactcagatgtgtccggggctggtttcttctctcccccggtcttcggcctatcgttctttgcgctc

SEQ ID NO: 3751 - DNA, 2324 bp, Oryza sativa
  unsure (1)..(2324): unsure at all n locations
ccgtcgttcgcgattgttgtgattgtggtggttgttgtggtcccggtcctcgtttgagcggtctcctcgatttccgttatcatggcgccatgaagagacatgacgccgagagcgattcacgttgtctcgtgtgcgtcgtgcttcccagcggccgttgatttgatctcgaagatcgccagtgccgcgaggagaaggggtagcttgttgaggtgattccctccgttccggatcttcaccattggcctcgctagttggtggctgctcctggtgtgctgcggtagcggcttcttcaaacgcgttgctgaggttagtcaccgattcccgtagtcgttctgtccaacgctcgaggtcaacgttcagaacaggatcgtaaggagtttccctcagtatcgcttgaacggccctgatgtgctgggctggagtagtcgattgattccccgcttctgtgttggcgtgcgctgacgtgccgatgtcatcgatagccaatacctcccgcggcgcactcgttgtcgatgacccatagtcctcgagaagatgtaagaccgatggttcgtaaggatcgatatcgattaccccaacgaatcgatctgaagttggagtcgctccttgttccttgccgtaatccatgatgggaacgtatgacttaggacactgagctttcatggcactgagaaagactttgcagctcgagaggtcgtgattctttgtcttgtgaataggacaatagacatcccgagttggagaagtacgctgaattccacgttctttgcaggcgcaaatttcagcacggacgttgaggaaaacccatcaatcttgcagagtgtgtttcttggttttgtggataggacaccaagaccttgtggcttcggaagtcatctttgttggctcatggttcatgtcggaaggacaaggtttggccatatcagaatccttcttgagcttggatgccatcgatattccgttctccgtctcgatgggaggatttttcgacatgaaatcgccttggtttgtagccactgcgttctcgtctccggtcattggaggaccggttgagatcggcgtcgtggtgtaaaccgggaagacgatttcgccgacttgagtccataccagcattgttgaagcagggagtacttggctgaggctggtgctaacgttgttgtcgacgaagctagatgacatagtagtagaaccttgagtaccaaagccccctacctggcgcgccactgtcgacggatgatacccgtagaccggatatagagggtattggggtacgttggtacaaggatctacgtagtacgacatcaagcaaacaaaagacaagaattatactggttcaggccccttgataggtaatagccctaatccagttgatgtgggattatatggtagaaaacacaggttacaaagagaataagggaacttgtcggatccggcgagattgtagtcgagttgattcgactagctctcgatgacttggctcctcataagctccggcttcgtaggctgtggaggttgtgttggctctgagattcgatgtctaaaccccccggggggcccttttatatcgcagatgaggaggtctcctcatagaactcggaggtatcagaccttatacgatacgccaacgacccagttctgcccgagtaggattcttcccatctatagattccatgaaaggtttccttagaatatacatgaaatatccgcctgcgcgtgggtatgccatatcgatatgtaatgtatatcgaagggcaaatgatatgcctaagccgtaaccctgacagtaagtgacataacatggcttcaaatttcaagtctcggagtatttgacagctctgcttctaaattctgcagataaaaaaaccactctgtattgaagcatacaaccagtggtattattattaaaatttatataaaaaagtagaaatgttgactattattttagaaagaaaaataacacgctacatctttttgttgatttgagaagttcagttcgagaggtttttatatcccgataaatatccattaccttattcgctacgatttgtattcgctctgtttttatattctataatatttgattccgtttttatatccggggcttccgattcgattatgatttcgagaaaaatatggaaacgaaaacgatagtgttggtttccgtctgaaacgacagtgaatcaagaataaaaatatagggtgagctcatagtatatgtcaatagaacaaaaataaaatacatatcgttgtgcaagttaaatttagtgcatacatgatcaaataggaatgatgnctnctgtacgactagttatccattnggctcg

SEQ ID NO: 3752 - DNA, 7419 bp, Oryza sativa
  unsure (1)..(7419): unsure at all n locations
gtgagggnattgannatcgatcgcctatcagctcagncagnncataagttaaggccgagtatgaagctcgctttttatggtcgcttaactgcataagatatatattgcggcaggggttggcttttcgtggtcatgatgagtcaaggaattcagagaataaaggaaatttcagggaacttttgcaatggttggcagggaactttgaagaggttaataaggtggttctaggaaatgctcctatcaattgtcaaatgatagatcacgagattcagaaacaactcattcgctcatgtgctcatgaaacaactaaatttatcatagaggaacttggtgatgagtgttttgcaattcttgctgatgaatctagtgatgcctaccaacaagagcaattggctctttgcttgcggtttgttaataaagcaggacaaccggttgagcggtttcttggccttgtccatgttgaagataccacttccttgactcttaaagaggcaatcaagtccttgcttatgcaataccaattgccattgtccaaggtacgtggacaaggatatgatggtgctagtaacatgaagggtcatgttaatgggttgaagaaactaattatggaagattctccttctgcttattatgttcactgctttgcccatcagcttcaactaacccttgtagcggttgctaaggagaacactgattgtgcatggttttttgggcaacttgcatatttgttgaatgtctttggaatgtcatgtaaaaagattcgcatgcttcgcatagctcaagctgagtatatgattgaggcatttaaattgggtgaaattgaaactggccagggtttgaatcaagagatgggcttagcaaggccaggtgaggatcatgtttcatttaacatgttatatttggtactcaatcatgttatattttgtactcactactactttaaaatatggtggcaggtgatacacgttgggggtctcactacaaaactgtaatgcatgtgatgtctctatatccatcaatcaagaaagttctcttcagaattggcaaagagtgtacaggggttgaggctataggagctcaaactatgctagaagtatttcaatctttcgagtttgttttcttgctccacttgatgaatgacatatttggatacaccgctgacttttgccaagctttgcaaaagagggagcaagatgtagtgaatgcgatggatcttcttgcgttcacaaaggtagaactagatgttttgagagaagatgatggatggcgagaattccatgggaaggtcacttctttttgtgtgaagcacaaagttaaagttgttgacatggatgggaagtataagcctatacaaagatcaaggaagttctttaaagatgccattaattaccatcggtttcatgctgatatgtttttgggtgtcattgatagacaacttcaagagttgaataacaggtttgatgaggtaaacacagaactccttagatgtatggcatcattcaatccatccaaaggattttcagcttttaatgttgagagcttagttaagcttgctgagttttatcctcatgattttgatttcgaagaaatgaaccagctttcttttcaactcaaccgctatattagtgatgtgaccaaagatgagaaattcactaatttgaaaggtctagcagaactatccatgatgcttgtcaaaacagagagggttcgtcggtatgaacttgtttatagacttctcaaattggttctagttctccctgttgcaactgctggtgttgagagggtcttttcttcaatgaactacatcaaaaacaagttgagaaccaagatgggacagaaatacttgaatgattgtttggttacattcattgaaagggaattctttttgcaagctaaggacaaggacatcatcgattattttcaaaatatcaagcgtcgaaaagttaatctctaaattgtaagatttcttcccaatttatcattttctatcatttttatattccatatgttggcactttgatatgtttatcaattagtatttctatatgttaaacaatttcacgtgatgatcaattctatcaatgtgtgcacttatgctcaattttatgttatatacactatatattatataattattagtgtgtgatactatacaagccaattattaggtttttaggtgtatgaacaaaatttttttctttccccatttcgaatacacaagttcaaaatcctgggcccgccactgcttctgcccttatctgcttgatgaatactagttgaattgatcacaccaccatttaattccagcatgcgtggagacgctagctagctgctgatttcgcttctgctggatgtttttgatggttttgttgacgtgtggtgtggagttgtgcggtggacgaatcgctggggggatttcgtggtcaggtgttgcgatgcacctggcgcagcgtcagtctcatcatgcatgggatgttgatttggatgatgtctaaaaataccataattaagagtaggtaaattgtggcgagaaacataagtaagacttgaaaatagtttggtcataagtatgacatatggtgatgtttaaaactcatgtagatgaggatgaagataaagatcaagtgttttacgcaaaacgaggtggtactaacatattgtatgattaattgagtattagttattatgaacttgaaaaatatttttatctgacattttagagcaacttccatatagaaagttttcgcacgaaatgtatcatttagcagtttgaaaaacgtgccacgaatatctaaaattttcatacaactttagttggaaagaaaataacagggctctgctctaagattgagagtatgatatgtaggatctaaaactaagaaaatgtgacatgacacaaccgtgacaacgaaacaaacacacggctaaagcatgacgtggcaaaatgaggaaataaaccaaacaccccctcaatatgtcggttgcaatcagccgctttggctcaccggaaaaaacatactcaattagcttatcattacttaaatattaactattattacaaattacaaattatatttattaatgaactatattataatttaatattgccgcgccaagtaaaaattcatagcatggtaaggtttttgctgcgccagtccaattggtgccaaatgttgtgtgttattctgctatctcactggaatggtcaaaaaactttagaattggaaattataagttttaggtgtttatttttcatattaaaaagtaatccggttaaaaataataataaatccttatattgttcccctgctaggcacactcatcatttgagacatggacgggtatcccatttgcatccgtgaacttatctttcagcccatgtcattagcataagataccacaagtttgtaatgagatgataataccatgcatatatacagacacaatacggctgcaagttgggggtacttgagagctgttgtcaacctaattgttgatgaggaattatatctttaatttcttgccgactacatgagtgcatatatgatttgtgtatttttaccacatgaatgcgtgtttagttagtgtaaagttggcaaagtacaatatatataactagacaaaagctttgactgattgttgtgttatgcattgtacacatactaacgaattttgctgcgcaatatcggagctagattttaaaagaatttaatttgattataactcttggatacaacggtatttcgtatcacccgtcgatgacaggacttctgtggtgacttcgtaaatctaaaaatatattgatctaatttttgaaggtacttataaaagtaggatatgtgtgtaagttaatcagggtatatgtgcacattttatatgagcgtctgcctatataccgcgtttcggagaaaaaaaactacagtaggatttgatatgcacagatctttagctcctgtatttcatctatgcaattgtgatagtaaagccaacagacaagaatacaaaaggatgatgatattagaaatccaaatcttatgaatccaagttggcaactagctatacatattgggggccggggtacagctaataaaacagctgcgtttgctgatcacttcagcaagcctgtatttctttcagggatggatgcgcgtaggctttgtcgtgtgctaacagggtcagaattggattgtttatatatacatcgccttgagaaatatatggcgtgtgcagtgtgtattgactcaaggaaaaacaatcaaatatatgtggttcgttgtttgagatgataagtgttgatctttcgaatgaaaaatgtaagtcgctttattagtagctagtttagtttcgtttcagaaatggatactttgtattgaaagtatcaataatgcagaagatctacaggaatgtttattaacaggcaaatattcaccatctgattaggaaataactacctagatcaatcattgggttttactagtagcagagatcaagaataagggtgtgtttagttcacatcaaaattagaagtttgattgaaattggaacgatatgacagaaaagttagaagtttgtgtgtgtagaaaagttttgatgtgatgaaaaagttaaaagtttgaagaaaaaatatggaactagactcggcctaaagcagaaagaatatgacacacctaattaataaggggtgactgaagaataggatgattcctagctaaatatagttatattttgaaacaaatgaaataataggtggctggtgagaaagtagtactctagagggctcaagtgtgaaacccataatcaaaattactggaaattatatacatgctgtgatcccgggaacataagtgtatgtacgtcactaagaagttttatattttagataaatttttaatcccagatatattttagagggaggggagtaattttgaccacaaatataaacagctcagatgtatcaaaataatcaagtttatcttttaaaaagtattatgataagagtaaatttttgcgagatcctcgtccaaaagggaaggaaccaagatccatgattgtagccaatagacacatatatacccaagattcatatatatgttaatgccctcagagaatatacatttgttagacaattgttactatcacaattacaattattcacaactccaaatatctagctagctgctccactggaggcaggcatgcgctcaggacaattagccaaagtacaagcaaacaagcgatggtagtacaaaataagtgacaagttgaggatcagccagcaccagcagggtcccgcgagatggattcttcccaacaactccggtgaatgactggaccgtgacaaagatgagtgcaggacacgaacactgcacgtgttttattgtgatatgctgtcaggatctggggatctcagtttttttctagtagtaatgcactgatgcatgatgtggtagatcaccattatactgtactcgctccgttttatattataaattatttaacttttttctctagtcaaactttattatgtttgatcaagtttataaaaaaattaatttcattaaatttgacattggatattgaatatattttaataatatgtttgttttgtgtactatatttttttttataaatttgatcaatttttttttaaaaaattaactagaaaaaaagtcaaacgacttataatataaaacagatagtagtaacatgaatccgtttatctactactatctctatcctaaaatattcagatataagttaaaagttgttaaagatggaaggagtactagctggagtagcaaacttggtcaacaaagatgtttatgtgatgttgattattcttttgctccctctgattttctgcaacctgaacatcgtacatgtaatgtggtgtatgcatgtgctaggtgaggagtcaaggtgacaatatttttttgtttgtctggagcaagtaatttgtttgacaatgtagatgcatggatttcaagagagctatcatagttaatgctatcatcaactgagttcaggaaagggactagcaagtaaaaaaatgggatggagactaagtagttctttgatcgctctaaaactgctgttcagtccctttccttaacttgtgtgttaatatggagaattttagtcctttggttcgtggagagatattatgcgaaaatgagccagttgttaaaagtaaaaaaaaaaaaggaaacttataaaactcggagctataactgggatcacatatttccgtcaaatctatgtatgctgcgatcatgaactgtaatgtttaaataaaaagagaattctgggggacttgaacattccactaaagatcaaggtctttacgtggtttcttcacaagaaagtaattctaacgaaagataacctggctaaaagaatattggggggataaacattgttctttctactatgcgcaagagacaatccaacatcttttttttagtgtcatgtcgctcagtttgtttggagatgtgtgtttttttgcttttaatatccctccaccccgtaacgccaaaaacattttcggtaattagcttagaggggtatctaggtccattaagaagatgattataattggagctagtgttgtatgttagtcaatttggcgttgtcgtaatgataaagtttttaatgataaacaattatctaaccccatgcagattatcttcatgtctccacttctggtctatgatgctaccataggaggagcaggatactatgcacaatgatgctacactcttggaatcggtagccaaggatctcttattccactatgggtggcgtagtttcattagaaatgctagctatttttttttgtgtagtttaaagctagtcaataataaaggaggagttggggatttgtcccatcaccttatttctcattttgatttacttttatcttacctttttattattattaaacttatggctatgtgtcttatgacagaagccggagatgtaatccattttcattattaataaaaaagctagggtcatgttgaaaaactctactgagaaatcaatcccatcgcgacatgacaaaaggcaatttttaggtgcaacagtaaatgaagaaaaaaaaaagaaattttcacacaattatccatctatatctataactaatataaatattcgtatttttccggtcgtcacatctaattttcgtctgtttttcgtccatacacaatccgattcggttagcaatagctaaggaaaaaaattgcaaaaaaagaaaaagaatcggcggtcgtcgacgccaccgccgtcgccggagggagaagagaggcggcggcggagggagcgccgatgccggacccgcccgcggtggccaccaccgccaacggatccaccctcggacgaagccgacgccgtcgtcgcggccgttgagaaggcgccgtc

SEQ ID NO: 3753 - DNA, 19584 bp, Oryza sativa
  unsure (1)..(19584): unsure at all n locations
nagaaggagccaatagggaaaagaaaccacccgcccgctgcccgctactgagtttatgatttacgtcaaccaaccttttcatccgatcaataggaaaagagaacggggtcctaccgccgttcttttaaaaagagtttcgacggcgcgaacaatatctccgacccccccaaccgtttgtggaaagaaaggcgtgcaccgccgccttggtcgctcgtaaggggagaaggggcggggggaggggggaaatgaatcctagggttagggttagggtttgggtgtatttatttaggttaggattaatctggaccgtccattcaatcggacggctccagctgctcccacgtcgggccgccggcctattgggccaccgaatggaggacgtaaaatggacttcaatggagatgaaaacaggccagacacatagaataaaagggagggaatataacattttctatattcggcccaatcatagaaaggaggattttgattttttttccaattaaataattgttaaatgcttttttattattaaaaattagcaattaagctctgataattacaataaaattccaaagagtgtaactaatcatggaaaatttaataaaattaaatttaaccatgttattttatttttcacacttgctttacttgtaaattgatttttatacacctacctatttaaaaataccaaatattttaattaattacataatgtaaagttttcttaactttttctcaatttttttttctgtacacttcctgttgcaacgtacgggcacctttgcttattttaattaattacataatgtaaatttttcttaacttttttctcaattttttttgttctgtacacttcccgttgcaacgcacgggcacctttgctagtatatatatatatatatatgctctaattgggcactttttaggaacgttaacatccctccattgtttgattgaatgtattatcatgaccgtagatcctcttgagggtccatgttaaataaatcatgccacactttacgcccaagaaagatcatgccattgaaaatgatatggactcttatttaataaatcagaaattagtaattaataataaatatggtggcaaaaatatcaagcttagactgtcagtttagtattttattaatctatttttaaaattcgaaattaataattagctagttgtaactgacgtggactctcttttaacataagcaactacactttcaaaggaaaccaacacgttaaatataatattagagctttaatatttatagtgtcaatattcattaagaaggggtgaaacgatgatatgttcgcacgttatccgtaggacctctcaaagaaagaaattgaaggatatatgaaacgtttgaccattcgtcctagttaaatttttcgtgcaaatataaaaatatttatatcatgcttaaaaatatttgatgataaatcaagtcatattaattatataaatttttttaataagataaatggtcaaacgtttagtaaaaaagttaacggtgttatacattaaaatacggagggagtattaggtagagttgtcgtttttgctacggtatgtttcaggtgttagggcaccaacgttgcaccaacattattttcaataggtcccataatcagggtagttagtaagtttgtgccaaatccattatgtgttatggatagggtggtaaacaaggcgaggcactattgaaaataaaatcctctaacttcagtctctctagtgagtagaaacactacaaataatatgctttatttgcttgttgctagtaatagcacaaagatccgctttttgttattacctcttcccacgatgcttattacctaatagcaacggtgtatttattgcttgttaccgggttttctattacgggtgtgtttagttatttggttgtaaagtttttgatgtatacggatacacatttgaagtattaaacgtagactaataataaaacaaattacagattacgcctgtaaactacgagacgaatttattaagcctaattaatccgtcattagtaaatatttattgtagtatcacattgttaaattatagtgtaattaggctcaaaaaattcatctcgtaatttacatgcaaactatataattggttttttttccacatttaatgctctatgcatgtgtccaaacatttgatgtaatttttggccaaaatttttttaatctaaacaatgcctacattgtaattgcccatagataggccctgcacaaaaaccgagttatttcaccctgttagctgaaatgcagtgatcctgccacttggtcttgatgaaacaaacaagaacaatagtgaatgaacccagaagatcgagaatcattagaagacaaaaataaaaggaccacccatcatttctacgacccagcagatttgtcggattttacatcatcttgcaagttgcagttggaccactaaccgactaacacaagcagtgttttctgcacgatctgcaccgatttccccttccctgagccagccagtcactgatagatgactcccactctcctattgcttcacacgttagtgtttataatggttattagtaatgatagaggatgtaaaccttatttcgtgcgaattctcgaacgagctctacgcattcacggagcaccaccgccacctcatccgtgacaagtgttactctggtgactggaagcagcaattgagcgtcagataagtagatgtgcctgctgtaagagagaaacattagtaacattgaaccacaaattccttgatcaatagttttctgatcatatctgaagctctccgtagaagcttaagcatatgcaacagaattgagctttgtaacaatcagcaacaacacaatgaagagggattcgatgaaaagctacggtagatttgcgagtgaacaattcgcagacttaactgctggtttcagtttcttccaaaagaaaagaaactgcagtttctgctaggtacctagttcttcatctcatagccaaacatgcattaatcttaccaaatatacaaccaaagattttgagaactgaacatgttgccaaatgaaaaaacgcaatatatcaaaagtcatgtgcagtatttcataactaatccactatgaacttcagataaccagcgcattattgcctaatcgaccttactcaaaagctctaattagatcattatatcttgccaccaaaacatagtagtactaattactgatatgttattacgatatatagttttaccatcaacaagctattagtacgaaaaacctatatgcacatgggatacctgtcaagaagtgcatatccactaaatctaaaacttaacgtataaagatgccacatcatcatccactaacaattattatatttaaacatcgtgtaaacatgttattttatctataattttataatttattaaattttatagctttttaaatgcaaacatgttaagtcatcatcttatataattcacataatatttcaatatgtcatttttcatcttttttataatatcttataaatctttatagttcatcctaactcctaacttagttaaaatatgctcctctctctctcctcttattaagttacatcacttcaattgttttgttcttagatgattatctatggtttaaattatctccctcttttattctcttattaagtcatatcattgatccttagttaaaatatgctcccctctctctctctcctcttattaagttacatcacttcaattgttttgttcttaattctcttattaagtcatatcattgatccttagttaaaatatgctcccctctctctctctcctcttattaagttacatcacttcaattgttttgttcttagatgattatctatggtttaaattatctccctcttttattctcttattaagtcatatcactgatccttagttaaaatatgctcctctctctctctcctcttattaagttacatcacttcaattgttttgttcttagatgattatctatggtttaaattatctccctcttttattctcttattaagtcatattactgatcaattgttttagcccttcgatatttaatctacggtccaaactatcttctttcttttctttctctcgtaaagtcatatcagcttacttttacatttgaatcatcattatacatactatttaaatttaaattattataaaccacattaactttcttaagattatattatctagtattctagctatatatcttacacattatttttacttagtaaactcccgtagtaacacgcaggatttcacctagttcaatatatgccaccagaggccacgctaccaagttactactagatgtcactagagctaattatccatttcacaactactagctagtaatactaattaagtatgacttaattacaattagagatgattaattattactactgctacagcattgccaacttcttaacattgatagggtagactttgtccggcgagttggagccgtacgccttgcgtgccagcctggcattcaccacgtctgtcgggtggagcccatcgaagaaggcgtacttggtcctgtcactgcagatggccccccccttctgacacagcacgcctcccctcgacacctcacagcaagctcgactcgttttcctgatgcctgagcaattataaaaaccatcaaagcaaattaggcacttaatacagctagctttgttgcttgcacgagtgatgaggaatgtttggattgatggacaaaaacacatgaataataatattgtaggaaaaagaaatatatagaaatatatgaataattaaaaaaacaacactgaaaaattaatatggacgtggttttggaacatgaattttagacttgcttaaaataaaaaaggtgtaatagattctttcaaggaattttttccctagatttgaggacattttttcccttgatttgcactagaataacaatagaatagataatgttaggaaagttttttcaagggattcttgatccattcctgcattccaaacagctatatagctaaaaagactataattttaaattccttttgtttttctttaaaattcccctaccaaatagaccctggaaatatcacgagaaaatagtagtggtaggaaaggaaaaggggagggtgcatcatttcactcataactaatttcttttgagtttcagaaatatatgatcgcttaattattaccatattttgccgggtgctgtattatatcgctaatgatcttgtaggaattgacgtagacgaagctcgcggcgggcatgtgtgacctcacgccaccattgtgatttttaacgatagatcttagcccagagttgaagaggagcgccgcatggttcatcggctcaatgcaagcatcactggtagcgttgaggaaggtcctcaccacaggggtgcaacccaggggttggatggagaatagcacaaacttccttgcccctagatcatacaatctctgaaaaaagtaaaaataagagtcataatttaaataaaacatgtacaaaagatatttattgtatctgttgattattatgtgtaatctcgaagaatataaaagggatgatatggagaaaagaaagactacagtaccaatcaatgtactatccatccaactactatgtactcttgcaatattattatgtcatgtacccttcacattcattacttctcagtctgagttcaaggtccacatatatatagctgcctgtacattttctccccagttccttctctttatttcacatgtaccaggaactataccaccatatccagtagttataattaattaacatgccatatctgtggctttaatagcaaatccatatgttatgggtacacaaagatatactcctacttaattaaggtgtgcattaaattaaggtggtactacctgcaggtggtttgagagcttggtgaggagtgagcttgtgaactctgacaagggggcccttgtgggcccactaccagcgttgaagtagttgagcaagtagtcattgccacctgtcccaatgataaacaggctcttgggcaggtaacactggtcaaagaaatcctggcccttcatcttgtgtccggtggtggtggtggctgtggttgctccctgcaggtgggcccgcaggtcagggagtgtcactgcctcaaagttggtgatctgctgctttaggctcaagacctctccctaataagattagttacagacacaaattagcaattaagctggctaattttacatcttaattcttttgaaacacaagaaccatacactttatttcattaagaaaaaaaagtacaacagagcaatttataaaaatgaaacctataaaaaacccatcgcaagcaatgcgtataaataaaactcctaaccatccatccaagggaagcaatctattttgatgcttagtttataagttgatttgaggtttctttatggcattatgtttctagttgtggctttcaaacttttaagaatagatttataggggatgtttggattggttccaatttgttttggtagtttcaaatagtgttttgttggtatttggattaagaccaaattttttacctagctagtaatatatcgccctacaaaatttgaccgcgtcaaaatttatctagattttaacactaccagtattttagtagggttttaaaccaaatcagcccataataattttaccaaaaatatgtcttgaaccttttttttcacaacttcagccttagctcaaccgaatagagcctcaccctcaaataaacgcaagcatcattacaaggaatgaagaagtatactccatccatcctaaaacatacgacgccgttaactttttacatattgtttggccatctatttattcaaaaattcaatataaatttgtaaaaatagaagttagattatagttttttataataaaacaagtaacaataaaacaaacaatatttatatttttaaaaaaaacaaaatgattgatcaaacattataaaaaagtcagcgtcatcgtatatttttagaacgaagggaattactatatagggacaattgctcatcaagtaacgcagaccttgttcttgccggtgaggtcgaggatgccggagccgccggaggcgaagttgacgccgtggagggcggcgcggccgcgggtggcggggtcggcgaaaggcgggaggaggccgccggcggggaggcgaaggagctccccgagggcgtcgatgacgttgcggccgttggagaagcggccggtggcgcccagcgggaagtcgacgccgtagggcgcgtagtcggcgcgcacggcgccggagccgttcaggtggttgttgttgccgttgtccaccagcgagctcccgaacacgaacaccgccctcaccgccgccgcccttgccgttgctccgccgccgccatggacgacgaagctcgcagcagcagcaggtttgcattggtggcaatggagatgcagcagcaggaggaagaggaagaggtagaggtagagagttgctccgacgagcttggccatggccggcaagctgatgagctagataatgtggctgcacaagatcgatagcatctgctacttgtatagcagaaggagagaattgaatgctactagccggtaggtttgggcactgcatgcacgtcgtggtttagtaattacagtttgggggagagagagaagttactgcgtgctggtttttagtatagcagcaatttatgcgggtgcaaggtgcaatactgcaatgcatgtacagtgtccttcccgcgaaggaaggatctggtgcacacaacggcacatgccatttgcccaactgtaatttggccttgttgagttcgcgaaaataaatattttgggtgtcacatcaaacgtttgatcggatgtctgaaggggttttcggatacaaatgaaaaaactaattccataactcatatgaaaacctcgagataaatttattaagcctaattaattcattattagcacatataggttactgtagcatttatggctaatcatggactaattaggctcaaaagattcgtcttataattttcatgcaaacggtgcaatcagttttttattgtatctatatttaatgctccatgcatgtgtccaaatattcgatgtgacgttttttacggggaaaaaaatttaagagctaaactaggccttcttctatcccctcctcccacttataactcgcaacagctggtctatatgcaaaaagtaaccaccgaaaacagtattttatcttaaatcatatttatagtagcttatttctagttatatacatatctgatgtgctacgagctaggtcttttttttaaaaaaaaaatcacattgatatgttctagggcacatctatattgtataaacaacatgtgctcaaggacggagaacaaggaaatgttcaagacaggcagtaattgcttatacactttgtatcttatttttttctataatttttcatagatatctaacacaaatcaagaagacaaatttagggctctggacttaagccctagttgttctgtcttatctcggccattgtgcattttgaccattgaatatatcaaatccatgcgtaagatctttggtggtgttcgattctaacgatcgagtcaagtttgcaaaacaagaaaaccatttgtgtataattaattaagttaaaatatataaaatttcaaaaataaatttatttaatattttatagtgacttttatataaaaagttttcgtacgaaactcactgttttacgttttacatgtttagaaaacatgttaatagaaatcaaggtagaaacaatatcttaatcataatcttaaggaaaatatgaatacatgaatgtagaactcaaatatttggagatatgtttcagattagggatggcaacagggcggggtgggttgggctggaatgcccctgcccccgacccccgacttcaccctcctcccccgtccccggcctcgaccgttgatgcagggccaaatcaacccccgtccccgacccctccggggccccgcaacccgaccgggcccccgcattggatagcatctccatccaatcagaaaaaaaatacaagacattcatcaaattagcaaaaacaaaaattgcacatagtggacacaccatcaaaaatagaatgaatcgtcggcatcgtgaatcgctggctgccgccgcgcctgtcccctcgctgggcgccgcgcccttgccgcaacctcgccggccgttgcgctcctgccgcaacctcgccggccaccgcgccttgccgcacgaccgggcctatgcgccaccccgtgcgtcgtttgcactgccggagggagaggtggaggtggactcgggagggagaggtaaaggggacgggatgggaggccagaggggagaggagaggaggggagggaagagggcgaccgacgaccggcgagattcagaggtgcgccatgcgccttgcatcgcgccgccgtcgtgcgccctgcgcaacgccgccgccgtgcgtgatgtggacgggagggagatggggatgggggagactagggagaggataaggttagggtttagtaattttatttatatatctcctttttttttgggttgggctgttttggatcttttatgggctatattttgagagttcatatacacttcccggggccccgcgagtgaaatgtctcccctgtcccctccccgctcaaatgcgggtctccggccccgactcccctgcgggtccaaaatcgcacccgcccccgcccccgtaggggcgggtccccgcagggggaaattgctatccctatttcagatcagttatcaacttgaacttggcactgcggctgatatcgtgtttctggcttttctgtttgtgtatgggcaactggccatcgcgcatttgcactgctactgtactgagctgaccgtgcatgcatatgcgctagatcgatcagtatcatgagtgggttaaattaattagggttactggcagctagctgctgctgggccaacgttacaatcagttccataaaagaaaaaaactcaactcaatctgttctataaaaaaaattctaaagattaatcgtctaaatataatttagacatagagggagcagctggtagctcgatcggtgacagatggtttaattcgcacattgaatgagaaagtacttgacccagaaggaagacgaaggaatagaaacgctttgtccgcaggtgttctcccttcattgaagtgtttgtctatgtgaagttccccttctcctggtcataagttttcagtgcacacatgatacagtgcaatgatgctctgggcgcgtctcatatggtttgagaacatctgacgttactgttcaccccgtgactgacatatgggcccgccactctcaggcccacatttcagccatcaagttagagggaagttacgtcagaggatctcaatccgtcttatatacatatagtagcatttattttactgatactgatagaagagaataaagataaataaatatgaatagtctctttgtgggtctcattgtggaaaattctaattgttgtattctgatgttttctgatctattagatggaccctctcatagagtatatataggagtacagagacttggagtataatacaagtaagagtagatttatctctaggattctatctctagtactctatcttatctataggatatatcttatctctatatttgtatttgactcttatccctaaccgacatatccatacttctaacactcagagtagtagctagatcgagctcacagtaagctataagctcataaaatcaacacatataatatgttaactatctctttctctcactttaaatatatttatcttcgagtatatgtagagctagctattatataaaggccaacaccttttattttttttatatctctcttacataagcttatatctgccttatagtccaatattatccttgctcttagatcatctctatgtttgacttatcatccattgctaaaatttatattttaaaaccaaattttagagttaactttgaggggtttttttattgtaaattactttcagcattgaattttaagccatgaataatacatatataaaaattttacctacaaattattttaaagtcaacaccaatagttacaagatccgcaagcccgtccagacgaagaggggcaagaaaggtgggaagaaggcagccgataaggtacagttcgaagttcttgcgaagaacctcatcatgagactcggacatttgcatgatgtcgatcatcttgtcatactccttgtatgatgcatgcctatacgagtgctctgcatggcactacggtggaaggtggagagtgtcttcttgatcttctctgtgtccatgacaactttgccacagagggagaggttggtacaaatccggtgcagtgtggagttgtagccggcaacgctcttgaagtctgtgaacctcaggcgagcccactcctgctctgcttggggcaagatggtatacttcagcttcttgaatcgcttcttgagtgaggtccaaagagcgagtaggctctttaatggctcaatcccatttcctcattcttgagcatggcgcatagatgttgtcataggaagtgcaaggcctcatcgttctcgtcagggataagcgcacgatcttgcagtgtgcccatccagatcgtctggcaaagcttcttggccctgaggacactctggacattggatgcctaggttaggtagttttggctgtgcggggctagataagcgaactccttgttcgtgattcctgatattctgttgcaaagtgataaaaaattcaaaagtaactgctagtaacatgcttgcaaatacgaatacaaatattttattattttttccaatacttctatgtaggaaatgcgaattattcaattaaataaatacaataaagaaatgctagagttcatacaaaatatatacaaaagaagcataaagtgaatatattcatataaatactgaaaataaaatttttaatatcaagtaacagtaattaatgcctcaagtatgaaaagacaagttcaaattctaaattcgtaagacacaatatgctcaaaaacgaaatataagcgaaatttgcaaaaaccaagggccgttttctaagtttccatgcggtggacggttagaaatggaagtttccgaaattctagtattgcgcaaggaaactccatgctgagagttgtgggtgtgattttcaaaaaaaaaaaaaataataataaaagggccttttgcaaaattgccaatttcattcctttctctcttgctctttcctttccccattgacctcctcagcgtggcgctgcggcgaggcgaggcgcggcgctggcacggtgccaaaaacctcaatcggctagtgccgatgactccaagtccgcaatggtggttttcgtcggaagtcacataaaaggaacaaggaggatacaacaaggaatttatttttgaaacccagtatacaagatgcaaagtggattttcgaggttttgaaatttaatgtacaagatgtaatgacttaataagactcggcccatgccggtccagcccgaagcccaccgtgctcctccttacaaaagtctattttgcctccctcatctcttttgggccatctcttatatggctatagtaagtctattttgcatcccttatgtccccttgtatggctagaataaaactattttggcgctctcataaaataaaaagtaaaccgaaggtccctcaacttgtcatcgagttacaaaattgtccttgaaccataaaaccggatatgacgcatccctcaacttataaaaccagtgcatactagatccctcgggggttttgactccgattttatcctatgtggcagctgacttagcgtgggaccacgtaggccccacgcgtcagcctcttcttctctcccctctccccctctcttcctctctccccacgggcagcggctggcaggcgcaggtggcgtggggagcagctgcacgggcggaagccggcggggaacaattgggcggcggtgcacgagctcctccgacttgctgaaagagcggaaggccaacgcggcgacgaggggtgcctgcgtgacttcctggagagggcgaacaaggacggcggcacaacgatggagtacagggagcgcggcgtgttcaacgcgagcgagatggtggtggagatacagagcgtggaggctatggggaacaaggacctgttcgtggttgggagatcaccagcatgcattccgccgtgctgctcatggtcaccgctgttaaatatgtgatccgaattttgggcccacaatatattcggattagtttcctagtaggagtcctattaggtgtctttcttttataccctatatatactcttgtaagccgtacgggaaggggtgacgttcctattgtgattcccctacgtttgtaatcatctcctctatagtgatcattgccggtcggcgcccgtggttttttcccgcaagggttttccacgtaaaaatttgtgtctccgttgtgcatctattttcataacaagtggtatcagagcattggagatcgttctactattcccggccaccggcgattgtttctcgatcgaagaaatcgatcttatcggcggtggcggcggctcccgtcgtctcgtcgattcccagtccgactcagtgtttcttgtcctcgtgcagaggagaaaagccgcgcaagcaatcgaagcagaggagtactactgcagcgcacgcgcaccgaggaaaagtataggagtatcagccgagaggtctgtctagtacaggcggatttttcctataggcgaatttgctatacgcaccaagcttgtgtacccaggagatctacatacttcgctacgtgcacacgagaagtgtaccaggtttcgtgtttttgctaggtttaatttctttctagcaaattcaggattaattcccatggcgagtttgaagtatgatctaccgctcttggaccgagacacaagattctcactttggcaagtgaagatgcgagccgttcttgcacagcaagacctcgatgatgcgctttctggatttgacaagaggacacaggattggtccaacgatgagaagaaaagggatcgtaaggctatgtcatatattcatcttcatctatctaataatattttgcaggaggtgcttaaggaggagacagccgctgggctgtggttgaagctggaacagatatgcatgactaaggatctgaccagtaagatgcacctgaagcaaaagttatttttgcactagttgcaagatgatgggtctgtcatggaccatctctccgctttcaaggaaattgttgctgaccttgagtctatggaggtaaagtatgatgaagatgatttaggccttattttattgtgttcattgcctagctcatatgcaaacttcagggatactattctttatagccgtgatactctaactttgaaagaagtttatgatgctttgcatgccacagaaaagatgaagaagatggtaccctctgaaggtttaaattcacaagcagaaggcttggttgttcggggcaggcaataggagaagaacacaaacaacaaatcaagagataaaagttcaagtagctaccgtgggagatcaaagtccagaggcagatataagtcatgcaaacactgcaagaaaaatggacatgatatctctgagtgttggaagctacaggataaagacaagagaaccaaaaaatatgtaacaaaaggtaagaaagaagaggaaggtaaagctgcagttgttactgatgagaagtctgatgcagaattgcttgctgcttatgttggttatgcacaaactagtgaccagtggattcttgatactgcatgcacctatcacatgtgcccgaatagggattcacatgtgcccgaatagggattggtttgccacctatgaagctgtgcaaggtggtattgttttgatgggtgatgatacaccatacgaggttgcaggtattggaacagtttagatcaagatgtttgatggctgtatagaacattgtcagatgtgcggcatattccaaatttgaagagaagtctcatctctttatgtactcttgatcgcaaagggtacaaatattccggtggagacggaattttgaaggtaactaaaggctctcttgttgtgatgaaagctgatattaaatctgccaacctataccatctgcgaggtacaactatattaggtaatgttgcagcagtttctgattcattatctaattccgatgctactaatctttggcatatgcgtcttgggcatttgagtgaaattgatttggcagaattgagcaaacgaggattgctagatggacaaagcatcgggaagctcaaattttgtgagcattgcatctttggcaagcataagagggtgaagttcaacacatctacacatactactgaaggtattcttgattatgtgcatcctgatttatgggggcctgctcgtaagacatcttttggaggtgctcgttacatgatgactatcattgatgattattcgtgaaaagtttggccttatttcttgaagcacaaatatcaagtttttgatgtgtttaaagagtggaaaactatggttgaaagacaaactgaaaggaaggtgaaaatccttcgtactgacaatgggatggagttctgttctaagatatttaaatcatattgcaagtctgaaggcattgtgcgtcactacaccgttcctcacacacctcaacaaaatggcgtagcagagcgtatgaataggacaattatatcaaaagcccgttgtatgttgtctaatgtagatttgcctaaacagttttgggcggaagccgtttccactgcttgttatcttatcaatcgatcacctagttatgccattgataagaagactccaattgaggtatggtctggttccccagcaaattattcagacttaagagtatttggttgtactgcttatgctcatgttgataatggtaaattggagcctagagctattaagtgcatttttcttggttattcgtctggtgtgaaaggctataagttatgctgtcctgaaaccaaaaaggttgtgattagtagaaatgttgtcttccatgaatcagttatgttacatgacaaaccttctactaatgttcctgttaagagtcaggagaaagcaagtgtgcaggtggagcacttgatcagttcagggcatgcaccagaaaaagaagatgttgctattaaccaagatgcacctgttattgaagattcagattcttctactgttcagcagtctacaaaacgttctattacaaaagataagcccaaaagaaatattaaacctccttgaagatatattgaagaagcgaacatagttgcttatgctttgagtgtggcagaagaaattgaaggtaatgccgaaccttctacatattctgaggctattgtttctgatgattgcaatagatggataactgctatgcatgatgagatggagtcacttgaaaagaatcatacttgggaattggtgaagttgccaaaggagaagaaacctatccgttgcaagtggatcttcaaaagaaaggaaggtatgtctccaagtgatgaggcaaggtacaaaacaaggttagttgctaaaggttatagccagattccaggtattgatttcaatgatgtcttttcccctgttgtgaagcatagttcaattcgcactttactcagtattgttgcaatgcatgattatgaactagagcaaatggatgttaagactgcatttttacatggggagttagaagaggacatttatatggagcaacctgaaggttttgttgttcctggaaaagagaacctagtctgtaggttgaagaaatttctttatgggttgaagcagtcacctagacagtggtataagagatttgactctttcatgctttctcagaagtttagaagatccaattatgatagctgtgtttatctcaaagttgttgatggttcagctatatatttgcttctttatgtcgatgatatgttgattgctgcaaaagacaaatcagaaatagcaaagttgaaggcacaattgagtagtgaatttgagatgaaggatttgggtgcagcgaagaaaattctcggtatggaaattactagagaaagacattctggctagttatatcttagtcagaaaggttatattgaaaaaattcttcatcgtttcaatatgtatgatgcaaaaccagtgagtactcctttaactgcacatttcagattatcttcagatttatgtccttagtcagattatgatattgagtacatgtctagagttccttattcaagtgcagttggttcacttatgtatgccatggtatgttcccgtcctgacttatcacatgcattgagtgttgtcagtagatacatggctaatcctggcaaagagcattggaaagctgttcaatggattttcagatacctacgtggtacatctagtgcttgtttgcagtttgggagatctagagatggacttgttggttatgtggattcagattttgctggagatttggataggagaagatcgcttacaggttatgttttcactattagaggatgtgctgttagttggaaggcaagtttgcaagcaactgttgccttatctactactgaagcagagtatatggctatttttgaagcttgtaaagaagctattttgcttagaggtttgtacactgagctttgtggagttacgtcttgcattaatatattttgtgatagtcaaagtgcaatatgccttacaaaggatcagatgttccatgagagaacaaagcacattgatgtgagatatcactttattcgaggtgtgattgctgaaggtgatgtcaaggtatgcaagataagtactcatgataacccagctgatatgatgacaaagccagttcccgctactaagtttgagctttgctcaagcttggttggtgttacagtatagtcctagagactatttggcgcgcggtgattttacctacatgaggtattttttggtgattgatgtttttatgctacaaaaggaaattcgtctcaaggtagagattgttaaatatgtgatccgaattttgggcccacaatatattcggattagtttcctagtaggaatcctattaggtgtctttcttttatcccctatatatactcttgtaagccgtacgggaagaggtgacgttcccattgtgattcccctacgtttgtaatcatctcctctatagtgatcattgccggtcggcgctcgtggttttttcccgcaagggtttttcacgtaaaaatttgtgtctccgttgtgcatctattttcataacagtcgccatggcctttgcggtcttgaaggtcgccgctgttgtcggtgtccatcgggctgctgctcaacaccaagtgtatcatcgagctcgtcatcctcaacattgcaaggaacaaaggggtaatccattagttaattacttaatcgatcgccatgcgatgcatgtcgtgattaattaaggctaggtagctgcttgtgttgtgtagatcatgagtgaccagtcgttcacggtgctcggtgctggtgttcgtgccggctctgaatcgctgatcacggcgatggtgagccctttcctcgccatggtggtgaagccgccgcggcgcctcgtgttctacaagcggcgcacggtggcgtgggctcacccggaaccagaatcggagctccgcatcctggcatgcgtccacgtgccacgtgatgtgcccgcgctactgacgctcctcgacgtggtgacgccgtccagccggtcacccgtcggcgtccacgccctccacctcatcgagttcgtcggccgctcctcctcatcaacgcatccgtgtcgtcgtcgtcctcctatgacctacgacgcctccgtccacgggctcagccacatgaagatgcagttcaagcacatctcccacgccttcgtggcgtacgaggagcaggcggtgggcgtgtcgatgcgcaccatggccgccgtcttgcgcccgtgcagctcctccccccgccgcctgcgcccggctcctccccacgccttccgcgcccgccggcggcagcccgtgcagttgctccccactgccgcccgtggagattggagaagagaggagagaggaagagaggtggagaggggagagaaagaagaggctgacgcgtggggcccacgtgggttccacgctgagtcagctgccacataggataaaaccagagtcaaaaccgccgagggacctaatttacatggttttgtaaattgagggatacgtcgtatctggttttacggtttaaggatgattttgtaactccatgacaagttgagggaccttcggtgtactttttcctatattttacttccctgacccagccggcccatcgtgccgagacagaggcacagatacggcccaaaggtcaggcccagggcccagggcctttcggccgacaagagcactaccaccgatccgacgtgtccgcccctatcaccgaccacgcgcgtacacactacatgatganctncttgcagtcgagcgcgagtcacgaaatccaacgcg

SEQ ID NO: 3754 - DNA, 23140 bp, Oryza sativa
  unsure (1)..(23140): unsure at all n locations
gttgtgcncgggtgattctgctcgtctgcaagcagctcatcatcctacctcatgcccgcgacccaaaaaaaaaaaaaacccatttcttcccgaacccgaacccgcacccgcctcgctcgcacgctgcctcctcctcgtcgtcctcctcctcctcgctgctccgcaagtccgcatcgcctcccccctcgatcccatctcggatcgccgccgccgcagcagcagccgggtggggctgcgcttggcgggagggaggggagggtataggataggggagatgggcggnnccnnnntnggnngcggcgcgggggcggcgggggccgtggcggcggcggcgggtgacggggctgtcccggtggtgctgaatgtgtacgacctcacgccgctcaacaactacctccactggtgcggcctcgggatcttccactccgccgtcgagggtgagcctctgcctgatcctgacccagaccaagctccaaccgtaaatctccccccagtttatttttattattttaccatttcgcatgatttctgatgggattccagctttagtttatgatgtaaaggtgagttccttttagcgttaagggtatctactactagatcttggtttgttttctaggcagtttgctacgcgaatctgatagtggcgggatgatttggccgagctgacagatttatcgcgctagtaggttagatgccgtgctggaaacatggtggaacgggattcataaaaaaatgtttgggggtgaaaggcaacaaacagtttgaattgcggaacgcataccggtaattttgttcatcatttctgatttgtgtaccagttatgtgagcccagctgcaaagtaaagccattggtttaacattgggaccaagcattgctatggttgcttgtgaagatggcatcaaatatctttccggttttctttctgacgaggcttttcttaattcatttgggaaagattagattccttatcagtgcgttttcactttcctttagaactggttttgtttctggtactgatcaaattatacggttatatgacacatttgaaaagtatctgtgggggttgtatagtggaacaaaacatttgcttaaacttttgttttaacgggctctactgagttttcaaaacataggtttgtaatttgtgaattattatgataaatcaaatcgaaatgagtacttttagagaaatgaaattgagttggatgtgttgcacattgatatacttgataaacaatgttacagtattaccttctcttgatacaatgacatgtgcgttctgattctaaatgtaaggttctcccagaaagagctttagcaatttagtttttggattgtttcgtgctattgaatttctctcgcaactatgggacactaaagaactagtagaagaaaagtatcacattgggtgtgtatgtatttattgttggtacagccgcacacattacctttgccattgtgaagccgttgcactagaatcctgtcctgtgatgtatatctcatattcgtctcatagtgtattagtgtttatgttttggttggttcaagtattagaaggctctataggatatacatgttgttttagcaaggttagatgttctcatattcgtctcatagtgtattcgtgtttatgttttggttgcaagtattagaaggctctataggatatacatgctgttttagcaaggttagatgttcaacttcctgtcaattttctttctgtaggaagcttttacacaaaatgagtactatgtgtctgtgacttggcttctcttccttattcatcgtgttcaaaactagaagtgtagatttagtagtattattactgtgatgtgtgatcacctttccaccccaatgtatgttctgtacactttagctaattgttttcatgcttctatgatgatgatgtaaacttctctaagtgttttaatgtattgtgtggacttaaaaacaatttaattctctatgtgaatgatggttttccatgtcctgcattttttaatgatttatctccttgactaattctatgttgaacagtccatggatcggagtacagttttggagctcatgatcacccaacgagtggggtttttgaggtggaaccaaagtgctgcccagggttcatgtacagatgttcaattttcataggccgtacgagtttgaatcccttagaatttcgagatttcattcagagaatggcttcagaataccatggagatacttatcacctcatttccaaaaactgtaaccactttacggatgatctcagtaccagattgacaggaaaaccgattcctggctgggttaaccgacctgcgaagctaggtaataaaacttgtgctccttttacatcattatattttgatttttctaatactttattactaagcagtacatcacactggcactttggcatattaccttgtcaaaaaagataagattgcaacaaactatgtccattatgtgggacagtttttcaaagcaagatgaaacaaatattcgacttgtagtatctggagttttgaacttccagcctattttcctgactagtcaggattctggacaagttataataaaaggtagcgaacattaaggcttgggggaaaggtcatagagtggtggattatgcagtattgttttacacaattcagaaatctggatccaaatccttaggatttttttaattaaatatgtcccgaaaagttataaagcaatcccctctcccacacacctttgttcagacatgggcgaaaacaatatcaattgagaatgagatgttgatttatgtccagggagtatcatctgctgacatgaacaagaagggaaatgtctgaacagactacagagtattgagtattcacagaaatgatgatgagatcatagatgataaaatcatagagatagtaatatgtggcaatataaatgaggattactgaatgatccaaattaggagtatgttggatctcctcataggtgtcaactaaaatgttaatgacataatttaatattaataattttatatcaaacttgatatacatgagtacatggaagtttaataaagttaattatttctctgttagttgtttaatatattgggcccatcattttgaaatccgtcatagaattagaaaatgccatctaccgttctccaccagatggagaaaatagcttagcttctgctggcaataagctctgtatcagcaggtcaggttccaacaaacaacataggtctttcaaaaataggaaagtctgtttggatgaggaggattagattgcagtttagcttctcattgtctgcttgttagcttatcagccacagccaaagtttgaaattttgaaacataaatttagtagctttttaatcgtagtctattttccagtattatcctttaaatcgcaaacaactcaaatatacaagtgttacccataaattagtttcggttgttttgttcatttttctacggcttgttagacatagctcaaacaatcggagcatcatgacatatgtttctatattggaattatgtgagagtaatatggtgtttcagtttaaatatatcaatcaataaattttaagtagtccggtaagttggcagggcagaatttgttccaactgtttcttgcccctgtattgcatgtgagcctgagagagaaattgatccaagatgcacgttactgtgtttgccttgagctgtccactcttgacccaacttcaagccatttactcagaaagaaactcatatatcaacatccaattattcaaagctgctaaaatgccaaaatatgtacatttcctgctcccaattctgttctgaattgttctgttgcaaagatgacaattcatagtcaccctttctttagcatgtatgataatccaaattatttcaggtgccttttgcaactgccttctgccagaaagcatgcggttggagtcaactgggacaaagcacctcgcggactgtcatttctcaggtagatactgttgtttgtcctgtcataagctcactagctgctacgttagctgatcatgctatttcaatctcatgtttgtgtgtggtttgtggtaatgttgcatttttttcctttagatgattcccgcacatccagcaatgagcattttgaagatgaagatcttgaagacaagcacctgctttcacaatcttctgtttctgaagatgcaattgtaaaggaagttcacaggtgacaaactgctgaggctatacagaataatttggtgtgtagtttgtcattcattttgtacattgtaattctgtattccaaaatttagtgcgctctttgtattctaagttgatattcatattattgtggccggtttattgtcatgattaattttgttcattccatttgtacaaacactgtaataccctacctactgaggctccttataggtagtctggaagtcactctgcatgtgtactcttaagtcttaaattcgtttcttgtaaaaatgtgagttcaaagagcgagttgatcccgatgactgcgacgtattgtcagtgaactgtgcatagaatttgttcatgtccattgatttttatggttgctgttttgaattaattaattaagtcgactattgacccattgtaatagaaattttccagttgccacctgaaaatgatacaaaggagcagtaacaggggtagttggcctaccatatccatggctgtttgttttggatatactctcataatttatccattgtgaatgatgacagtaatagcagattagcaagtcatcctttaaactcttagttgcaaagttgggtaactttggtcagatgtatgtgttgaaagacgccagtgattcagtgtctaccagtttctggtcggtttcgtttatcgttaagaatgttaacccttcatttcaagttaatgttctgatcgttctgaatctaggaaggctccaacatcaaccctgaagattgtactaccaaacttttaccttttacctggtcaattcagtttaacctctcagctgaacagagtataagatctagaagtagttgagagttgctccatgtggtggccaaattgctaactgaatggtctcaggagggttgcatctgctcacctataacaagcagattgctctgcacttaatatatgtcaactctgtcagacccatataactaaatactatatcgttttaggttataagactttctagcattgctcatattcatatagactagaaagtcttataacctgaaacggagatagtacatggtatgcatgtcagactgtcaaatactcaaatgcattatctggacatttcggatgtaataacgacgtttgcccatttacttaattttatgtatgcttttcatgtgtgaaacaatttggagaaatcctcaccagggcatccaaatcgtttcagtttagctgaaacatcagataaggcaagttgttgcccagtactaggaacttatgggcagacaggttttagtggatccacgttttgcatggatatgttatgttccaacaatgttcaggttcgattgccttttttcattgctagggttcaaaagcaaaatcatcatgctttcaaaaggaagacttcaactattttcatacttactggaaagaaatagataaaatgcctgcaaatcaaattgcggtagatgaactcagcacacagtaagatgttttttttttctgttcgtcctgtttgttcgatttttcttttgtgatgtatttattctttagaactttggcagggagccttgctttggtgctcgtctatgtgtcgtgttttattatttctatgagatgaaacatttttttttttgctttctagttctagaaaaaaggttatatatcattgcaaacatgctgtaaaacttacccacttacaatttaaatatatactttatatatggtcaatgcaaacgattaattaattgtcaaatttcacattaatttacacaaataatgggagatgcaccggtcagcaaaccattcaatgtatgaaaaaaaaatggtggcagaatagtttgaagtacctgttctcccaaaatataagagattgatatgtgatataattctttgttgggggcatttcatcgcccttcaattaggttcacattgctgttcatccgtaactaattctcatgctcaagtggtgccttactgccgtttgaaaatgagcttgtcgaagatggggtactacaacaaaaacctcatgttcattgtagaggtgattttcattaggagctttatagtctacactctacaaagacgcttgaagaataatctaaatctagatggtttttgggcactctaattcacctaaggcatccacaatgtatgaaaaaggtgatcaacagagcatacggtctacctcaacactgtgaaagtggttcatatgtcagtccttataacgagctacctatgtacccctccgttccaaaaaaaaaaagaccaatcctacctacgaacaagacacatgtgtccaggaattcgttttttttttgaacggagtagtatataagaactagctttaaggaaaaaataacaataatttctctctcttctcccctctcctcacttgcaaagctactaattgagtgggaccagtgggactcaggctatatatattggggtaactacatcatctaatggtaaggcccaccttatgacctaagggtatacattaaagatgaccttaatgtgtatatgtatttttcttaggatagtcttaccaatttggaagcatctgcaggagggaggttaatttgtttttaagtagctaaacaactagtacaaataatgttagatttatacaaataattagtggaacgaagttgaggttattagcacatttaagataagttaaacttccatgattgctctagaattcaatgattgactatagcaaaggcatacatttttcagtacgatttgtggtagtagcacaatttatgctgctataataatgtctctagctactatgtaggaagtaaaaacaatacctctaaaaatgctgtaaaaatgtatatacatatatatataatcgggtcactttgatttggtgcatacttactattgtgttatacactttcttttcttatgagaggtgatgtttgtaaagcttttgtgcatttttcaaaaaggttaatataccccatgatggacatgcatgcttataaaactattttaaatgcccctgccctccaatgagtcaaagatatgtttttaaatgcattggcaccactaataggtgtcccaatgagaaagagagatataacacacatttatacaataaatggagagatgcactagttgtgaaaacattcaatgaatgtcacaattaattaatgtttgagaaataatttagtgagaaggtacctacagcataccctccattccaaaaagagtctaaaaagaatcaactggattcatctccggaagttgatcttttctatgatggagagagtatatattatcacgaaatattgcgtattgatcttggatttaaaagtcgtattccaaccatattgtaaacctggtcctcccaattccaaaactctggtgctgattccccctattaatcatttctggtgtgtgggacatttcccacacctttttcattgctacatctcaatcgctgttcgtccttctccttcttcagtggtgccttacctccactttcaaatgagctcaccgttaattgaggatatctctactctaccatctctatttctcgatcgatggaataacatcttaggtatatatggtctaaccgccttcacatgacccaaccaggatgattaattagtttttgagttctaaatttcaatgtcttttgtagatgatctatcaaagtaatttgtttggtgatacagagcatcgatttgaggtggccatatagcataacaatccaaatcattattttgtcaagaaacaaaatcaaaacataattcttgtaggtatattttgatttttgagggcctagtttcaattctttggtaacttatatgcactaaattcccaatgcacagctttatttgccttttgtacattttgctttcttctttcctagcttatccctagaacacgccacgagaagtcgaataattgttcgacatggctatttctttgcctgctgctatatgtgaattaatgcatgaccatcccacatattcctttaaatatagaaaaaaattattactccatattggtattattagatataaatcatttttttactaaagttaggaccatcataatttttagtaattaatatttatactgttctatacaatgctacttgtaaatataacaaagaaaatttacatccacatgccaaatatggtttagaaaaccatttggtgaccctatttttggttttctctatggccctaataagaaatatccaaaattgagttatctcgttttgattattttaccatgcttttaagaataattatgtatgatttaaaataaaaatagctcatgcaccaccccatggtccatgacgcttagaggtgagtcgggacatggttcgttgtgtgaagaggcagccgcctcttgcactctctattgtgcttgtgcttgagcctgcgcaatgcttgtgactaatgttgctccccatgtgtgtcacagagtccactggttggagcacgtgtttagtatttataacttaatagaaaggaaaccttggtatttcatatagacatatttcctttcaaaaattttaatttttttaagagaatgtgacacaacaataaaatataaaatattatggattcatattgtactgaagtgtactggtgaaacttttataatttgtagaaaagtaaactaaaactggtatatcttttaatgatataaaattgatctccatatttcttgtagttatgtgctgatagtagatagaagaaataaaaagttctttttagaggcttgtcgtttactatgtaaactttatttcaatccctagaataacactaaactttgtttcacgttcattgatgaaactaggaggccgcctggagtcaacagtggtggatctgccattgtgcgctactagtggaatcgttgcatatctttgaattaaattaatacatcaaaattgatgctaatttttgtcgttgcttgtagtatacaagtaaaagagaatgaggaaccagaacatatgacgatcttttttgcttcttctattcatcagagtaatactagtatgaagtgcccaaataatgcacgagtttttaaattatgttttctacgcttttcaatacacatcatcaaactttaccatgattgggcaaatgtaattttatttcttggttttaaaactactaaaatttaacggaactactatatagcacggagtgtttagcgcaagtagcgcttctcacagcggcccacccatcctgctcgctttccctcctaatgtaaaatatttactcttccccttacccacccgagcattggttctattgctagtctctccatccatccctgtccttacccactctatctcaaaataatacatagaaaatatcttgcaaatccggaactggggaaggggacatgatgggtccctctcctcccgatgtaagaaaattaccctcattccttatttcgtaaaaagaattatctggtaactttggaaagggcatttacctttcatctttctagtgtaaaaagttcatcttgtaacttttggaaggggtgagagtaatttctttacattgagacggagtagagggaaggtgagtccaaggatatatggaggggtgtttccaaccaactagtgggggagagaacaggaacagagaggatgaaggggaggatagggaagcaatcaatgttagcataaaggtgagaatatttttttttttacataaggggaagagttggacaggacaaagaacggggaggggagaaggacagttgggcgtctgtgaggcacgctagttgttaagtagtgcgtgttacgctgtttagcgctaccgagttcaataccttttttctatttttctttttggacaatatactagtaagaatgcgtgaatagtgcatgggtttttaaattatgtttccaacgcttttcaatacttatattattctattttactaaaattttgataaatgtaatttttttcttgttttcaaaactccagtacgaaattgggttgttttttaggagttaagctttgcatatgtcaattgataataaataaccagaactaagtaaggagttacagtagtagttactacgttgtgtggcggttttataatatgtgacgcgtaaataatagatacaacggctaaatttttcaatgcaatttttgtgtgttttttttaaattctagagtcgagtaaataaaaacctgagtatgtggaaaattaaagcagaaaatttcggttgaaacactacgctagttctacgatatgtgttgaacacacatcctaaaatagcaaacatttttttaggagttaagctttgcatatgccaattgataatgaataaccaaaactaaataagaagttaatagttactacgttgtgtggcggttttataatatgtggtgcgtaaataatagatacaacggctgattttttcgatgcaatttttgtgttttttttttggaaacactacgctagttctacaatatgtgttgaacacacatcctaaaaatagcaaacaaaatacaacacatatttcaacagtactagagtatcaactggattaattttgcctttactagagagtcaacaagcgagagagagagagaccgagcagtatgcagcagcatggtttgcaattccggttcaaaatatccgatcatccctgggcacacaactattttttttccaaacaaatgtccttttcttttcaatttttgttagtttagtataacatctattcaaactaaatttgctcaaattatccattttacccaaaatagtaaaaaattcaaacccaggagcagcagctagcataggtgtagacatgtctgtgtgtccctttctctctcaagggataggtggagctaagctagctagatagatagatagagagagagagaggggggaaggctagattggatttggtgaaccttttctcgtagcaacgcacgggtactttgctagttatagatataaatacttttttttactaaatttaggaccattatatttttttattaattataatatttatagtgttctatacaatattacttgtaaatataaccaagcaaatttacatccacatgccaattagctagggtttagaaaaccatttggtcaactatttttggtgatctctatggtcctaataagaaaaaaaatatcaaaaagtgagttatctcgttttgattattttaccatgcttttaaaaacaattatgtatgatttcaaataaaaatggctcatgcaccaccccatggtccatcgcgcttagaggtgagtcgggacagggttcgttatgtgtaagcactgccttgcctcttgcatttgcttgtgcttgagcctgcgcaatgcttgtgactaatgttgctccccatgtgtgtcacggagtatacaggttgggcacgtgtttagtacttacgacttaatagaagggaaaccttggtatttcatatagacatatttcctttgaaaaataaaaaaaattgttaagagaatgtgacacaacagtaaaatacaaaatattgtggattcaattgtattgaagtgtactggtgaaacttttataatttgtataaaagtaaactaaagttggtatatattttaatgatattaaattgattttcatatttcttctagttatgtgttgatagtagatagtagaaataaaaagtttttttagagattttcgtttactatgtaaactttatttttaatccctaaaataacactaaactttgttgcacgttcattgatgagcctaggaggccgcctggagttgacagtggtggatccgccactgtgcgctactagtggaatcattgcatatatttgatttaaattagtacatcaaaattgatgctattttttttgtcattgcttatagtgtacaagtaaaagagaatgaggaaccggaacattgcttcttctattcattagagtaatactaatatgaagtgcccaaatagtgcacgactttttaaattatattttctacgcttttcaatacacatcttcaaattttaccatgattgggcaaatataatttttttcgtggttttaaaactattaaaatttaacagaactactatatagcaccgagtgtttagcgcaagtagtgctcctcacagcacccacccatcctgctcaccttccctcctaatgtaaaatatttactctttcctttacccacccgaacattggttctattgctaggctctccatccgtcccctctccttacccactctatctcctaatgtaaaataatacagaaaatatcttgcattctagaactggggaaggggacatgccggatccctctcctcccgatgtaagaaaattaccctcattccttattgtgtaaaaaatatttagtaactttggaaggggttttacctttcatctttctggtgtaaaaaatttatctggtaactttggaagggctgagagtaatttgtttacattgagacgaaatagggaagggacggggaggccaaggatatatatggaggggagtttccaaccaacgagtgggggagagaacaggagcaaagaggatggaggggaggatagggacgaaatgaacgtttgcgtaaaggtgactgagagtaattcttttatataaggggagagtcggagaggacgaagaacagggagagaaggactgttgggcgactgtgaggcacgctagttgttaagtagtgcgtgtcatgctgtttagcggtactgagtttaatacttttttttgtttttctttttggacaatatactagtaagaacgcgtgaattgtgcaggggtttttaaattatgtttccaacgcttttcaatacttatattattctgttttactgtgatttacaaatgtaatttttttcttggtttcaaaactcgtccaaaattgggttgttttttggagttatgcattgcatatgccaattaataatgaataaccagaaagtaaggagttagaagttactacactatgtggcggttttttaatatgtgacgcaaaaataatagatacaatggctgaatttttcgattcaatttttgtgtttttttctgtaaattctaagtctagcaaataaaaacctgaatttgtggtaaattaaagcaggaaattttgattgaaacactatgctagttctacaatatgtgttgaatacacatcctaaaaatagcaaacaaaatgcaacacatatttcaacattactatagtatcaactggattaattttgcatttactagagagtcagcaagagatagagagagatagagagagagagaccgagcaatatgtagcagtagggtttgcaattcctgttcaaaatttccgatctaccccctaggcacacaactatttcttccaaaaaaatgtcttttttcttttcaattttggttagtttagtaaaataaattcaaactcggtcaaaatttgttcaaatttatcccttcttttcccaaaatagtaaaaaattaaaacccaggagcagcagcagctagcataggtgtagacatgtctgtgtgtccctttctctctcaagggataggtggagctaagctagagagagagagagaggggaaggctagatagagggacagctcggtctggcgtatgtccaaaggtgtttcgtgtgtgcctggagaaccttttcctttctatctcttcccttccttcagttaaagccatatcaaacacatggaattccggtctccaaatctttattaattgcttcctcaaaaccccctcttgccccctctctctcttccctttcctctctcctcttcctcttcttcttctacctccctctccctccccatgtgagtgatcctgctacatgttacatgtgatcatgcacaggtaggtgagctctagcccctgatcaaggaggtgcaagcttctactgccatcttttcggcgagaaggagatcgaggaagaagatcagaagctcaggtagccgccatggatggtgtggtagcagaagatcaagcaggcggcagcggcagcggtcaccgccgcctcatcggatcgaggatcgaggagcaccgcaagtacatgtcggaggagagctgctgcccgaggtgcggccacaagatcgaccggaagctggtacgcgtgtgtgtatcacactttgttaattaaccatgtttaattaatagtttgctatatatgtgtgttgtttgtgtgtctgaattctgaattttgttggagttgttgatgcctgaatttttcgtgtgtctgtgaaggactgggtggggctaccggccggtgtgaagttcgatccgacggatcaggagctgattgagcatctcgaggcgaaagtccggcccggcggcgaggcggcggcacacccgctcatcgacgagttcatacccaccattgaaggggaggatggaatctgctacacccaccctgagaaattgccaggttaatatgtgcaattgattaatcaagttcagttcttcaaaaggatgtttaattgttgttgttgttttttttttgtgttttggaggtttgcactttctgtttcttttacttgcttcagttttttccaccatttctttcttcggtttctttttccctttctgtttcggttcatatcttctcctctccttgtatctcgcatttctagaattgttttaaatgatacttgatagctaagcatgcatactccccacacacaccaaaaaaaagagagagaataaatggcatcaatggtagatttaatttgcaagtgtgtaatgcactgtaggaatctagcttgtgcaagaagggaaacagtggtacaccaaatcttccagtacatgtactgcatgtatagctagtcaatcaatgtgttgttgttgtggcagcacatctcacacaccctctaaaaatttgaaaaacaccatctctctctctctctctatctatctctagaagagagaatgaaatgtgacatgagatctttcccagcccctgcacatcttccaaagttaggttttgtcctcctcccaaggttgttatatcctccaaacagccaatggcttaattgaccattgcatcatcactcaaatccttttttcccttttcttttcttttctttttctttttttttcaaaagagaaacagacagtagctagctagctagctaaccagacatggaaaaaaatggcgggcacttgctgacgtgtgcttccatccatgcaggtgtcagcaaggacggcctgagcaggcacttcttccaccgcccatccaaggcctacaccaccggcacccgcaagcgccgcaagatccagccgccggcggccgccgcctcgtcgggcggcggcggtggcaacgcgtcgtcgtcgtcgtcggcgtcggcggctgcggcggtggcgcgccatggccatcagcagcagcagcagcagcagaggagcgagacgcggtggcacaagaccgggaagacgcgggcggtggtgggcggcgggcgtcagcgcgggtgcaagaagatcctggtgctctacaccaacttcgggaagcaccgcaagccggagaagaccaactgggtgatgcaccagtaccacctcggcgaggccgaggaggagcgcgacggcgagctcgtcgtctccaagatcttctaccagacgcagcccaggcagtgcgccgccgctgacgccgccgccaccgcctccgcctcggctgtagataggaggacaacgtcgttgagggaccgtgcggcggcggctgccgccgcagctgcagcggcggcgccaatggcttccgctaacgtcagcgtggccgcgttccacggcggcgccgccggcattgatgaattcagcttcgcgcagttcaggagtagcttcgaggaggtgagtgatcgatcattcccttgttaattagagatttagagtttagcagttgctaatttggggattttgatgattccttacacagtaaaagtaatactccctctgtcctctcggaataaaatttatttcttaggatgaatctagacaaatgcagtgctggttcagattcatctccaaaagttatttctttttaggactgcctacttaccttttgacgcttgcatactatagggtttaaaatatcgatcgaacagcttaaaagacgaaggggggatttcggtaaatatcttgaaggagtaattaagatagaacttatgaaaatgaaatgaaatttgtaagagataaactaaagtgaaattaaattaattcatcaaaacacatgaaattataatgaaacatgtagaaaatactgaattcgcttatgattgcatttaaattcagcattttataccaaatcagttcaagccattagtgaatgggacaagatttatagtaaccgccgagatctttcccctttatttctagaccattggatgttcaacctctaactacagtcgagattaagttgatgaagaaacataaatatgaaagtatctaagaggaaaataacatacatgaacacacgaacctctgtatatatatctcgcaataaatttttcgatatatgtaccatgaaatataataatttcacatatatttgtcctagactgtgaatattggtcagatggtgggactattttgtcgttttgtatatattgactttttacatatggggacaattgagaaatcgaattcgcatatatttctattagttattggaccactataaataatgcaattaatgttttctttcattgtatgtaggttgcttgtagaagaaggtttcctttttcttggtcagtgaaatgtaggtaggaataggatgagatgtttttgtttgggagggtacagtcattgggatgacaaggctaattttctgtgcgcgtccggatcaatctgaccttacaatatggtaggatgagaaaagatttcttcaggtgaacagtacttgcttagctctgagatcttacctaaattgatagatgtatctgacctatatgcagaattgaagtaagacatggtcttgtcatacaattaaatatcagttgaaattaggaacaaaatcactaacataaacaggactagggacacatatagactttcaggaacgatcttgaatctggtagttatatgtacctggtagacaatctgaatagcatcaatgctgtacttaattgggacatatatatatacatagtagtataatacaataaattttgtgcacacagcaagcaaccctaattaattgcatgatctgcatatactactcacccatgtaagcgtgctatgatgaatctaacagcaaaaactaatgaacaaagagaaaacctctaggttatcaattaatttacttcgctttccaaattggctcaccttcccctatctaccaaaaaaaaaactgacagatataataaattaattaatccatcagaatttcaggtgtgatgatggtcgtgcagcacaaacctaattaatttatatatccaagtatatataactgattaattcctacatgtatttacttactatatatttgcaagtaattaatttacatgttgaattaataaattattaatctaaactacacaggcgggaatgggagcgtcgtcgtcggatcaccaaagtgctatggttgatcagcggcggcggcagcagcagcacgacgacgacgagcacgaccaccggcgcggcggcggcggccaccactacgtcgggcagcagcagagcgtcgcggcgacgttccacgtcgtcagctcgccggcggaccccatagccaggctgatgtcgccggcggcggctcaccagggcaccgtcatgctccggcagncggagccgccgtatatttaccatcaccaggtacacgatcgtagtagctcgctaaaaataacgacgttttggacttttcaaatacaaatttgactaataatttaattctctttggttatacatttgaaaaggttatacaagtgtgatatatattgcgaaagaatttgttatgataaacttagctagctatataatttttatatgcttaagacgagtgactttagcgtggtgtctactggtaatattctaaatcttacaacataattcttgtgatcattgggacgtagtaatagattcgaaattagcacgtactacacttcttttggcattgtagcccttgtattaagccacgtacgtcatgatatatatccgtatacttctattaattattaattagtattgtgtatatatagtaattgactgtcaattagtcctattaattaattgtttggtctgatttgcgagaaaatgatcagcaggaggatgaacggccacaccaaccgcgaaagtttgatgggaggtcgacctctggttctggactggaggaggtgatcatgggctgcacctcacggaggtccaaaggaggggtacgtaaccatatatttcacgtatatatacatatctctctctcacacacagactgcagatacatactctgattttatatgctttacatccatctcatgtacggttgcacatccaacaacttgtttgatcgtagctagtggcattcacgtttaacacggtgcttagatttatctgatatagttagctactccctccatcccaaaacacaataactatatatgtatctggatagagatttatctagatagatacatatatagctaaaatatgttttattttggaatggtggtagtattactacagctatttaagaatgtatatatagttgtgttctaattttaggaataagcacaagaaaagtataaaatgtattttttctaataataataataataataataataataatatcatttctagctatgtgtacgtgttgtacatgagtggagttttctttttattaatatacaaagggtgattttacggtccttgagttagtatggagtatccacattatttgttactccccccgggctgataatacttgtcgttttagacaagggtaaggtcaaactttataatctttgattataaatcatttttaaaatatttgtcttttaaatatggtgactacatgtatagattagtcttaaaaagtactttaataaaatcatatattgttaacacttttatacatattacaacggaaaataatggtcaaagttgttttttggagaccgtgcatgctcttgtccaaaacgacaagtattatcaactggaagggagtattaatttgtgttagctcctgatgcactacaaaagtacggagagacaccacaatttacaccataatgtggtacttttctgtacctctaaagaaagtagtaaaaaaactattgtgtgcaaataatatacacctttaattagcatgtaaacatgtaactgcacatgaattttttttgcttaatttgtagtgaatttatagctagctagttactatttctataactcttgaagatgaatttataatggtgggagagggtagggttggaaaagccatcaacccgggttttattcaacgtgcatactttttttttaaaaaaaaaacaacattgttttattcaacctgacatttcacatatagcatcagggaacgtgcatacttttttaaaaaaaaaccaacattgttttattcaacccgacacttctatttagctgttccttgtgctatttttcatatggtagaagctagtttttcgtcataaaatattccattcagttatacaaaacaatgtggatttggaaacttatgcatttggctagcggtttgtattataatatacttgtaaagttgtaacgcctagcgtgattatgttatttggatgaaatttatgtgagaaaatataatggggaaatgtagctttgtcatttatgatggcatttttttccatgcctgcatagaaatatttgacaaccataatgcattcatattttttcccggaaagttgagtgtcctaattttgttcatggtgaaaaatgcattattttattatttgatatctaaggcacattatattttgttgggcgaccaagtacaagattatgtgtgtttctctttttgtcttttaaataatataacatatagcctcttgcatctgggtaaacactctttaattaatctttttttaactgtttttttctctccaggaaacatcaggtggtaaggatggcacagaatggcagtacccatccttctggccatctgacagccaggatcatcatgggtaaaagagcaacgtatctagctgcaccttgagtatgagtagtagccaatctcggtgaggcaaccaaaagcaaaacaagaaccctgacaacatcattactaccatgataggagcagcatacatgcactatatacactcctacaagactaaaagctcaccagcttagcacatagcataggaggcaggagtggcttccaagaaacacacaaaaggcaaagtttgcaacaaaatccaaccccctaacttttatcccccccttctccctctatctctctcttcctcctcctcctcctacttcatctttctcttcacccaatgtgtctggataacgggatggaagtttcatttgagtgctcaaatttacatgtctaaagagacaaagatgatattgaagcaaagcaaaagggagagacagaaaaagaaaaaggagaggaaaaacaaaggtgacatcacaaggaaggttagttaaccgtcggttgctcaggcggattgatgcgaaatcatcaccgcgatcattgtttaccgacacctttccgacaaagtgattgaatgttagtctaataatcaggagtattgataaatattttattacttttgttgtattgatttgattggttaatattaattgtacaccattacccttttccttttgtcttatactgagaaaagaagctaacatgttggaaaaagaatgaaagggtcaatttgtaaagatggcacaagttctcatttgattggtccatttgtttctacagatttgaattttttatagtttctcaagatacacatttgccaagaaatattccatgaacaaggaaactctaaagatttctaggtatgcatggctagctttagttccaaaatcttcctttttcctaaggaatatctttaattggttccaaaaactcctcagtggcatgcatgaggagggaataaatgtttccatattcttctgtgattctgtcacatgcaaaagaagagagctagctaggcgcaaagaaaagcttgtcatatctcttgctataaacgaaaagcttgatcttaccctcttactccttctgtacctctttcctctcttgcttttgatttcttttttttttctttcaaaaagattttaattggaccatgggcaacgttaaaattgctctctctgcatgtgtttagtattttgcattctggcatcttgtcagaatcgaagttgccggagaatttcccagtgtgtgtagtggagggagaatatgatgagcatggcaatgcatggatgaacctgatactgcccttttcagattcctccaaactgagattaatgtgaatgtgtgaatgaaatgtaatcaccttttaatatcagtaccacttcttcatggcgagagatatgacaggttgtacacgcatttggcgtacgtaaatattgcataaatgacactgattaatttcttttagttttagttcgaacaaatactcagtgcaaacagttaaatgtgtggcattaggggtgcggagtacgtcggtataactgaacaaaaggtccaggtagttcggttttagaaaaatcgttcgatctatgaaaataggaaaccgaactttgtcaatagaaaatcatgaactgtgatagttcggtcaatcgaactgtcgatcggttcggcggcgaaactagcatgtagcaatagcgggcatcatgagggaatctgttggagagagaggcaacaatgagggagggtcgtcacagatctactacaagggagaccgctagggggcggacctaggctctgagggccaatttggattgctaccctaccaaaatttgccctaccaaaattttggtagggtagcaaaccaaacacctctactaaaactctaccaatgctataaatttggctttgcctataaacttatctcttatgggtaaattttggcttcaatccaaataaacattttcaactctacactaccaaaattttggtagtaccaaaacttgcccaagatttggcactaccaaaatttgacatcaatccaaacatgccctgagtaacctgggtgtgtttggccgcttgagacaaaaggcccatagagcactctgatatttcaccatgtaaatttttattgggccgaaattctaatggagcggcttgggccttggcccatttatgtgtccacccctagagaccacaatggcttatcgggctatgatccaatgtttttttttttcatcctctttgtctcgatttggtttgtgctactccgaaatatgcaaatcatttgatgcttaaaagttaaggtacctgtggtagcagcctgaagagctgagtgaaagtcagtccatgcaaatgatagaccgatctaagaaacaccaactaatggttcggttatttcgagttcggtattggtttttggtcttcatattttctgtacctatccctatctgacactctaccggtcaatttgtttatttttcctagcatgattaattaaatgatatatatcatatctagagattaattcacattaattgtgcgctcggtgtggtgcaatattaggaagaaaatgacaatggttatcagtacaaatggaaaatggacagtgacggagcgcggggctcctcaccgggagaccgcgcaggcccccctttgccggttcggccgggggctcagggtgatgatcccaagctctctctgtttgtggaaagatcgcgacctctcaaaagagcatgaagcacaagcgatgtatacaggttcgggccgctgagaagcgtaacaccctactcctgtgttttggtggatctgtgtatcaaggagctacaaagtgtgagccaacctcccccttttcttctagctactgaatatggn

SEQ ID NO: 3755 - DNA, 1513 bp, Oryza sativa
aggccttcttacaacacattcttgcttgtaatggttagaataagcctggcatatatcgaccggggctaatggtcaatctatggaatgtagcacgataactccagctggtgagaggtgccaaggagctcttgtcttgacggaatgggcaaggtgtgagtcagaccgcctgtcgccactaaaccgcgatctgaccggtctgtgactggtcccagaccggataatcgagtgcattgcactgtatttcgtgcggcgtgacacgtttagccgaaccgcaataaatgcggttaggtgagccatgctgtgctcacctaacccatacacgcggagtagaacccgcgaggggtcggggcgcctcggccctcgggggcgaggcaggagtggtccgacccccccccctcggggagaccaagaggtgggcgcacacatcaccctcgggcccgacgtcccccgagggtgccaggccacgtgggcgattgtgtctgcctcaagcctctaatcatgatactcccggtcccatgtcaccgacagacaggattggctacatgcaggtcgtagaatgccacaaaaggtgctagtaagccacaagggaggtttgctttatatggatgttaaattgttgaatatttaattaaaagccggtatgatgaagagtagttgttttcttaagtataaaatcatgacagtacatagtttgaatatgttctaattgacttctggatttgattctttatctcacgatatgaagatagtaatagtatgaactcgatgcttttgattccaagaggatatatagtatccgaatttcaaatcaactctgaaaatgggggacccctctctgtcggtgacccctctgcaagcgaaaataggcgactccttcattcctctttagccgaccactttgctccatcaattctagtaactcatgctgccggcgacgggggagaggggggggtctaggttgttaggcttttctgtaatagggttttttcctttatatttttgttttcttttagtgcttttgtgtagtgcgagagttcaccggcatcgcatttctcttgtccctgtagctttctatttattcctgccaaaagtccatccatggatggtatttgggtttgccatggacacccccaacgaattttttttatttataattttttttattaaaagttttacaaaaataattttccattttgaaaattaacggaaatagtcgcctaccgccctctgggagggcgatatccatcgtttcattctgatatgtggtcacataattaaaaagtgcgttttctttttttccccgagcaacagggtaaaccgccatcctagcaatatttctctttgtcgccatcaatacagccattcacaggataaggcccctttaatggtgatatctcaattaaaccctgcccagttttattccttatgatatctgcccacgcacaaatgggtggtaaccaccacgcgggaatctaatttttctcccccggtgtcccccagaggaattctctcg

SEQ ID NO: 3756 - DNA, 7446 bp, Oryza sativa
  unsure (1)..(7446): unsure at all n locations
cgccgttaatgatgacagtcgntcgnacagnagcncattaaactatacaagattaaaatctccaagactggtaaaatacaattttattattttttagggcatatttggaatgttaccgtacaaatattttgtaaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggaacgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcttgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtcgcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggtcttagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtaaaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattacgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgaacttgtgtgccttgagcaacaactctatgtctccgtgcctttttgattttatcttccatgtactttgtcactacgttgccaaacactatgttgttatcggccatggatggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtgcaaaatcgccctagcggagggcggcaagggggcctccctgcataattccatgccccccacttccgcccatttgcaattggccccctttgctgcataccgcttgacattctttttaccgattgggggcctctatcgaattcagcggtgatggttatctagcgtattatcctctaataatttgtgcctactataaagtgtcttactggtctgtacagagcctacgcgcgcatatatctctatacttcggttacattaccgctcatctcgtctttagtcgctttaagattcataaccaccgttcaattgctccttaaatcgctttttaaactcttttatggggacggataaagtggcctaacacgctcactataactccctactaaatcttgattataaaactcg

SEQ ID NO: 3757 - DNA, 11839 bp, Oryza sativa
agggcaagcatatatgaagtaaatatgatagtcaactggttaacaaacgctaaatataagtacaatactaaacatgaatggaagcaaaccggtacaaaatgaaagatcagcggagcttcacgatccactaaacagccctcaacggtaatatcgttcgttttttgatctctagtgaacaaataaacctcacagggaaggaatgggtttataattgtaaggcaaaaatcgccctcccccagggcgtcagggggaccgcttgctaaattccatgccccctaacagcccatttgctggcggccccccgcccagtgcaaaatcgccctagcgaaggccgccaaggggaccgcctgcaaaattccatgccccccctcgccgcccatttgcaggcggccccccgcacagtagaaaatcgccctcgcgaagggcggcaagggggccgcctgcaaatttcgttgacggccgtcgcccgagagcgaacggccgtctgccacgtcatatttgccgccctctgagagggcgatttttaggcggtaggcgactacttccgtcaattttcaaaatggaaaattatttttgtaaaacttttaataaaaaaaattataaataaaaaaaattccacccccaactatgcatgagttcatttaaaaataatctattattgttatttgaataagagctagcttttcaaaagtcaatttgaaacttcaatttctttaggctagtgttccagttagttatgttttgtactatacgatcgttttgaaatgcaatttttttttaataattggcagtcgattctttaaaacaacggccaaaacaaattccattatctccaaaagaaaattcagttctttattttctgaggtatcctttaatggttttcagtaccaatgctcaatagttctcgcgaaaagaaaatataagagcaaggtgtataggagatatcaggagtagcgcctgaagggtgattagttatggcttttgtttgtgagatatgcgcaatgtatggtggttgggaatgtatagtaaaaggcttaatccagccatagttcaaaccgaaggttcaaaatttcgaagtgaaatatctgaaatcccctaaagttggatatacaaatgggctaaacaaggatttgttcgtaagaaaaatttgtgactaccactacttcaatgaaatatattttgtgtttagtcaactttttgtcgtggacgtcttattgggcttgaagcggacataaaaggctagagtcttgggttgaatttatcctggcccaaagatagataggccatcgatctatacaataaatagaataagtttattttaggccctttttcttaacatcgagtttggatcacatcctcaaaccacaataccagatatcactggcagcgtgatgatgaagatatctctggctcggatataaccatgcttcacttcaacaagctgacagtgcaaatgttatatattagttttacttataatatgttttaataaatgtcactgtaccatgagttttctatattttcgtttgcagaaatacttgtataagtgaaagaaaggagagcgagcttacgaagtacttcgatgatcaaaaaggttgattggagattaaaccaagatatttcccaagtctatctttatatcaccatgtcacttttgttccatacaagacaagagatgaagttctacacgtttcggatctagagtcgggtctccttaacttcaaacggacctaggcgtcgattcagaaggactctcggggcccatgagtacttgttggaaaacttatggcgtatacttcatatggttattgttccacgttaaaattcctcctgaacagtcgggaatctacaaaacaagccacacacctcatccagtctaagtctggtttggaccttgggccttgtaattgtgtcatgagctaagtccaaggggtgaacgccctagagctaaccctaggacatccctaatcatatttattcagtagtcatcatcgtttagatttggggttttgcttagattattttgtcatcgtaattccgccactagttcggtttgtggaaccctaatttgtaatattcatcttatattcgtaatatattcatattgcatcttctactctcttgtttgtgttctcgattcgcttgcaggagatattattattggtgaggccaaccatgtttcggtttaggtgataaccaacgaaggggttgtgtagtgattgtgaggggttcagtcatcttgatcagagccttcggatcgtcaatgtcgagtctctataattgactagtcagtatctaacggaagatcgggatcctagtccgcatcacatgaggaccaaccgtgccacggcgagcggctactggaaggccactgacaaggacaaggaaatcttccgcagccgcagtgtccagctcctgtccagtggccacgtgctgcccttctcccttcatccgtggccctgaagatggggaagagagaggaagagaggtggagataggattacgaaacaattgctcactgacatgtagggctcgtgtggtcccagcaaactcagctctccatgtcagctaaaaccaaacatgatagtgctctagaatctcaattaatcaggttttataagttggtgaacgcattatatctggtattgtggtttgaggatgtgatccaaactcgatatcaagatgagagatatgaagtgaacttatttctgctccaaatccagtaggcagcgcaaaggccatatgaaagtgatatgaagaatacagaaggaggcaatagaaacaggagtaacacaccatagcaggcagcagcatttagcttcagctagcagccaacacttgttcagtgggactgtccgttacccgtaaaccgaaggatttatattcttcaagtctctagatagtagcgtgtgttggatgtgcatgcatgtgtgggtgcgtgggtagtggcagtgggtataaccgtgcagtgtggagtgtgttcgtatacgtcctggctttgtacccttgtaagaaggcagccaacacgctggtaccagccaatcctcaacttgagtgaagtacatgggcggtacttaaacttgagccgatatatcatctaagtctctaaactcctaaaatatatttttaggttcctaaacttaccaagtgtgtcatataaatccaaacgggttctaacccgctccatgcgttgacctggcagtgccatggtgacacctacatatatatcaatggaatccacatgtcaagcatatataaaaattaaaattaaaaaccatattttctcctcttaggtagacagaaaaaaagataaaaattatagatagagaggacaaaatatgtctttctaattatattttttctatgtgactgacacgtgggtccaactaacacgtatacactatcgtggcatgccacgtcagtgcacggaaggggttggagcttgtttggacctatatgacacctaaaacaagtttgaggacccgaaaatgcattttgagagtttagggacttagatgatacatccacacaagttttagagaccgctcgtgcacttcactcttttcagaatatcgaaaaaatcaccgtagagcaaattccacttttgaaaatttcgaaaaacactttcaaaaaatccaaaaatcaccaaagagcatttttgcttgccaccactattacaaaaattttgaaaatcacttttagaaattccaaaaatcaccagcatttttgctagcgcggccttttcgaataaatccgaaaatcacctgacaacaattttcaagaatgagaaacactttaacaaagattttgagcaccaaacttattcctagacatcaaggcaacatcgtccttaatagtacggtttttctatcgacacattcaaagtaaaaaaaaatcacattttaccgtttgaactttcgccgcactttttctttttatttttgttaacacgaatggttattgccttgaatataaactcatacaggactaatattctttcacatgttctcaaatcagctgttagtcctcactactcatattgttattaactaacacaataattagggacctagttgtactttccgttggttaaaaagtgagataacaacgtcgtacataaacggaaggagagagagtaggtattggtggtaacaataataaataaagaagaaacagtagtagagcaataatgcctgaaatcttagtggcaattatttaaatgtcacttattatatgtaaaaagacaaacatatggtccaagtatgcaggtgcttgtctccatgtggtatctgagattgaaacgatggatcatgcaacttaatttggattttggaagttgcacacctgcagcacggaatgcagattttttttttatttagtagatcttactccctccgtctctaatataaaggattttgacattttactttatgtttgacttttcgtcttatttaaaaaaaataaaattattatttattttatttgtgacttactttattatctaaagtattttaaacacaactttttgttttttatatttgcacaatttttttaataagacgagtggtcaaaacagtgcaagtaaaatgtcaaatcatattagggatgaagggagtagaagtttagtaggttacacgcagattctttcagccccaattggagcattcttatttttccggatcaccatggaatcgaatcgttgctccaaacaaggactcaactgattatcatgggatcaagcgagtacttatatattattgtaaggttaattacatggagattcttcaagccccagttggatggaacatgtggcatttctccagatgccacaaatcttttgagcaaaagttccagtgaacaggtctaaaattgaagtaaaccaaagcagataattgtacagtatccagcattgatcagtactaatttgctggagaaaatcactgatgaatcatcattatcgatcacgggatgccatatcaagaagctttgatcctgcaacggcaccaaaaaagaacgaagaacacatcagtgtataacgtcactaacattaatatcatcgatcgtgttcgaattaatcactctgcagctgctaaatagctcaccagttcatcttgggcaggatcctgtcgagatggaacagatgcttcctcacccggtacacatgcatcgtgtacattgccgccgcgcaggtcacgagaaagaaggacagcacgatcagctcgccgaaatcctgttgaaaaaaaaatcgacgggaaagattatacccgattccttagaaccacgtgaacgacgacttcaatgcaatgttctttccaatatcgcaataagccgtgtatatatcctcgttggatgtagaggtcgggtttttatgtaaaaaatttttattgtggcaattaatttccatgtgcagcatgggggatatggtgttggtaccctggggtcggagacgatgatgcccatgacgtaggtgagcaggtcgaacatggactgcagcgagttctgcacgccgccgacgacgcaccggtcgctctccgggacgccgtcctgcatcagctgcatcacggctaggtcgaacatccacagccccagccgcgacgccgccacgccgcccatcagcatccacgccgacgccaatggcgcggcgccgccggcccagacggaggcgacgcagacgaggaggcagcaccactgcgcccagatggaccagaggcccgcgcggagcgtggacacgcgggcgtgcgccgccgggtacacccacgtcgcggcgatgccgacggcggcgctgacgccgcgggcgaggctgatcacgtatgccgggatcccctcccagtccagcgtcgccgtcatcagcgtcccgaagctcagcacggtgaagtagaggaacgcgagcgccacgccggggagcaccacctcctgccgcgcgtacaccgcccacgactcccagcacggcagcatcgtcatccacagccgctccaccttctgcggctgcgccgccgccgctgcctcgtcatcgtcggcgcgccgtcttgagatctggctggtctcgctgagcgccgggaagccggcgtagacggagacgaagagccagtactggacccacacggcggcgaggttccacgccgccagcgccgccgcggaggcctccatggacacgaagctgatgaagaacccggacagcaccggcgccagcagcttgcagctcaggtcgatccgccggatcaccgagttgatccccgtcagcaccgccgccggttgcccgccggcgatcaccaccaccctgcacgcagcaaattctcagcaattttctcgatctatcaatcgatagatgcgaacaccgaacactaccattctctctcgatcagtatggtgccagcgagggtggagagcgcggcgagcgcgccgaaaacgttggtgacgacgacgagcgccacgaacgccgggaaccccgcggcggcgagccgggcgccgtagacgagcagcgccgtgacggagacgccggcggcgacgaaagacgcgccctgcagcagcagccacagcctgagcacctgcaggtatgcgagcctgtcgacgacggcgccgacgatggggcccagcgccgccacggcggaggcctccacgacgccgtacaccgccgtgagcaacagcgagcccggccagattcggatcatgtagagccccaccgagaactcccacatcctcgcgccccacctcgccaggaagtgccccacgtagagccgccggagaagcgccgcgtcgtccaccccgccgccgccgtcgaggagcggcgccgcgaggtggccatcactcgccatacttactcaccttgcaatcttgaatgattcttgatcgatcacacaagaagatgtacggatcagaggccaatcgatcgaaccgcgacgagactgatcgatcactccgatattgatgtgaagaagagattgattcttagccaggagagatgagtggatcgagggattgaaaaagagaggatcatgcaggtgaagggtgagacaagaacacgtctgcatctgagcagtcagggagacgctgctcttgtgctacctccggtttactacctgacagaggcagcagctaacctactctgtctctcaaatagtagtaaatatcgagagagaattttaaactctggagggatgtcctcttttattatttgcatgtcacctaaatagttataaaaaaaataagaagatgtactaacatgtgatatatcactccataagtatacaagttaaaaattcaacttctacatgttagaacgaaaaaaataaatttaactgtgagtatacgttaactagctgtagtttaatgtgtttgtttttttttttgcgatatgtataagttgaattttaacttgcttagactttttgtttgtaatttttttatcattcgttttattaaaaaaatttgaaattattatttattttgtttgtgatttgctttattatcaaaagtactttaagtgtgacttatcctttttatatttacattaatttttcaaataaaacgaatggtcaaatattgtaagcagaaagtcaaagcaacatctattatgggactgaagtagtatattaatgcatctttttaaattttttatagttatttaattaatatgcaaataacaagaagatatgcccttgagaattagaatagttttacagtaaatactctatatactattatgaaaatgtctttctcctctgcctccacatggaaacttcatttctctcctaaaaaccgtacacctaaaaaattgttttcttttaataaccaaccattttttttaaaaaaaaaacaaactgcttgttgggttaaaatcctcaaactaaactgaataaaaacctgttacaacactagtagaattaaatatgtaacttaactcagatttgggggataattaagtaattaagcctcggtcaactacacacttgcgtgataaactacacgggagctgtcaaatcttgtctgatagatatatgagctcccattggaggtacttagctagataagtcgcggttaataatttggtgtaatatactacaaggctgtcaattcttgtattgtgtacttatgtggcagagtctatagtatgatgttatctctgtcagaccaagttgatttgtattactgtgggcagctccatcgggtttattgtatgatcaacctattgcagggaagacgtttagtatgatcaattgggcctaccttaattctttcactgaatcaaattgagagttgtatagggattaacatttgctctacggtttattaaaaaaatgtggttccttaaaataattttttttctactgcattatatagaccatttatttaacttatctctgtgacaagtagataattggtgataataatttgttcagtaatttaaatcaaatgggacagagagagaaagagagaagacacatttttccgatctgtcgattgttgtaagcgttccaccaaaatcttatttactgatcagggagagttggttctgctaatcacgaaatcttatttagtgataaactcatatatattttttcccgctagtctcaaaaaggattattttctataaccaatgaaaaattgctcaagtctgattcgtacttctagggtagccttacgaaggtcaaacataattttctttcgtatatggatcattgacgattaagaatgacccttgaattaaatttgaaaataataaatggttggaaaacacaagcttacaggaacaatatccttaccaatacaatattgttaggcatatacagacactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctactttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaagaaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaatagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctcacctgtgacggcccagagtgctgggcccgtcacaggtggtcttacctgtgacggctccacggttggcgcccgtcacaggtgaggccacctgtgacggccacatagtttgagcccgtcacag

SEQ ID NO: 3758 - DNA, 4657 bp, Oryza sativa
  unsure (1)..(4657): unsure at all n locations
gccacacagccataagcgaggtattattggttgtaaaactggtggggaaatatccaacccgccctgtaaattgtgtctctcccagatgccagcggaggggtaccttcccccaatgttggataaagcccccataaaacttgtacccacaataacccgtatagaaggtgtttaagttaactccccaacagcaccaacaaaaccggatgatggtttaatgggggtgaactcttctaaaacctccgaaccaaccaaaacgttgggttggtgaagaaactggatgggtagccttatccccaaaagaagtaaaaaatttaccttggggtgaagatggttcaagccgtacggaatgggaagcacaagcagagcaaaagagccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataagaacagattatctacacttgttcatttttttatctattcttctttttgcccctgttgtggctcaataagtaatgaattgctcaataagaatagtttatctgtacccttattgtgggctgttttttaaatttgcatgattgactcagtggttatatacctctacacttgttctttatggataagaacagagtatctacacttgttctttttttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgcttgttatgtgaatttccaccctgctgttgctgtttatgtgaatctccccttgctgttgctgcccctgtggcatatatacccctactgctgttatatgaccctgctactgctcttttccttatggataagaacagatgaactacacttgttctattttattgataagaacagatgaactacacttgttctattttattttctatttcctcttttttctgcacttgctcttttcttctggattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatgattgattcagtggttatatacctctacacttgttctttttttatgcataagaacagatttcctgcacttgctctgttccttatgattttctctttttatccctttatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacaactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatagagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcccaatttgagctaggcatgcctgcaggtcgactctagaggatn

SEQ ID NO: 3759 - DNA, 25072 bp, Oryza sativa
  unsure (1)..(25072): unsure at all n locations
cacctctgccttgctcattatgtccttttattctntttatcttcnttcgtatagctctgtctctatgggcgccggctataaatttntctctccccncccccccnccccgtgggggttgatgactgtcgctgcnccccnacnncanncagannagcccgagatnccaaagagaaaaaggcagaggagancccggagatggcnccccctcaacctattttgtctgagaaggaaagaggcggccgggtttggaaggggaactgcggcggcgcgaactatggtttcggcagcggcggcggctcggggaagacgaacctgacaggtggaccccacctgtcagcggcagcgggcgcgcgcgcggcaacggactgggccggctgggccgaggagagagagaagagaggttttgggccgactttcggcccaaagccaaaagaagactttttaaaactttttcaatttaaattatttcttaaatgcaattccatttattaaaaatacttccttagctcaaataaatcctagaaaaatctaggaattatagaattaagcaaagtatttaatgaaattttatctggccactttttatattggaatttattaattaaacatagattttcttttcaagacttttaaaataaattctagaaattccatttaaacaacaatttatatattttgaattttcagggtgtgacaaacctaccccccttaaacagaatctcgtcctcgagattcggaagaactgacaaacagatacggatgagctgacttcaattcatcttctcgttcccaagttgattcttcttccgagtgattactccactggactttgcaaaatcagataactcgattcctggtccttctctcacttgtttccaagatacggatcggtttctccacataggtcaaatcctcttggacttctatctattcaagattagcttcttcggtaggtacccttaaacacttcttcaattgcgacacatggaacacattatggactcctgccaaagattgaggtaactctaactgataagcaacctctcctcttctactgacaatcttataaggtcccacaaaacgcggtgccaattttcctttggtctgaaaacgatgaactcctcgtagaggcgtgacacgaagatacacataatctccttcttcaaaactcaaatctctgcggcgattgtcggcataactcttatgacgagattgagccactcgcaatctttcctgaatgatctttaccttttcttctgcttcccttaggatatctgtcccgaaaacctgacgttctcccgtttgatcccacaaaagcggagtgcggcacttccgaccatacagtgcttcgtaaggagccatctgtagactagcttgataactgttgttgtacgaaaattctgcatagggtagattcttatcccaacttccaccgaaatctaaagcacaagctctcaacatgtcttccaaaatttgattcaccctttcggtttgtccgtctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgctaagcgacttccggaataggttgtctttaccggaataaaatgagccactttggtaagtctgtcgactattacccaaatagagtcatggcctgatgacgttctgggtaaaccagtaataaaatccataccaatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcgcaatacacttggaaacccttctttggatcaggcaaaatcaaaataggagctgatattaagcgacttttcaactcttgaaaactccgctcacattcttccgaccacttgtactttacatctttctgaagcagtcgtgtcatgggcttagcaatcttggaaaaattctctataaacctccgataatatcctgcgaggcctagaaaactgcggatctctgaaactgtctttggttgtttccagttggttacggattccacgttactaggatcgacggcaactcctccggctgagatgacgtgaccaaggaatttcacttcggacaaccaaaattcacacttgctaaacttagcatacagttgatgttctcgtagcttttccaatgcaaggcgaagatgttcttcatgctcttctttggttcgagagtagataagaatatcatcaataaagaccaccacgaacttgtctaggtattccataaacaccttattcatcaaattcatgaagaaagcaggggcattggtaagtccaaaagacataacagtacattcgaacaacccatacctagtggtaaaagctgtcttaggtatatcctcctctttgattctcaactgatgataccctgatcgaagatctatcttggagaaaacagtggcacctttaagctgatcaaacaaatcatcaatcctgggtagtggatacttattcttaatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcctctgggaacacatcaggatactctcggactataggaatcttttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattctaacaagataagattggccagaaatggtactcccttaatttctattctgaccgaggggctatgttgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggcagggacaaccttcacgcgacggggcttcggacacttgtcagcataatgtcctgggtctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgagtaagcgacctgaacttcttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattatcccttggttttgctgattctgaaattgctgcatcatcatgttcataagctgtgtctgttgagcaagaacttgggccagagtgggattctctccattgttgttgttagggttgttgttgttgaggttgttgagaccattcccattgctgcgagtgttcaccatctggcatgacaggataagaagagaaaacgggggaaactacttaggacagagaattaccttaacttttattgatcttaactgagtttcattattacaaactgaagactctcacaccactaaactcaccaacttcctaacactcagaagcaaacaaacgcatgcacttacatcccaccactgatgtaaataacatgcaagacccacacacacaaacaaacttaaaacaagcaaactaacacaacgatctaagacaacgacttaacaagtcactctagttcttccgagcataggaggtcgattgaaggctcgttcggctcatcttcctcatctttgatagctacccactcaaacttggaattgttgcgcttgggttcttcttcttcatcactacttatgatgatgacgggaggatttgctggggcaacttctttctccaccacgcggatctttggcgccaattgataacgagggacaaacaaagctctcttccttgcggtgagacgaatcctggccttctgcggcggtgcttctcccttcaatgcggctaattccttctccaagcgatccaccttgtcttctagcttgcaaatcttaccacgattccgatcttcacgatcttgagctgctaacacagtctccgcacgactttcatccatagcccacagcatctcaaccaaatgccttgtagtagcatcattctcaattccttcagtctcaaggtaactgccacggtcacttccctgtggttgacgaggatggtagcgatactcagtatcggccaaccgatcactgtagcgatcacggagctctcctatggcgatccttgccacttcctgacatgcatggatgtagtttcttcctccagcttcaaacatcactgaggggacctcttcactattgctgttcaaggtgactttgactcggcacttttcttcatgacgatcatgacgaatctgggcataaaaaagggcagtcccaaatccaatgacaaaggacatcgtacgcaactcctggacaaaaccctcaacaccaaacaggtactcaggcttgtaacgcggcatctaaagacaagtgaaaggagagagttaagacctttatccaattaatagcacaagtttttggattaatttgaataaagtttagaaatcaaagtagaagggaagtaaataaagtaaaccaagctttgcgagataatttgaaatagttggagacaaggtcacaaattttgtaattttgaataactggtttcaaaagaaataaaagaaaattataaaatcgacatactaaatttattttattgcagcaagattaaatacaacattgtaaaacttttgctggtaaatgagccattagtacagtaatagatgtacagtactaataacactggaataaatttttaatgagaaccattaaaaaaaaattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaaccaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatacctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggattattgcgtcagcaactagggtttgggtggaccggcgcacgggcggcggttcacacgaacggacggccgagattgatccgatccaaatcggacggccgagattgatcgggtccacggcggctcacgggagaggatcctgatgacgtcagcggtgacgtcaccgacggcggcggcggctcggcgggcggggacggctcgggcggcgcatgctcgccggcgaacggcgacgcgaggacgcacacggagggcaccaacgggtagcggacggcacggcgaacacaccggcgaccaaaacgacggcggagaggcaacggacgacgacggcgacgaggaaggagcggcggctaccttcgggttgtcgacggcgacgaagctccggcgggttccgacggctgcgaaggggcggacgaggacggcggcgacttggcgatgacgacggcggccttcccgagcgacggcgacggctggaacggcggcggcgcacggctggagcggcggcggcgacggcaaagctagggcacacggcgctagagctcttccggcgacgagaggcgaaggcgagggtggcggcggaaagagaagagcacggggatccttttaaaggggctcggaggcggcggcgaaggcccacggcgacggcaacggcgaaggaaactcgcggcttggaaagagggaacccgatccgaatcgaacttgattccaacgctttccaaagcgatttagccgatgattccaaagagaaaaaggtagaggagatcccggagattgtttcccctcaaccaattcggccggagaaggaaagaggcggccggatttggaagggaaacggcggcggcgcgaactagggtttcggcagcggcggcggctcggggaagacgaacctgacaggtggaccccacctgtcagcggcagcgggcgcgcgcgcggcagcggactgggccggctgggccgaggagagagagaagagaggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggccactttttatattggaatttattaattaaacatagattttcttttcaagacttttaaaataaattctagaaattccatttaaacaacaatttatatattttgaattttcagggtgtgacagccaatttgagatgttaatgctattacttgattaatttccgaggagaaatatcagaatggtgtggtacactgttacagcgggtgaaattagtctccctttatctatgtcctaatgatttagtattaaattagagagtaaagtgcattggcggtccttaaacttgtagaattgtgtcatattcaacacatggagacgtgtccttaactttttttttcttcttttctttttctttcgttttcttctcattcttcacaaagaaaggagaagaaagggaaaaaagagaagaaaaaaaagaaaaatgaaaaattttcaatgggtcccatttatcagttaaaatttaaatgagacttggatattcatttcgagagtttagggacctagatgacatatccctacaagtttaaggaccacccgtacactttactctaaattagatgtggacatctcctcgtgtgtgtgtgcatatatatatatatatatatatatatatatatatatatatatatatattattttcagacattgtctatactaaaaagaatgtagagtatgcatgttggccatcccccatctcaccaaaattgaagtctaaaatcaacatataaagtgagaaaattattacaaaattgaatagctaaattactatttatgttttagatttgtctatttttttctcgatatatgacttggatttagactctaattttctgagaatattatactgctgttatattttctaaaaaagaatactattatcttctatttatattattttataagataactaggggtattacaaatactttgtccttttaggtataccatctcgaaaaagagcatatatgtatatacacaccagctgaggtaatacaagataacaccgacggtccaaatgaggaaacccatagtcttagggggtgtttgggagagagtggctaccttaaacaaatgcaaaaggtagagaagaaacaactttttatcctccaacaacttcatttctatatctagacagccaaacctcccccaaaacagaaacctaaaagaagaaaggaaactaaaacgaaactttttttcaaaaaaataaactatatatgaatctcttagaaactattctaaattcatttttgactttacaatatttatcattcgttctactcttcaattatttatcattcgttctactcttaaataattatcgtaaatcattctgtcattcagctattcttagatgctttatccgttctatattatattttgactttttaagttaaagacttggataagtctgtaagaatagcaatatttttaataaaagcatattattaaaatatattcaatgttatatttaatgtaactggtttgacatagtagatattactactttttataaatttaattaaatttaaatagatttataactatgaaagattaaaacgacttataatacggcgatggaagagtaggagcagatggacggagcacccactgctgcgggcgtgaggtgtcgctgtcatccacagccgtagctccacgccatggctgagtcactcgctcgctcgcctaggataaacccgttcatagtctctctctcgctgacgccccggccccacctccagcttccccgggctataaatccacctcgcccttcttcttcctcctcctcagctcaggcagcagcagaaagcaacgccaatacgccattgccgtgctcctcgacctgcatgcacctctgttcttggcgttgagatacatagaggcttggggtgggtgtttaagaactaagaccggagttaattagcacccctgtggctaccatcgatctgtctaaagagtgattagatcgagatgaccatcaccattgagcagcctcaccttggtgagctcatgatccttttctctctctctcttgatttcttgattccagtccgtgaggaagaaaaggttcagcaatgttcctggatggatggatggatcgtgaaactaattaaggttctaagttctgacatggttcgcttgcagatgctatcgccgaccggaaggtcgccggcggcggcggcggcgacaacgcggcggagctcgtgctcgacggcggcttcgtcgtgccggactccaacgccttcggcaacgccttcaggtcagctacatattcctgcataggaaaaaaacagagcatcatgcaaaaacagagcaaaacagagtgtcaactatggttaaaaatattatcccctcagaagaaaaaatatttaaaatatttctagtggattagggaatttaattaatcatgtagtatttttttaaatatggtgaaggttattgtttctctttgcaaaaaacagagtgggcagcaagttttttttcaagtggacatgtgcaaataatcatatattttgcatatggaatgtcttcttttttctcctttgcaaaaacagaggttggtattacttgctccctctaaaataagccaacatcgtattaagatatgatatattttagtacaacgttatatttagatttgttatattagaatgattggcttatttttaggacaatgcgagcaggctgacaagacagacatgatattttcgtacgaaattagtaaactagaacatgggcacaactcgaaatgaaagagatgtgtggccattcttgaaacttgtggttgtgcattcaaatcgtacatacctctctctcaagccacaatacatgtttgtcccattacttcaagttgtctttccatgattagccgtttggtttagtttttgttgaaacgtccaaacccaggttttgtttttttttcagataaaactggacaagaagaagatgaatttgactacttaaacgtaaactcaattttgctgaccaaagtggcaagctacttactggtcaaataaaataaaataaagacttatcttttcttgtacgatttcaaaggtttctgcgtgtctatgcacagtgaatgtcccacgtggcatctgtggctgcattaacatggccttttgcctattccttttttgcacgttatcattttcgcttcttcaggaattctgtacttcaatttgatgtttctttaaaaagtccaacacgtggacaaataaaacactacctgtgttcgaaaaataaaaaccttatggtcataatctagaaattgaaatctttttcaacggtggtagtaaaagatatttcttaaaaaaaaggaattaaccggaataatatggtgatgttttaaatctccaggaattatgaggccgagtctgagaggaaggagacggtggaggagttctaccgggtcaaccacatcaaccagacatatgatttcgtaagtgcaaattctgtatctaataatctttttttaaaaaaatacactcataatatcctaaacgacaagtaaaaaagaacgggagctttaatatatgagatttaccattattttggtgcattgtaacattgcaggtgaggcggatgcgggaggagtacggtagggtggacaagacggagatggggatctgggagtgcatcgagctgctcaacgagttcatcgacgacagcgacccggacctcgacatgccgcagatcgagcacctcctccagaccgccgaggccatccgcaaggatttccccgacgaggactggctccacctcactggcctcatccacggtaaattaaactattttataaccgccacaaaaaccgtcactgtaattgcacatccaccgcgtcgccgcaatgaactgataggcaggcctcacacgatacaccgggtaggatttgttggtgtaagagcaggtacaatagcaggctattagccagctataaatatattttaatgagataaacgatgagagagaagagtagtgggctacagatctgtagccagctgcagcacggacttcaagacgcaatgtgtgtatgacaggtgataccatatattaatagtatagtaagcaactattgaatgaattggctattagattagctatagatgaattggagctagtagtgggctatactattaaacttgctctaaggtagtaataatagtatatatctaggactcatccagtcactagcaggtaggccatacgataaataaagatgaataattagatatgatggagtgatacagtatcagtgacggttcgtaacaacctctttggaattactcggctaaaggaagaaagaaatgaaatggcaatacagtggggcacacttgtgacgtgtaacatgttctcttttctttttcagatctgggcaaggtgctgctgcatcccagctttggggagctcccacagtggtcagtcgtcggtaagaaacaaacaacagaagcaaacagcttattgccatctcactgaaacttcttcagattcagctaggaacaatagctgaacatccatccatctctgaatctgaatgtctttgacctttcaggtgacaccttccccgtcggctgcgcattcgacgaatgcaacgtccacttcaaggtaaccaatgaatcatctagcaaactgttcaagacaaatcaaaagcgtagatggatcaagcagtgagctagtggtctaagactgaaactgaaaatattttgtctgaaaatgtgcagtacttcaaggagaaccctgactacctgaacccaaagctcaacaccaagtttggggcctactccgagggctgtggccttgacaatgttctcatgtcctggggccatgacgactacatgtacctggtaaaacacacggttcatcgtgtcgattcatcaccaattgcataccatggagcagagaaatcttcagttctagtactgaggttgtagttttctctgaaatgttgatgtgtttcttgttcttgttcatctcaggttgccaaggagaacaagaccactcttccttctgcaggcttgttcatcatcagatatcattcattctaccgtaagtgcgcgcgacagtcttctttttttcaattttgtcagaattacaagttttaagtaagttttagctaaattttgctatctttgtccatgattcagccctgcacaagcatggagcctacatgcatctgatgaacgatgaggacaaggagaacctcaaatggctgcgtgtgttcaagtaagccaccagattgatcaccctgcatcttaatgtatatagtatgaaaatgtactgaacatgaatggttttcttctgcagcaaatacgacctgtacagcaagagcaatgagaggatagacgttgagaaggtgaagccctactacatgtcactcatcgaaaaggtatgatcgattttgcagcgaatactgaagcttgaaacagacttctttttgtcctaaaacctgaagaaatgatcttctttttctctctgaattctctcgcagtatttcccggccaagttgagatggtgaagaagagggagagaacataaaaaaaattggtcgaaattatcctgtaatatgatgtaattgcaggagttcagttggctgtacaagtatgtagtagtacgtgtacacattttgtatgttaagagcagaatttgttgggagccatgcacgtggaataaaagttgccggtgattgttctttgtaaatgagctcttgtaggtgggatctgaacatgaaattgcattcgaaaagaagggttgaaatttgcaaagaggcgtgcagatttttcgtgtgtacgaggaaagatgagatgaactgagcatctgagccattatctggatgggccttttggggtgtgaggaaatgggcctaagttaaagatggcctgagctgttttgatgccttcttggcaaggggaaaaagtacaccgaaggtcccttaacttgttgtccagttacaaaatcgtcctctaatcatagtaccatagtaccagatagtaccagatatatgacatccttcaacttacaaaaccatttattttaggtcccttggtgcttttcaccctggttttgtctgatgtggcagctgagttggcgtggaacccatgtagaccccgcatgtcagaacgccacatcatcatcctctcttatttcttgtcttttttctcttttcttttatttcttcaattctcctctcttctcgatgcagccggcgccagatggggagaggcggtcatcgaggccagccagggagccccaggcttggcagagagggcacgggcatggcgccggcgggttggggtggtcgtagaaggggcacaccgccgccgccccctcccgcggatgttcccgcgcccgacgacgacgacccggcaccggagaacatggcggcggcggccgagccgaggaagaagctgtcctgcatggctccagcagcggcggcggcggcccccgccgctgggtcttgggcgcccgacatcatgtgatggtgagcgccgcgttggcggcggcggcagggacggacgggccgcccaactccactccgccagtcgccactcctttcccccggccaccgttcctctgcctagtgggcggcggccggcgggggagcccgcgcaccgctcctccccccgccgtccgcccgcgcgatgaatttggcttttttttcgttttcgtaaaccctgctccagagtacaagagagcaaaatgggcctttttctggtcgaaatgaggagcttcgtgtttctgagatttgcgaattgcttttaagtccttgttactgaatactgcattggtagtttggtacaaagtgatccttcggtattgccctctgatcttggactgaacaaaaacaatcccggataagctaccttctggaggaaataatcccaatgaaaccagggaagtttaccacgatgaattcaaccacaccagaagaaccattataaactcaaatgcttgtatttcccgggaattgtattcctcgatttactctgctcgattctcaaatcagattagagtttgacaccgcgagagatgaggccacaggttgcgccccccccccccccccgggggagtgcggagtcagcctgcgcgcttcatgccgccgtggcggccgaatagccccgcctgcaacacccaatccttgaccatctcctgcgccgcgtggccgttgtccgccggcaagaggtgcccggcgccgtagacgacgacgtgggagagcgggccggagcgctgcacatacccggcgagctcctcgccgatgcgccacacggcgcagtcggcgtcgaggaagacggccaggccgtcccacttcagctcccgcatccacgcctccgtggacaccacgccgtccctgaggtcacggatgccctggtacagcagcacgcgcgttccccgcagcagcgcctccaccttcggcttcacgctcttcatcacgtccccatgcatcgccgcgcctaccgcgtcgctgcactcctcccactccatatcgccacgcgcgcccagggccgccttcacctccacccggttcacgaacttccccacgggacccgtctcgtaggggcgctgcttcgctgcgtcgaacagcgtcgccaggcccgtcgcgttctccagcaacgacagcacgagctccctcgtgtcggcccgtcgcgttctccagcaacgacaacacgagctccctcgcgtcggccagccgccgcgtcgcccatcgccggccgctgacgcccttctcctcccgcctgctgagtcagagaagggagagaaatacgaggaaaggagagaagagggaaaagagagagagaggaggttgaagtggtcacgctgacacgtgggtcccatgctgactcagccaccacgtagaataagttaagggacgctggatatctggttttgtggttgggggacgattttgtaactcgatgacaagttgaggaaccttcggtgtactttttccattggcaaggtgacagctctttttggatggaataagttcactttaggtcccttaatttattgcagagtctgaaaatcatccttgaaccacaataacaaatatgacacgtcttttaactcctaaaaccagtgcaaataagatctcaatatggtttggatggtttcggatggtggtttcgactcctccaacaagagacttcgtgataacatcgtcaacccgaagggggcggtgccatcaatgatcgagaatctggtggccaccaacaccgaaaaccaaaatgtcaatttccttttatatatgaatcaagtaatagcaaacgagtaatcacaacttcacgatcaattacacatcactacagcgcagagtcccaaagtacttaccaatcatctagaactggacattcctatggctaagaaaaacacaaaagacaagaatcatttgagagtgaagcaggcgaggctagcagatctatcggaggtgccatcggctgggaggtgataccttgaggttggaggacgccgccttggagtcgagcgacccccaattgctcgccgcggagatggggagattggggagaaggagacgcgagtcccactgtatttttttttacttttaattggaccgtcactaacatatgggtttcaccatttttttctcattttaaacatcgtgttagttaaaaccaccatccaaaccgtctttgattttatttgcattgtttttgagagttgaggaatgcgttatatctggtattgcggtttagaaatgaatattagattcgacgacaaatttgagggacctgaagtgaactcattccttttggaatgtggatgatcttttgcaagttgaaaatgggccgaaagaacagtctttcaattgaccctaaactgttcccttctcgtaaatcatttcgcatgatgctttattggtagtagatgtaaccgtagtgggccggatccagaaatgggcggaggcatggaccgtgttattagagtttttgctccacccctgaccatagaacattgtctttttttcttgatccaccctaccagcacacactcaccaataggggcattcctagtgtaatattcatagttgtgtcacatcacactatgtaggacgaggttgctatagctttacgatgatggctactacctccattctaaaatatttgtcgttttgagtttttgtttataatatttgatttttcgtcttattaaaaaaaatatgaaattattatttattttgtttgtgatttgctttattatcaaagtgctttaagtatgatttctccatttttatatttacactaattttttaaataagacgaatggtcaaacgttacaagaaaaaagtcaaagcgactactaatttgggacgaatgtagtactcattattcttttattattatcattttggctcttgatttcttgtatgccaacccttctcatattttttattaacacaaattaactgaaacttttacaatttagacgctataacaacatcatcaaaaatacatacataccgttaattataggctgacccactatcaccctaccttatttttttctccctcaccgccctctctctcctctaattctctccccagcagatcgatctccatttccgcctctcttgtcgcctcctcccctctctattggtttccttttcgcctcctcccttctccatctcctcgagtgccggccttcgccccctcctcgttgccacctctcgtctctctgcttcctcccatcccctttcctcctggcagtggcggctcaagcttggtgccactgatcgagctcaagtgacaggagtgccctacgacagcgtccatagtcgaggtcgtcatcatcggttggcccttttttcccctccacgattgggttgggttgaatggaagggaaggggaggggggacaatgcatgcttcgattgaagttgggtgtatgccactacagagatacacgggttttaccgaggttccgacttgtgcaaacgtggaggggattcttctagcggtcaccttattagagaagaatgccacataagtataggtctagctaagacatatatgatatatgaaacataggacaaaggtaaatatctctaaatttctactcaaatcgtgttcataataatcgttgataacatagattcgatgtttaagaaaaaatctatttcttttgtatagcactttgagtatagtgacggcagttctcagataccgaatagcttatctctatttctagctattttaagtcatattaatcattatattactacttctagctattttaagttatattaattattgtattacttgaaaattagactataatatgtcgagaatccggtataattatttttgcaaagtttgtcaccgtacgtgtatacttgtaccctacgcttggacgtgccgctcgttcactggctaggacggacgagacaaccgagtaaacagtactccatccgtcctgcagccttgcttgttgtctccgtgcaccagggagaagcaagcagcatctatacgtccaaagtaaagtagtactagtacggtgcgagatcaaactgaccagtgagcttttcagttttcacggcaacaggaggcagagaaagcgagaggaaggttggccacaacccaatcaaaaaggacgtgtatctgtgcttttttttttgtgcgagtcctccattttcccttgtgatgcaatcatccgttgaaagatgaaacacaccacgtctgaacaaaatcccccctttttcgtccgatatatggttatattttttgggggtttgaatttgaatttgacgacggccaggccacgatcgcgagcgaagtggaccgcggccgaaccacaacctgctggactggactggagtggtggcgagacaactgatatcgcctcctcgctccaaatccaatcccaccaaggctggaggagcatatacacgatgctattggccaacttgtatcgcgcacatcagaaaaagcgtaaaagcatgtgttttaattattttggacacgcggtagaataggatggacttatccatgtttattaattatgagacggttctatttatccgtctagtatgagagatagaacgatgctaagctggagatggagctttaccaaatatgccccaagggtgtgtttgtaactcctttttcccaacccatctccctctgttttccgcgcgcacgcttttcaaactgctaaacggtgcgttttttataaaaaaaagtttctatacaaaagttacttaaaaaaatcaaattaatccatttttgaaaaaaattttagcaaatacttaattaatcatgtgctaatggactactccgttttccgtgtttactgtgcatgcggggaaactggagtagcgaacacaccctaagtgggttgggttaattagtttgtcgattttagtgggatagcgtcaattaaacctgggtcttatgagaatattctttttagggaccgttctcatcatgcgtgtccttaaaccaatgacactgaaaaatgtgtttgatctatgccgatacatcctattccttgaaccaagcacatgcttagtgataggagtaaatcatatcacgtgaaattcatgtgttccaaactggtgccctcctctagaattacacatttacgtaacacggtcctttttagatgtgtaattttgcatgactgaaactaggtctaacttggttgacgtggatttgtccatttgtctgtttgatctcctttaacagcaggtgtaaggttttcgagtctgattcctcttgaacaagtgttttttttccattcttagtataaaaaaataggaacaatctgtcctctttatcgaggtataaaaaatttgggtttgatgtatgatttcatctgtcagctgctatttctatgtaacgctcttcacgcatgcttttttacgaaaaggctaatagttaggggccacatgaggacatgatctccttaaataattcaaggtttccattagagccgacagtgccaacaaaaagggtctacctccttttccctgcatctacagccaaatctcatcaagccatctccctccacccaaaagctggattgtgtttggtcgtctccctctctccaccactcccacccaactagtaccgttggagaaggaccgaataaggttatatctacggagctcaaaattcagagaagcagataaatagacacttaataggaatataaaaatatttcccagtttttgatttttaaatttattcttcgaattctgcaactataaattcttaaattatattctaggtaaaaacctgtaccgtttgaaggagctaaagactttttttttaaaaaaataattttagtcagacataaactccttcaaacatgaccaaactgagctaccggagttaaaaaaaaaaaagctgagctactgctagtgctagtgtgaccagattgtggagtatatacctatgcggccaataataggggttcggagatcgttgcgatgattttatagtgcgtagatactctagtactccctccctccatacttgtaaaggaagtcgtttagaacagcgacacggtctctaaaacataactttaacttcttgtttctataaaaatatttattgaaaagtgatatatgtataattttatgaaagtatttttcaagacaaatctattcatataatttttacattttcaaactcaataacttgagagttattcatgatttatatttttaagatttaacttaaatattgtcctaaatgatttcctttacgaataaagaggaagtactagagtcattatgcatggggatgatgaattgatgattattattgaattggtagagtgctcgtgcaactgcctgccagtggaagtggactcctgcaggggatatcgatagtggtgtgtgtgaaggcaatgcacccagaggccagccggtgggaggtacacgccgtaacgtcgctgcagaccatacatggggcacggaaagatatacagttattttggaaaaaaatatgggcctgtttacttgataaaaaaatttaagaaaattcgattcatagcacagaaaaaaacagtaccaaaaaatagcacaagaagttttcgcttatagaattatagaacgtcaagaattatagaaccggagggagtactttcttattgtatttgtcggtgatatgggtccgggggtacgcatggtagaggggaatgaccttcccatctagccacgtggccgtgcggcctgccttttccccaccccctcggggggaggtcaggtggttatgaggtggccagggggcctcggggcgccacgtcacacccctcgggcccgtgaggcatactgcctcgaggccctcaccggccaccacgtggcggagtgagtggacggagcaggcggtgccatccagcgtcttaaatgcgcggcgccccaaccatctcttaccacatttaatgtggtgtgggcagacgtgcggtgccgcccgattgacgcatgtcaatcgaccttgaccggtctgcgacagatcgcaggcggataggacaagcgatagtgcccccacgtcccaccctgtgtcaggtggagtgggggtagatatgccccgtcccatcggcacactgccaagtgcgccccatgtacatggtgaatccaccaaagtctccatacatttaagagggaatggaagggatgtcccccgtgtcaggcggaggacggcgttgggccgcacctggcggcggacaaccactttgcttccagttgaaggcacggatggtgatctgactcaggccaagtgagcccccccatggagggataggtatgaacggtgcatgtagtatcctcttaaactataaaatgagaaccttgcccaccgaaaaaaatggacgactcttgatagcttgagctccagaggaagcacagctagggtttccaaggagcacaagatctcttgtaaggactccaccataattccacacacaggagtagggtattacgcctcccggcggcccgaatctggataatccctcgtcttccacacagattcgctagtgatctagcagctagaccctaagcggagatacgctcttgatcatcgcgccttatcccccggtcaaactcacaaaggggggtctcacgacctcccgctagagaggatcgctcctcgacagtattcgtttcttgggtttgaaattgttgatttaaaaacaaattgaagctaatttaagaaaaaataaattgaagttgaatttttgcatggttattatggtaattgtcttaccgtgtggtgctggtaattaaaacccatgcatcggtagagaaacattggttatagaaccctaggttggttttgttatgacagtctagtgatatacatgaaaatttggtatctttatagactctatgtgtattttagataaaaaattcgtattttatcggatgtttgcaaggacgctatgcgtattttagataccaatagaaatgcaatctataaaagtgttagtattaatcttgaaaaactttaaggagcagctgataaaagaaatgtactagggcagaggaggtggggccttctctaaaaaggagtatatagatgatacatttagaaaaagtcttccatcatggtgtcgtacaagtcattttgtacggtggtgtagcattgcatcacacaatgatcctatagcagctggtacgttgaatgaccagcagtactaaaaatgcattcaagtacattgcatttgcatacagctagttaacgtaagaagcaaattaaacgatatttccgtacaaacttccaacagtgcatagaatgggcggaggatatgatctacaaaaggaaaaaatcaccaccatcgagatatatcgattttactttgaataatagtggaatttcttttttggctaaccgtgaatgtttttcacaatcacaatacattgatgacagctctcaactctgtgagtaatttcattcgtcttgacttgagtgtaatgctaatttccgagcctagccatttacaagattattcggtttgaccacacctcttatttcaagcccaataaagatcgactcgttagtttcattgactatagttatcttctattccgtctcgtaccttgatatgcactagtcacatgttattttactatggctatgttaggataacacccttcatgcatggttcttgctcctcctatgcattttcgatcaaagtcaaatactcactcagccccttggtcatctcattgttgttcttgtcaccacatctctctcatactatagttgacactccaagctgcaactaatgttaatttgaatccattgcttcttgccattctcaacatgatcctccctcctttcctccagcttctcgtctggaagtgatgaatgaggagtgcatgacattgtgataatttgatgaaagtaatctcgttgggctcatcaacgaataaccaaccaattataaaaaaaaagcaacaaatgactcaaaatggatatgacaagagcaccagtannnnnnnnnnnnnnnnnnnnnnggccgagtcaaatcaaagccgcgg

SEQ ID NO: 3760 - DNA, 749 bp, Oryza sativa
ccgatgatctgctacagatggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgc

SEQ ID NO: 3761 - DNA, 737 bp, Oryza sativa
cctgtcgtcgcccatttccatacagaatcttcgactgatgtcgcgtggcaaactcctgctgaccgtggagtccaagaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccactgcagtcgagcgcgagtcactcacgcgg

SEQ ID NO: 3762 - DNA, 1060 bp, Oryza sativa
  unsure (1)..(1060): unsure at all n locations
ccgcgttgatgaattgaccaccnagatggnacagnacntcatcattctagatcgatccagatccggcgcccactctcactcactcactctctcgaccgccgcctcgcctctctcgacctctctgccgccctctacgccctcctctgcaccgacggctcgacctctccaccgacgccggcctgcaccaccgccgccgcactcactctctcgaccgccgccatccatatccaccgccatctccgctgccatccagaccctcctcgccgccgccctctctgccgccatctccgccctatccgccgccctcgccgcctccttcttcaccgccgcctcctcactcactctctcgaccgccgccgtcctctccaccgccatctccaccgtcgccgcctcaacccctcctccgccctctccgccgccatctctgccgtcctctccaccgccatctccgccgccgcctccaccgccgccctcgccgccggtcgtcctctccgccgtccgtccatcgacttccccgacctccccgaccctgacctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtgaatgttttggatgaatgtaggggctagattttatatacatgattttggtgcagtgaatcttagcatcaatagaggatcttagcatgaatttttaatgcattttgttttctataattctttgataattaaggacctttattaggtgtagggtttgaaatctagttacaagggaagaattgatagattggccgcagatttaatgtagttccgaggttatcaaacctgatgaactacttgcagaagaagagcctatcaccgtc

SEQ ID NO: 3763 - DNA, 1046 bp, Oryza sativa
cgggtgaaacatagcagactgtgccacgcatgcttggtgtgctgctcactgctccaccactcttgggcacgaattccccactagcccaatccttgctgctccttctcacaccgtcaatccaccaatcaatgctgccattgccattgctgctcctacgactccagcttttcatcattctccaccttgatcgtcccttctcctttaagtcacagtccctctcccaccactgcatgctagccattggaccaatctcactccttgacttagcaagtgctcgccttttttgcttcttggttagctcatcagcatactcctcacgccaccattctctcgccctgcgctttgttttctttctctctgttgaggtggcaggggtggttgcagatgctcctgcaatccaatcattcttcggccgctccttcttgatctccgacctaatccattccatcacatagtccttgacaccaccagaaccaccaccattgtcctgacgccaccaccagtcattcccagctcctgatgctgcagcacctccaccattgcagcttcggccattcaatccgctactgacactagtcttatcacatcctgaagtggatgctgcctctgcaggagaagccatggtaaacccctcatcatcttccggtgacttggcagcattgtcttccccattgacagcaacagcagtagcattttcatcagcaacagacatgtcatcatcacattcgccacaaggattgctactctcatttccattgccctcaattgcagcactctctaattcatccctctcctccgactttatctgcgcgaggccaaaatctgagaggcgagcacggagctcaccatccagcaacacattgctgggcttcacgtctccatggatcactggtggttgcgcgacggaatggaggtaatggagcgcggcggccacgtcacgcgccaccgcgagccgccgtgggcactcggacaccagcttggggcacctttttccgagcagcgcgtcctgcagcgacccgttcggaatgagctcgtacacgagcata

SEQ ID NO: 3764 - DNA, 856 bp, Oryza sativa
  unsure (1)..(856): unsure at all n locations
cctcctgttattcattcgttnggtttatttaacgttgcgttagtcgcccactgcattantaatttacttcttttctcatgttttcctaatatatcatcttntncanncnnnnnncnnaagcgttgaatgcatgacgcacgcccnncancaccggcccgtggctcgccggatctagactcgagcggtgacaatgggggaagcagtggctgctcgacagcatcttgatgtggtaggcccgcggcggcctttccccttctcccttctagcgctggcgcgacgtccctctccgccacagctcagggagacggccgacgagctcggcggtgcggagaggaggagaacgacgagttcgccagctagggtttgagcaggggcgtcgacgagactctctctggcacggcggcagctgtctccggcgacgatcgccgccgccttacacagggtgtggggtgtgggcatcgcacagagccacgaagcgcgaaagcacgacccccacagtgcaccgtgccgttcttcccaagccgggcagcaacttttctgacgaagaacgcacgcccagttttgggctcacgaaccctcgtaggtcacgctctaatcccagctggtagagaatcttctacgtggcgtgggttggccaaatgccacgtgtgtgcactgtgaatgccctaacgaaaatagtaagtgtcgacgggtgatacccgtagaccggatatagaaggtattggggtacgtttggtacaaggatctacgtattacgacatcaagcaaacaaaagacaggaattattctgtagggcaccatggatttctttgagtcgcttgctttgggggctatgcgtttgggaggggttgggtat

SEQ ID NO: 3765 - DNA, 770 bp, Oryza sativa
  unsure (1)..(770): unsure at all n locations
agcgcattgaatgactatccgctggnacacnancncatcagacgccatccgttgactcctgcatccagcttcgccaccacagcttgagtctccgcttgcttgttgttcaacgacaccagcgactcctggatctcggccaaaacttttccgaagtcgttgttctgcttctccatggcctccacatgcagctgcaacctagaggtgtagcgtggtttctccaggatgagtgctctaataccaaattgtcacgaactcacttctctccgattcgatttactcaagtagcgaagaagtcagcggatagaagtttcgtgaggaagaagaagagcagagctagaggaagaagaaggagaaggaagcagaggagagtttgaaatattggggaatagtttgtacaatttctttcatgtcccttttctctcgaccctgccgatcttatatagcaatgagctattagatctcactctctgacccgtggcccggcaaacatcaccgggtccactcactatgagggaatttacttgtgggcctcctcgcctgagtggatcgcctgatttggatgtcttgagcttctggatcgcacggtgatgacgacgccgtgacatcggccccttgtgctcgcgctggtatgcgtggctcctaccatgagcacttttcttggctgctgtttcactcgcgtgtgaatcgaggaaagaccggagcagagtaccaactacttttatgtaagtatttgaaatttttatgagctactcccttcgtcccacaggata

SEQ ID NO: 3766 - DNA, 762 bp, Oryza sativa
  unsure (1)..(762): unsure at all n locations
cgcgagtgagatttaccactatcatataatcggtatcgtcaccaagtaaatgcaatgaattgatgtatatacaataatacatggtatctatcaattttactcactaattaagccacaactcacgcccgctgattcctatatattttatgactagtattatgccaggtccctctgattcctatccattttataagtagttaatttgctccaaatatatatatagtacagtagtatatacttgtgttttttttacctggggcacgtgtaatacaatctagagattatttggaacttgggattttttatagtaattagtttaagactcataaagtttatgtaaatatcaaacattaaaaagtatccactactgaaaaaacgatttttttttacgagagccccctatgggttgcaaacgtaccgtaactggcgacatctgcaaaaatcaaccttcattatcgcatacgactccttaagagacctcatgttcagtcttgcggggggtgcgcacgactctaccgcgcgcgtcgttcgctgcccccctctccacgcgcgccacctgttcagtcttgcggggaggtgctgacgactagttgtgatttagccattccaggttgcatcggcatccatagccgaaggttgaagacggcggtgggctatacgaactgggtctgtagctctactaggctgggctggatcgaagagagacagtttgaacagagggaggcatggtgngctnctacanggaagtcaatcaagccagtg

SEQ ID NO: 3767 - DNA, 1397 bp, Oryza sativa
  unsure (1)..(1397): unsure at all n locations
atagatcataaattaagttaatggtaaataatataatttagtaaactttattttcaaacatattagagctatttttagttatttatgattataatgtgatatatgacactataacatatgttttcatgtttttttttgtctgtgagatataacgcaattggtcaaatcgatatgaactgatttaattctaaagaatataattgtggtcgaataaaaaaaattgtatatataatttaaaaattacaatagtttatttattatttatatactacatttatctcaaataatgtatggaaaaaaggagttaaggagagggaacaggggctccacattatctgcaattagtgagtgtggctagttagttacctatggtggaacttacccacctaggtttaacatctagacttgacatgggtcttatatttatggctaattattttttagtaggcaacgtttctatcaatagcgaggcgtttatgatgacttcactaatttgaagatatatgattggctcagtctctcgaatatgttttctatagataagtgtacgcgtgtgtatataaactcatgtgtttgtaatatgtttctcctaaaaaggcggcatgcattacctttccaaaatgattatctaaaaaatcaattaacaaatttctggtggcaaagcacgcagcatcaagacgtcttgactaagtgctcaaaaataaactgacagcacccaaatacccgatgttaattagtgaatatattgtccaagaggcaagagctttgatatatcgctttgttgtagaagctagtagcaacagatcagaatacgaacaacatcaccgaggagtagtataaaattgtaggtaaaaaagcgaaattatatgcttaaaaaaatagagaagtggaaggctatgttaagagatcaaacaataaaaagatggaagttgctgcttgcatcactcacctgtttgatacgattaggattgtttcaaccttggttgttgctgctcgttcctaaaaaaatgtagatggatgtcgttaatattggtcgaaaaagtaagctagaggcgcattgctttcttttcctatggctttgcatctgaaaatttatttgttgatttttttttcgggagagaaagaactgattctctgcatttgtttactcctaattaattattttggtgggaccaaagcatgaaaccgtcatatattatggaggagagatgagaatttaatgtagtgagatttagcatccgtgaaaatttcatcaggccctggtaatcaaacagaaacatgaaaaattcagaaactaactattgagggcaatattcatgaatctgaacctaactctgtaaatagtttagagcagttagtgatattcacttttttaacgcanaggtgatattcactta

SEQ ID NO: 3768 - DNA, 11501 bp, Oryza sativa
  unsure (1)..(11501): unsure at all n locations
ntcgaataagccaacaagcaaacagccaatcagccaaaaaaagccaatgcaatgcacagtcaaatcgacacgacatcaagtatcggtaattttatcgatatcgataagaaaaaagataatcttaattatcgatcgtacaccattgtagcacatacagagtactataggagtatttacgcaaacctgcggctggcggctataaagtgacagcattgatgcatcacttttcaagacaggaagtacatgggcagtactatgaatcgatctgcttaaaataactactactccaggctagtaccactcataggagtacgataaaataaaacaagaagggttaatggactccagagtaggaaactggtcagccaaatcttacgtaggtacccagcatgtagtggagactggatgcatttcaaactaatggccttttttagatcacacctaaaattttacaccttgttatacatcgaaagtttaaacaccttacagacaataattaattgctacatcgaaagtttaaacacctaaagtattaaatataggctaaaaaataattaattgcacagattacgactactttacgagataaatcttttaagcctaattgctacatgatttgacaatgtggtgctacagtaaatatgtgctaatgatggattagttaggattaataaatttgtcttgcgatttacagacgaatacagtaattagttttttattagtacccaaacacccgatgcgaacaccccatgcgacaccctatataatacctgatgtgacacgccaaaactttacacccctgatctaaacacccccctaaaacaatatatacatggattgatcttttgtgaaagaactccaactagttcatttcaaactaattaaactataaaaagttgaaacgaaaaaaagagaaacaaatttgaaaaatgaagaagcaaagtgagttcttgttagaggacgaatttagcttattagctacacggaaaacgagaaaaacaattagtatatgattaatcattaattgtgtattaattattaaaaatttaaaaaatatatttattgatttttaaagcacttctcatatagaaagttttcacacgagacacactattaagcagtacgaaaaacatgctaatgggaagtagttaattaatctcaaataattaagcgcttagaataggccctaaggccgagttcatatatgtgcttttcactgcatggaaaacaaggtaaggattgaggtatatgattatttatttgctttttaaaagaaactttgattaaaaaatctcaaaaatttacactgtctactaattcggaaagtgtgctaacgacaaaagaggaaacttactgtttggagctgaaaagaatgcagcctgaggcgaagcttcttttagtccacagagtggactttctatctaattaaaggagggtttgttcttggaaatcagggatgcaatataagtatatgtggattataaccatgtctttaatctcatggaagttaggcagacttatttaaaaaaacaaattcgacatatatatttcgtgaacatcatgcatgcatgggttttaagattatgtatattgtatctcaacacacacctagctagttattaagtgaagtaatttaattagacctccaagaaatacaggatttttccaattttcgcgccgattggacagattcctacgaaagtactgcgaattcttcgacgaaacatcaaattatacatcgcgaaaaaaatattagttactaaaacagttaaaagaaaatttataagaaatgttcatacaaagaagcaacatcagaaatatacagatgaaacatcctgatgagaacggagggcaacattaaaaaaaatcataagattaaaaataaaaaaagtgaaaaatagtcaaatcgtatcctatatatttgaaatgtttctctctcatgcataaaacatagaaattcattggtcgaaagatatatatttctttcataaaataaaattatctgatatatttttaaaaagattttgattacaacaaatacaattaatatatttgtattaattgtaaataaggtatatatacttcataattaatacctctatctctctatatatatgtatgctccctaaggaacaaggatcacagaaaaatatgcaagttttgtgcagcgtgcaggtgcttttttgataatgaccatatagctcctagatatacggtggtgtcagtgccatatcgctttacatgaattttgtagcaacaatataattagctgatttccatagaatttctggacaaaaaaaagaaatccttttgcttccaaagcgctgtaagagatggctgcttgtgttcatgcctctgttaaaagaacggccaaaaaggaaaagggaaaggtgtatagctagattgcattttgttgtttgaattatgcctacctagcatgcattgttcagatatctatgcatgtccttgtttgccagaggccgaccagctagcccaactagcaaaaccgaaaagaaaatgttgggtcagtttctaccaggggataagaaaagcagcgagcatacaattttaaataaaagcagggagttaggattcaggaagcatcatgcaatagccggtagaggggaccaaattaaaagaaaacatatgaaaaaaacgagagtgaagaaagcatggtaaatgcaatagagcagagagagagagagagagagagagagagagagagcaacagcagtagcaaaactacggccaaccgtgcatgactgggttgtgttacattgcatggttcatactgcaaatggaagctaaccacaagcaagctgagccgcaaagcgagcaaggtagcagtcacaaaccctatgtccctagtccctacctaatcctagcttagcttgggaaccagaaaattagctagtgtagtagctgttgatcgatcaacaaacgtacgagtagtagtactaattaaaagaagtactacacagaccacaggtttcatggtagcgagatgcatggaagctaagaacacactcaaccatgggagataattaaaccatggttcatggaagtcggtcgatcagctcccgatcgagtcgatctcgaaggatctatctcacactctccatatgcaatttgcattgcagagaaatgcatgctcgctcactggccgctacagcctacagagaccgacagaaagcaatgacacacatatgcacgcaacgctagctgcaactgggaggggagtactctgcatgtgtctgtgtagcgcgcgcgcatgcagagacccggcggcggcagtggaaatatatatatatacataatcaattgggcagggagaggaggcttagcttagctgtgtgactggctataggattaggaggaggaggcagccgtgggtgggctacgtagtggccgcggtagtggccgtggtagcgacgctagtgtgtgcctctacctttatatatagctctctctctcccgcgcttcgctttgcatgcgcttttccacccagcagtccaacgattgaccttggcaccaccaccacccttgtctgatcgcgtgcgtgcgtacgtgcgtgcgccgacccatccacccatcgcgccgcgcgcgcgcgcgatcgaaacccaccatgcgcgcggcgatcgaacagctaaaagtccagacgccggcgcgcgcgcggggcccggcggggcggtgaatccaccgaggcgcgcgcgactaccgacggggcggacagggggatcggtcggccagccgaccggccaccgaggcgggagaggcgcgcgcatacgtacgtggagcatatggatgaatatccctgtatacatgcgtgcgtaggagtatgcgcgtgtggccaggttgagtacttgagttgcggctgtaactttccgtccgagtccctttgaaaaagtcaaacacctgctctctcatgctccttaacgctttagagtttcatattataagactttatgtatagatttattagtatctatataaatatagacaatgctagaaagtcttataatataaaacggatcggaagcactattatagacagtgacatgtgaagtaataaaaaggtgggacccacatatcagtaacggtaatggtactgatattatgatagaggattctcacccggtctaaacataccataccaaagctaaaaacatcaatttttttcatccaaacagttaagtctctaacgttgactaataatgaaccggagggagtatatttttacgaatggactaacttagagtggtggagcttggccttatattaggaatgaaaaagaatgagatttggagaaagagaccctcgctccaaatattttttaagaaaaaattataaacgtattagggattgaaccgcacatcccttaccattgccttataagtgcatgttcgacctacaactgatagggcttaagcgctatacttagcatcataatactatttaaattttacaaaatcatcacataatttcttaccaaagaataaaaaccccggttccttcggctataggcgtacgtggattttacctgactccaccctggctaaaaacttttattttcttgctggatcgactgaacgcataataatcctgataaattagaaaatggatccacaggtcaacacaagcatcgttccaattccaacaggcttacaatgttggcgcaaagactttggaacctatagtagttctgccgctatatatagttttttgaacgactcgcacgagacaatgcaaagttctattgatagagcaggaaaaaattataagattacaaccctggagagtcataaccaggagaaagaaaaaaatataccaccacccacacactggcagcgccaacacacacgaccaggagaaggttagctccggaccggctgccgctaagcgtgaccggccgccgctagaccaacaaaggaacacagacgagatcgccctacagcaagggggtgccaaaacgacgtcttcaagaagagaagcgacggaagaccgccgccgccgtccatcagggctcaaaggagccaagactgggctttcgcccggcaatcacccttgaggggtgagacagcacgacaacgccttcaggagggggaattcatcgttgtcggtccggccaaggccgagctaggttttcacccgccgctcaccacctgcgaatctacggctgatgcaccgatgctccaccaccactcaaactctgccgacatgtggccctgcaccgacgcccccgtcggccagccttcgtgcgccgaagaccgtgccacacccaccggcagctccaccacgcaccgaggtcgcctcttccaccaccagccgcgcctctcgcgccaagccggtctcctccaccggacgcgcctctcgcgccaatccggcctccctccatcggctgcgcctctcgcgccaagccggcctccatctccgccgcccgcgcctttcgcgccgagccggcctccgctgccatcggctacgccactctgtgtccagccggtctccgacccctcctccaaacaatgctgcgctagccgatgcaaccgtctgccacgccctcggcaagccgtccgaggccgccatgcctcctcccaccaccgtcacggtcaccacctcaccgtcgccgccgtcacctcacacccaactccttccccgcctccactgccgcatccttcgacgttgccaccgtctcctcagtcacggccgctgcaagtcggccgccgtcgctgatgccgctgttactagccacgacgccagcagtcgtcattgcaaaccgccggcaccgccaacgcaaccgccccaacgccgtcgccgagctctccgctgccgtcgcgaccaccaccgaggcaaaaccatctccagcgcctggatccggtcgccgatgccagcctcaccgctagatccggcctccgtcgccaacctcaccgccacctccatccccgccgccatctccaaccccgccgccgacgcccccagcaagagaagcagcatgccaccagcacgcacgccatccctgtcgccgtcgccgcctcccccgccaccgtcgtcgccttcctcggcgccagccaccaccaactgccgccgccaccccaccaccttccatccccgccgccaccaccaccaactgctgccaccacctcacaccgacccaccaccggcggccttcccgccagatccggccacggcggcccggatctaggcggtcttcaccgtcccgcgcgtggccccccaccacgatgggagaggaagacgaagacgagggtgaagcctcgccgccgccgtccttgcggccgcgcggctttgccggcgaccgctcgggcggcggcgaggcggcggagggaggaggggggaggagcgggcgacgccggcggtttccgcctcccgtttcgcctgtgggggaggacgacgcgggggcgcggtcttaatagccgctatatatagttgctggcgtggccaagagaatcgccccgccctgtctgacctaagcagaagtactaagtcttagcaccgtcttcattgtcaccgagcttttgcagcttgccgctaaataagctaatcttattttgctcaaatatcgatcttacaagcattaaatgatattgtacttatatatggtcatctaatttaggcttgctagaacgaggctggcaccaaccattttgaagatctcaggttagaacgagaacggtggtaaccttgggatgtcatttatagaagctttgactgaaagggcttcgacttccttgccattctggttaactggcacatgtaaaataaacattgaacggagttctgtcacaagtgccgccaacagtagtgggacggattctgcaagaaggacggcaataggtggaggctaatataccaatcctgtctaggctagccatgaagtagctttttcaatcctccccatcccacacccttcggtgtgttatagatgtatgctatttttttctaatatattaacatgtaaagtttttttatgttcgcggaaaaaaaatctcaagttgatagtaaggctatctataggtctgcattgaccctgccatgttatcatagctatttgtaattgcaccgtcagaataattgacactgatatacattacattctaaaatacattaattatatgtagagttgacctccggtttatctccagggataggtttcacaaatcagtttgttaaattagttttccaaaaggacgaaatgcgaagattacacaggtgagtgcgacctcctcgattgagacatgcatagttacaagcatatcatacacatgcacatgcggtttgggtgggaattgtgagtggcggtcggagattgcctcggggacggggctccttccaagattgagtgccgccgcctctcgcatagcatgcctatactctcccagtgctcttggccggttatctgatctgtccatgtcgatgtctcctgagacctgagtgcctacgtgtcatgcgctgctattccaacctggcattctggcagttcataacgaagataccaaaacattccatgcatccaatgcaagaacattccatacatccaatgcagtatgcatattactccctcgatcaacaaaagttatacatattgggttggtttggtttgtggcctaaataggccttaccaaattttgtcagtgccaaattttggcaagttttggcatgactaattttggtaaggcaaagttgtgtttggattgaagccaaaataacttaagttcactattgaaatggcctattttcttagatatgccaaaatttggcttcaaaccaaatagatactaaacactattaaaattgtcaaatattggtaagtctaatttaggtctcaaaccaaaccagcacattacttttaacaccaagaccaagaagaaattaaatcaccttgaatgttacaaaatcaagtagtaaatgcaagcatgtaaccaatgagtatttagatgagtccttgaggttctaataaaacatttaatttatctcttcatttaagttttaaattcataaagattacaaataggaccaacttatttgaaaaaatttaaatgtgaaataggtgtaacttttatcaatgaagggagtacaaagtactgtacatgtactagctaagctactgtaattgtctgcttcggtatctatcttgtcgatcgtagtgtcattgctagtggctcgtatagatcgtgggtttgcactacttcatgcaaaaaccggtttgttacgtacgctgacgtcagatgatgtccgggcccggcagcaaattatgctccaataatcaccggatggagttcatcaaatcattaatcaattcgagcggcttcttcgactgcaaatctatgttgattacaaccacacaaaggcaaatactatatctaattaattgacagaccacagatgaattgccggcagcaggggacgactcatggccatgacgagcggtttgttggtgatgaattgatgattcgcaataatttacttgtacaccacaaacataaactgcgaattgtcacctcagtggtgcattagctctgctacccaattcagtgctccgtaatgatacgagtatctggtctctgatacactactgttcctctacttgggcgcacaactctgaaccatgcatctccagagctcagccgctagctcaccgatcagatcgatcgatcatttcctgatcccacttaaacctggcttagtttcctaaattttttttctcaaaaacatcacatcgaatctttgaacacatgtatggaacattaaatatagaaaaaaacaaaaactaattgcacagttagtggggaaatcgtgagacgaatcttttgagcctaattagtccatgattagctataagtattacagtaacccacatgtgctaataacagattaattaggctcaaaagattcgtctagcggttttcaggcgagctatgaaattagtttttttattcgtgtccaaaaaccctttcaacatctagtcaaacatatgatgtgacactcataaattttcttttcgccaactaaacaagcccttaattcagcgcaagctatagcttcaactgtggtcgctcgtgcacaaccgtatatactaccgccctacctagtaagctactaccatttccagccagaaccaaacctaattatggaaccaatcatggatgtaaaatgcaacttattcttcatgctcacctctagttttttttttttttgcctgcccaactgttactggctatgactcatcagagacgattggtatagcttcaattctctctctcccttctcgctctctcccgctttaatttgcgcccacaagaacactatccacggctttattttaccttttttgctgcaaaagaacatgtttgagcaggtatttcttagttggttaggtgatgcttgtttcttggcccatctccacaaacagggaaaaatataatggcgtacgtacaaatcagatgcgtctctctgaagcacttgatggtagtaaaaaacaaggtttatgtttggagaaacagttagtttactgttgatgacaccttttaagtcgtcttgagtcgtcaaattctgccttgtggatggcattattaggacagaaagttatttggcgtgcgtccgtatagcccagagggggccctgaaagtttttctttaactttgtgttcttgttttctgccgcttaattatttaaatggcacctagctttgtaatagtacgttgtacgaaacttttgattcaactttgaggcaatgaggccatctagctacccattattgcaacttgccataatctgagatcgagcgtaatgttgctgccttcagcaaattgctaggcattgcggcctcatgcgcctcccactccttaaatgacaattaaatagttgttgaaattttagagtttgattttagatttaattttaggattttttttatagctttcgttgcatagctctctttttattatcgctaagaagacaaagaagtagtctaccttaaattgtttttaaacatcaaacttcataacctctgcagctagcataactaagcatatatattaccaaactcacaaattgccaatctaaaattcaacaagatctctatggaaaaacatgatattgtgtacgacatgtgtttgtcactgtcacaccagccacgcatgcaagcatgtgacaaacagtactgcttgatccatggagcaaacataattaagcaaaccattctacatatatttcattagttctcgcacaaatcatatattactattacatttttcgtctttctatatacactagtaattaatcctttagttccatgctactagctttttaatcttccttttaaatttatctgcactagtttaattactttctctctcttcttttttttaattcttttttcctctaattaaacaagtcgctgcatgcagggatgaccggagatgatctctatctcaggcatgctcatcacatcatcagtaacactggaggtcctttttctcggtgtagttggggaagccggagctgaggcacgacaccggcggcacggtgggcgtggcggcgttgccgtagacgttccagcagaagggctcgtcgacggtgtcgccggacgccggcagcagctcgacgtcggagagcgtgatgttggtgcacggcacggcgtcgctgcagccgaagtggatgggcgggccgcgcacgtcgtaggtgccccggatgccggagtaggagacgccgttgacgaacacggcggtggtctcgttctcgcagctcttggagaggcagtagtactggtcgatgatgatggggttgcgcaccgcgtccatcctcacgttctcgaacgccaccgccgacacggagccggacccgccctgccacgtcttgatgcgcacgccgttgtccgagtgccggatcaccgcgttccgcaccgtcacgttcgccacgcacgccttggtcccggccttccccaggctgccgatgctgatgccgtgcccgggcccgcaggtgacgttctcgatgtggacgttgagcgtgccggcgccgatggagacgcagtcgtcgccgttggagacgacggtgttggtgatgaggacgtccgaggtgttctcgacgtggatgccgtcggtgttggggctcagcgccggcgagctgatggacaggccgtcgacgcgcacgccgttgcagttgtcgaaccggaagtggaactccgggctgttctgcaccttgagccctcgcaccgtcacgttgttgctgatggcgaaccgcatcgcctgcaaagattagcatcgtacttagcactgattacactgtcactaatcagaggcagttaatacggttaaaaggtcgttgcgttaggccactcaccactgggctgtcacatggtccatgagtgtttcccccctaaagaaaaaaagaaggaaaaaaaatggaaagctattagattcagatagatatgtgctccaatattgcaaaagtagagattagtngcttctacgagngttctcattngcccg

SEQ ID NO: 3769 - DNA, 17308 bp, Oryza sativa
  unsure (1)..(17308): unsure at all n locations
gtggccttganatcgattgccnnctctgcagnagcncatcannnnnnnnnnnnnnnnnnnnnnnnnnnnnnnnnnnnnnnnnnnnnnnnnnnnnnnnnnnnnnnnnnnnnnnnnnnnnnnctttccggggaaaacatacaacgaacacgaacacggagacttgttcttcttcttgcgtgatccgaagaggagaaagaaagaaagaaacaaacaaagcggctgagataaaagagggaggcccctatttacgcgcgttggcgcgtgtggggggccacgcgcacccaaaccccacccgcggtagccggtgggtggcgggcggaggtgaccggcaggtggccgcgaccggcttggctaagtggcgacgcgcggggggtgtaccggtgttaccggcacgtgcgcgttcgcgcgacggtgtggccgtgtgtggggtttggtttgccgaccttgtgtggtgttgtgttgggtgtgtttcgtttggctaaggcttacgagatgggtgatgcgtgcactggtttcacgcctttcgcgtgtggagaccggagaccgtccgtttttaggggttttattttgcttttttttaatgaagaaactcgattaggaatgccgtttatttccgttatgtggtgtaggaatttttagcgtacggttatactcgtcgttattagtagttgaggaatgtaaaggatttacactggcagttattaacataacggctatattttttttaaaaaaatgatgtatgttaatttcgaaatacaagtaggggtgggtattcggtttgactgaaaatttcggtctcgatatctttgaaaagtgaagaccgaatttcaacacaaaaatattaggatcgacaaattcggtctcggtcctgactaaaattccacaatatttttttatatgcaaagaaataatgaaaattttcaacataaaaaaaagtaagcacgtatgagtaaagactcttattaggttgcatgcctagaagaagtaggattgtggaaattagagtttaatcatattgaacttagtggattataggttacatttagatttttttttgttaattcgatctattcaattaagcgatgagactaaccgaattgatcgaataaaattcggtcttttactgtttaggaccgaatttcttggtctcagtcatttcggttcggtttttttatgcccacccctaaatactagcataaacacatgagtatttaggctgtgtttgctgggggaggttgggaacaaatcttcttcgcacggaaaacggagcggtccattaacgcgtgattaattagaaattagctaatttttttttcaaaaatgaatcaatatgatttttttaagcaatttttgtatagaaactttttgcaaaaaacacaccgtttagcagtttgaaaagcgtgtacgcggaaaacgatggagaggtgttgggaaccctgggtccgaacacagccttagccttttcttgttgctatatacaattgagctcatgctttcatagtttcattcgtgaccgattgcctctcgtgattattatttttttttgcggggagcctctcgtgattattaacgaaaatactcagaaaataactaggcatattgactagaagaaaaacggcggagagaaaattgtgcccctatccccctaacatcaatttgccaagtctgctaatagctatagttggtagagggtacagatccaatattcacccgtaagtttgatatgcacttctactttaagtgaactatggtcagtaattctttatatacaaccggacacccacggaagcattttttcaaatggccatcaatcaaacaatcaaaaggatcaaggcgtagctagcgtgcgtaacttttcaacggtgttgggattaattaagagccgatgcgaaaagtcagaggggccctttccccctcggggcagggcagctctccatccatccgtcatccgtgaagtgggcgcaggaggacggcgccctacagtgcgtgcgtaccttgcacgccaccctgcctcatctttcggtttccccccctacgcgccggcgtcgtcgtcgagtcaaccggtgcgattctccgttttctcccgcgccttcccgtactagtaaccccgtacgtggggcgcccaacgaaagcaaaaaccaccagcttccgcttcccgcgacccccgagtcaaagcagagcagtgtggccactgcccagccacgccacgccacgcgccgccggaaccacaccgtcctcctcttcttcggtctcctcttcccggtgttccccgtgccgtgctacactgcatcatctgcatgggcggcgccacggagacccacgccgcccacccgcccacccgccgtttctctcccgccgccacacgggaaaagcatcgtccgcgcgcgccagtgtacgtgcgtgtgcgtgtgcgtgtgcgtgtgcgtgcccgcctgcctgcccggccgcgtttcaccgggaaaaaaaagaaaagaaggcgttgcagaaggttggttgattcgattttggctcgcgcgcgtgtattacgcttcgtgtcgcggaaccgcgcgatgagccgaagcagatagcgtagcgtccgaacaagtgtaccaccgcaactcgcgcgcttcggcgaggcgccgagaggagcgtgcgtactccgcgtgtacaacagctttgctcgtcgggcgccgcacgacacgtgtgccacacgctgctctctcggtggaggcagagcgagttcgcactcggcagcatcgtgtattcgtgtcgcaccgtggtgacatgactgccatcgctacagcctacagcgcgggtaggcgcaggcagagcccctgacaccggcacgcggatcggtctgtatgcgtatacccggccaacggagtcgggtaaaccagagctttgcacatagtttatcaccaagatgttagcacactgcacacccaaaagatcaagagaaaattccctatatacccctgaaaatttactcaatcccttcaatacccctgaatttgacattatcccttatatacccctgagttttcattttgatctcctctatacccatatccgttagttgatcattagttgaccgttaaatattttaaaatgactatattacccatattatacatatgtgtggtacctacccaataaattttcatatgaaaaataaacttatacaaaatacaagcaatataatcatttaatgcccaacttaaaaaataaaacttattattttttatttttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaggtaattttcaaatcttatgcataacttttttttacaataaatctttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaagggcgtagaagggattaggtgaaattacatgggcatatagggaattggcccaaagatcaaacagttggtgctagtacctaacaatcacacacattattggactagatttagttagcgcgccgcggcgaactaatccatggagagtcatcgtctcattgaccatatagtgaactaatccacctgcacacctgcaagttgaatttgggtacgccctgctgacgtaactccgtttctttttcttttccttcatcctctgctgtatcttgtactcttcctgtttgctttcttttcctgaaatctctttcagactgcaggggacacttgttgtcaagctagaaagataataatagcgaaaaggtattggcatccgaattagggtatcaactgagcagcaaaatatcaaacacatgaatacacacggtccagatctcctagagttagctataacttcagatcctctagagttagctataacttcaccaggtggatttgaccaaattcataccatcaattgtttcctatggctaacttatattaattaactccctcaatcacatatgcttgaatgaaaattacttaccttttcttctttttatgttcctaatgagtatgtttctgccaagtgccaacaacattaacaaagtttgcacgctctcttcttctccaaacaagaagctatggtcatgtataaaactatgttaaacatttagtactccctccgtttgataatgtaagtcattctagaatttcacacatttatattgatgttaaatgaatctacatcaatatgaatgtgaaaaatactaggatgacttacattctgaaacggaggaagtacgtgtaaacatgcacaaaccatatccacacaaaaatattgctaaaacattagagccacaagcccaatatgatttttatatcgtggatgaaccataaaatttataggttatgcaagtaaaatcagtttgtatattcttcagatatatagtattcgttgatttgttacaaatattaggatgaagaagaaaaactagtgggaattagttagtttatctcaaccgttgttataaagagacgactgagatttgatcaaatccatcgggtggggttggagtgaactccaggggatccccgacccgaatacacacaggcacacagctaccacttaagggcggcattattggggcatgaccccgtcaatcaaatgcttcctagcttttttggaatagtaacgatacctgcttttctgctgggaaaatatctcctgaaaagaacttcatcgacatctctagtttcatttctacaatttctttaaggaatctttttatttttttaaaaaaactctccgagctcttgagaaagattctgtccaaatagaatcagatattgtgattgatctttcggtggttgtttatcaggcaattgctcacagggtgcaacttggatgcaaatctctgtcgaatagtatatgctgaaggcacaacaacgacctctccgggctagttttatccctttcttattttctttataaaaaatttccttttttgtttttacatatttcaagataaggttacaatctttgaagatgctatatccaaaactgtatcagatattcagatattatgattgatttctccataactgttgggtggtatatccaactcattaagctttgacgtacactgtttagcggcatgggtatgtgtgtgctcgcgctctttgatggcacatcacaaacagctgctttggatgcaaataaaggagaagcaactctgcccaaaggagatgcaacactgcacacattatcactttggtctaatttcttatcgggcactgatcctaaaaacaaaaagatactatcttcaatagtgcctcgagcttctgaaaactgaaatggctagggaaagcaagcactgtcgtactttcctaatcactggtttccatgcctatccaatgatcaaggactggataaggatgactcaaaagaaaacaaattttgggattctgtttaaagtatagaaagcattttgcattttcaggcattaagcactaatatcagttgcacaagcccaaagccccgaaaccaacatcaaagtttcagacaaattgtactgctcacacaggccccatggtttcaactaaactgcgactaaaaattgcgagctattctattcactcgaaacaagccgcgcctcagtaatcactaaaactgaaactgataaaccacatggcacatggaaacactagcttcaatgggcaaatgcatcaagttcttagcttcacaacagttggatgagtggcattgcctttgctttttcaacggaagaggagggatcctacacgcaaaaatattaaaagagcaatgcaagcattcaactgaaatcaaacaggaagtgtcttctctccagtgaacgccacttgtttaggagagtgtatttgctaatattatcaatgtaaaggatagcagtccaaacaatacaaatgccagaagtaacttttgtgtgtctggtactgatacctcaaagagtgagtcaactaaataaaagtgaatggaatataccaaaatatacaaactatcaatgtagtatagcatacttcctaaacacaatccaatttctatatcaacaggatctttgtattgctcctgcaattttcactaaactactaatgaacagaaccctgtatcatcgatgcgagtgatgggtggactcgagcagttttcattgaccgtgcaacacatcttccatctgaatattcctcaccaagaggccaccttggacgcaggtcatactgtaccagttaagacaattatcaggcatgataacagccagtcagtcttataaaacatagaacttacactgtattaacgtcaggagtagagtaaaattaccaagtataagattccttccataacataaatacacagcaggtcgatctgaagtgtgttctaatttaatgtaagaaaattagacggcatggttctaagttctgacgatgtgcgaattccatcttctatgatattaattataggaaacatttggataaaaaataactcctaaattgatcttcgtgacctgccaccatcacatggctactgatatcataaatactgactagctctgctcacaggccaagccgatttgatcaatccccctgggtgtcaaattgaaggagacatgaggaggaacataaaggcagctatagggatggggaagatggtgaaaatgtggtttgactgtttgactggcttggattcgattttgacataacacaagctcacctgttcgatgaccatatggcaaagcttataatatggtagaccacaagatgaaaatgccaacaaaaccaaatttggcaggtaatttgctacttttgagatttgagtattgagatttgggagtcgagggtgaaaaaaaaaaaagactctggatgacttgaggtaaacggaattaccgaccttcaactatagtgccaaatgcagttacttgggactacaaggacatatatgccaaatctacccaaattaagatcaagaacacgatataatctatccaagcctcacatttcaatgttcattgaaatgccatcggtttagctttatactcttcctccttgtcagtagccacaccaattgccttttaataagaccttttttttattgtagcagcaaagagttgatcgtgtatcaatgcatttttaaactaccaagtcataagaagcaaaaaagttttctgtgcttgatggtgaactttgttttgttcaactctatcaactgagcatatttatttgtcacgttacctgcaaatcatcaggctcatcaacagcaggaggatcatcaaatctgcctgcaatgaaatgctcaataccagtccaagcaatcatgacacctgcaaaagcatatgccagaattatgtgcaaattgcttaagaataattaggaggaatctgtactctgtacggaagaagcagtcaaaaataagttcaaatgctcgagttcaacaagtcaaaaggacagaaaataaacagtataacaacaacatagggccaagacacaaaattaaataaataatgtagagtgacataaaaaatgaagatatgcaatgagtggcatggaaaatagcattaaatcctaaatacttttgttaataatatgattgaatattttgggcatgcaaataaactttttaccattgtcagtgcaaagccttggtggagggcatacgagctgtaggccattcttctcagcaatctgattcaaatgagttctgacatactggtttgatgcaacgcctcctgaaacaacctttaataactgagtcaataacacactggatgaactaatgtaaaatgtaaatattttaaaattaattaacatcaagatatctgaattacaaagtatttaatagaaggctccatcttcaaggcccattcaactgctcgttggcatctttcttccaaatgtaaaacagcaactcactgcagaggtcaacatcagaaaactaccaaaatcttaatgaataatgaaaatgcatcccctataatgtaaaaacctgaaaagaggcagcaatgttcgcccttatttgtctgtcatcttttgtagcagatgaaataggaatatcatctgttgatctaccatagcacaaaaacaacagaagagttacgagaccaaatgttacaatcaatgagattgcatgtctgtttcatgtaataatgaaaaatgttccttctccaataaagaaacagaaacattctatacctattctaacaatcagttttctagcaacttgcaacctcttgttagttgttaacattattgttcccactttgttgttcttgttatttgatctagagcatttccagcacaggttattgtatataatgcctatgtaggtgttctttaattaataaaaagaacaatgaccttgcatggttgagacagacttactaaacttgtaggaacggctgcaatagtttcatgttaatttcctagtgattgatataaaaacatttcagtaaaattaaaaaaacaagtattgtagattattgagagttaaagtcaagtctctgcttgttaatctagaatactgtagtcaaggagagcaaacagcatgccaaatacactatttatttgacacaccagcaggcatattaatcgtacgatgaagacaatggcacaaggactaaaacagccatacatgtttctggattcaatagccaatcgaacttgagtcttcagaccagcataagagaaattgcaatctttgtgttgtcgcatcgaaacctggaagttcacaaaaggagaaggaaagcaaacatcatgttgacctaccagtcacgataggtggataacacaacatatctacccagtggacattacaaatttacaatagaaaaaagtggaagtgcaaaagttcacaacagaaactagtcgtgctctagaactaattccacaaaataaagagaaaaacgtaaaatccctaacaaatgaacagtaacaacattccatcgtttgagctaaagaaatctactattgttgggcggtgaactggtaaaggaacttatgcttcatcagttgagaatgtcatcttcataactcagaaataaaaaccaagccgatacctggaaactaatgcctgtgcctccatatgatgaactccaacaataggcaggtgaaatgattttgctatttttcgagctttgtgaacaccaactgcaatttatatggttcgttaaatagcctttaaagaaatgtaagagagactcagcaaggttaaaaagtaaattcaataaagttcactctgactgtgtaaatagtagtatatgcaatgtatcatttcaacagtcgattattttacaggttgacattgcgagtgactgcacaagataaagaactactaacaagtaacaccatctaaagggcaaacaagttagtgatgaaaaatgcactgcacctaaaataagcgaactaatagagagaacacggggttttggttgtggggaatgattgaaagatgcaaacaagattctgtaacaaactgaaaattcagaaccatgccagcatttaagacataacagtaaataccagataatcctattgatcaggagtaaacatacaaaagcatcaaatacctctgaggcataaactaagtcctggtcctacggtgacagccactgcagaaagatcactttctgacacatttgcattatcaagtgctttctggacaacctgcaaggaaagtacaaaaagttagcaactctttaacataaatgtaaaaaacagcaagatccgcacaacttctgaacagaaactctgaaactgaaagccaaacccgatcaatcgcaagcaaatgagcttcctcagccatcttcggtgcgacgcctccccacctcacgagtaaatcttccttccaaatgttgtaagcacaaagcaatactatcagcagcgcacagaatataacatgacaaatatacagaaatgaagtgtgctggacagggaggtggggggcatagtgtctcacttgggaagataccacctggcttaggatctcgccatcgcctctaacctgcaaccaacaaaggcaacagagagccaaggcactaagaacaaatcctagacatggctccaccacagctacaagcggtctgccatgggggaaagggaggggggggggggggatgagccgcgcgtaccacggcggcggcggtgtcgtcgcagctggtctcgatgccgagcatgaggaggttgccgtgatcgggggtggcccgtgaaccggcggcggagggcattgtggagagggagcggaaggtaggagaccgtaccggcggggagggggcgggggctaggaggcgtcggaggaggagaccggcggcgataaggtggggaaaagagtggccgccattccaccgtggctcggctttgcactctctcagcttcggccttggattgcatttgaaacggaagtatcggatattcagatttgaccacgagagttttcgcacaggccacaagcccgcaagttagattgggccttcggactgacaagtcttagcattaaacgggcctagtttgggctgacatttgtctgacatgaccgaatttacacaactttttacgcaattacacccatatatactttgcatttattcctaattgccataaaaattttagaaaaaaagttcattttagtactccccgaactaattcaatggatcacttaaccctgaactattttttgggctcattttaccccttaaactattaaaaatgattcagtttactccttaataacagctctattttttttgttactcttttataaaagttatattttaagctaaaatttattagagccatagatgacacctttatcaaagttcaaaaatattttgaaattttttcatggctgtttgcttgaactttaaaatgttgatgtttaaatcagttttaactgcttccaacgtacataaacagtgagaaaaaaatataaaaaaagttgaggcgtaagttgtgaatgcaactatattttctaccaaattttcagtgcgatgacttctatagataaaaacaaaaaagagagatagcgttagaggagtgaagtgaaccgctttcaatatcttgagggtgtaaaatgaacccaacaatagtttagagggttaagtgctccggtgaaatagttccgagaagtaaaatgatttttttttcaaaatttatgaaacaattctacaacgttgttaaacataggttacatcattaaacattattttgtaaacttgcatattaaatgagatatacaatatcaaagtaaaacaaatattcaactataaacaacaccacaattatggggaaagaaagatgatagcaattcttgtaaaacaacacacctattagctcccttccttcccacatcaacaaaggcataagatgtagaatacctgtgtagttccctttatcctcgggaacattccacaagtagaaaatgaatacaaaggtcaaggttcaaagaaggcagaactccatgatgtcagcatgcagataatcaagatcaaccgccctagaaaacttggagaacaaatgaattgcggatggcatcgtcggacgagttgatggattggggtgaaggcactgtatagcaaccgtgatcaatccaaatatctcgcttgcaacttcacctgctggaggcgggagtctggtgtccaacaaatccttcatcggtgtgcttttcttgctagggcatgagatcgacgaaacaaagtctccagggtgagatcccatcaacagctcaagaactaccaccccgaagctataaacgtcacatttctctgtcaccttcgtagtgtatgccagctctgaagtatcaggagttcagtcagattaaaatgtactaaatattaatttatgttaatattgtggtaacttcttcatgcatattaagtatagcgtagagcatattttttagtaatataatgcagcttcatgcaacaagaaaaatacataagataagaaaaataataatcaaaacagtaggttcaacataataaattttgtttacctggtgcaagatatccttttgtaccagcgagccttgtgtgtcctgatccatcagcatccagtattttagctatcccaaagtctgataaacaagctctgaactccagatctagcagaatgtttttggttgttacatctcgatggactataggatctgaacagtcgtgatgcaagtaagatagggcatgagcaacatcctgagcaatacataacctgcgcttccaatccaactcgcttgcacttctgtaggacttgagagctgtcaacaagtttcctcctttcatatacttgtagacaataaacttatctcgtgctgtacagcagtagccaaagacttttacaatgttcttgtggcgtatttgcattgtggcctctatttcacgatagaacatttgctcgtttatcaaacggccattctctgttgcatttatcttcttgactgcaaaatttttaccatttgataatttagctacatagacagacacataaccacctgctccaatgcaatatttttcactaaagttctccgtcgcttcaataatttgctcgtatgcatttccaccatcaaagtttaagacagagaacatgttttcctgctgcaaatctcctgcgtcgtgtatcttgtacttctttcttctgcatattctgcacaggcttataactagaactgcaagaacaacaaacagagtaagataaatttcagaaaactataagttctaatgcaaaaggcaatcagtgaaccacacattcataagaaacagtttcacaaacccacagttttagttgttaagaaaaccacacatttgcacaacaaattatgagggaacacatatgcaacatgatgaagatatgaagtatatcatataccaaagtatatcatatatgaagtcatccacacctgcagcagccaagacaaagagtaacacaatgagccatggcaaatacatgttggggattgtgagactgaatcgagaagacacggaaacttgaaggatgagttttgtggtaggttgcgaggaggagagccaaagagaatgagatatatgcatgtaagggacttctgaccaaagaacgaacagcgacacagtcactggatgctttggtatttgattcctgtaacgtgtgagcagtttctggatcttgtatgcgtagctagcaccctaatactagtcctgggtttagcatgtataactatcaattaactagactaaagtacaacaagatgggttaaacaattatagagtatgtagttggttttcctactggaaattgtatggtgatatttggttgatgagcaagctggcaatctagtgtcaactgtcaacgtgccgtgaaactatgatagttatatttggactcttgactttgagcgtgtttggttaaaagcctctgaccgaggaattaaaaatgagctaaacaaacagaagaagtccctccaaagttcattaaaaaattgaggaaaccttcctaagtccatgtgcacaaaatatgcaataaacttattattatcgcccgggtttctgcttagttcctctgaccgaggaattaaaattgagctaaacaaactgaagaagtccctccaaagttcattaaaaaaattgaggaaaccttcctaagtccatgtgcagaaaatatgcaataaacttattactatcgcccgggtttctgcttagttccgtatgcttcaatctaagctaggatacggatcatgtgttggttgccttgaggaactaacaaagaatcggtcatctcacttgcagcacattactcaaaggtcaacaacgctacaaacacactaaacgtatgcataccatttcttcatcatttggtgtgtgcgggatggcggttctcattttctcaagtgatagaatccaatacccaaaaacattgctaagaactccaaagtaaatgattagagatctaggaagcagagaattcctgtaaagaaaacggaaaaaaagtaaattgtacatgtacacgagaaactagaagctggctccatggaagcatttcatcgagcaacttgcatgcagcgagttgagctcttctcacctgcttgccgcggcgtggttgccgccgggaaaaagcggagatctgcgtgggtttggagaaatatgcgacgcgctgcagctgctgcgcacgggcggcaacgggaggagcgaggaggcaccggacgcggcagcgccgccgcctccgcagcctcgatgacttcattttccctggcggcgccgcaccgacgacgacgagaggaaggggtcaagggaaaagcggcggagtgagtgagtgacagtgtagccatcttgttgggccacgtcgcaggccgtttcggggccatcagcaatgcagaagcccaatacaggcccagttcggcccagcccggcctgcgcatgagcggcggcggctacagagattggaatccccttcccgattggaatcgggcggagagacgggagagagaggagaggagtcgaactagggttagtgaggtgaaggggggcgattttgctcatcgccctccgcctagatcgaatccgaatcccgcctcctcctcctcctcctcctccccccgcgccgatcttgccccgctccctcgccgcagctgcgggcttgccctagcccgccgcatcgccgacgtactacgcccgctcggctccaggctccagatccggcctccagggcgtgcccgctgctggacggcgctctcccgcgtccgtggctacctcctcctccgggtttgcgttgccgtcgccgaagcgatccgttggtatctctctctctctctctatctatctctgcttggttagttatttgttttgcaaaagcgattcgtttggaatctccatctgcttggttagttattgttcggaatggtgtctttgtcggtaattggtaccttaaaaaagagagtggtgtggttgctttggattggaaaaaccaaggagagttctttacactataaggtgagaggcgaattaccgagcagggataattcggattgtgctgctttgaattggaatgccgaagaggctctatgtgctataacagtacggctcaaatttctgagcagggagaattcagctatttaggttctgtgtcatgtacttttgcttgttagtgtgtgggggcggaacctcacacatttctttgtagtgtataaacctaagaacttagaaagttcgagctttggtgaagtccttcatgttaatacatgtcgaatgtgaggatgggggcgtctggggggtactatgctcaaatctgaaaaatgtgttatatacactatcgcatgagaccaatgaaccacacagatagtagacatctgtacaaaagggtacactttcattacagaagatcatgtgtacaacatgtctacataaaactagcctcaaaagatcctccaaagtgagggtctcaagcaaaattggccccatctccttttaaggactaaatatgatgcattgcctaaaagcccccaatttggatgtaaggtttattgacgattaaaagtatgagttctaataagtagctgttagttaagttatgcttttaattttgaccaaagtttgatgatctggattcggatgaaaagtctccagctttagtatatttctttgcagtacttctgtatacccaactgtcaagatattcatttctcaaaacttgggaagatatagtgtttcatagggtcatcgatatacgaattgagcgcaacaaagctaatatgagcttgttttatttcttatcaaattgtttggtgtaaccaagtgctcagcagtttggcatcatgggtacctgaagatccaactatgttttggcccttctaattcataggagttaggactaaccattaacatttttttatttagtagatttgcagggatatatgtttctaatgtgcaattttctactagtacctaggttatgtgtcctgctaaaatgattgttgttgcaggtggattgtgtgtagctctgtaacaaaggatcttggtccataggagtgaaccagaaggtacaaaacttcttggctattatgacatcggtgggtctagtagattcttcatcaggtttcccggaaacgagtactagtggagccactgatcgtctgacagatgatatcagcgagatgagcataagagataaggtaattttattctggaaatcaatcacaatattactcaattcttatgatgataccatcctctttgactcttattgacatatgtaccaggaagttgaagctgtagtggtcagtggcaatagtatggacataggtcacactattgtgacaactgttggtggaagaaatgggcagccaaagcaggtactgacatagcattggtctatggtgatcactactatgtttgtactgtagtacttcatgttgcaatagatagaatttatgtggcaaacactaccacattattaaaaaattgccgttatgtgccattatttgtctatttctaaaaacttatagtactggatttttattggattgcagacaattagttacatcgcagagcgtgctgttgggcgtggttcatttggagttgtcttccaggtgggccattggtatatgccattctgtcattacctttctgtttagagattactaattaaattatctttgacaggctaagtgtctagaaactggtgagagagttgctgtaaagaaagttcttcaagatgcgagatacaagaaccgggagctgcaaacgatgcaagttctcgatcacccaaatgttgcatgcttgaagcattacttttgctcgactactgcgaaggaggagctatacctgttaaaggtgataaacacctccgacaggtttcaactcaccacccgtcacaggtgtggaaaagcaaccaaaaaaaaatcaaaagccctcagcctctagctctcagctctcaggcctcagcagcccacaagccatatctcatgacatgaagaacatctcaaaatctctcttgacacaataactattgatgngctnatgtgccagctgaatttcaattcaaggccgcat

SEQ ID NO: 3770 - DNA, 7021 bp, Oryza sativa
  unsure (1)..(7021): unsure at all n locations
agagtttgatgactggctgtaggaacgnacaagcatttagttaccaaatggcacgagacctagtcaacgtgtcacgtggatgtcacgtaggacaaaaccaccggtcaaaccgctgagggactcaatttgcaccggtttttgaagatgggggaagtgttatacccggtattgcagttgagggagacgattcaatcaagagcaagaatagagggatgtaaaatagacttattccacgtcaaaaggatcacacgggcctaaatggaagcccacaatcttaaaatattatgggcctaaactttagactaaaatccaggtccttccatatatgggccaaaaccatccggcccatcaagcgacagtagcaagcagctcgctcaatcgcttcttgcaagacaagctacctcttctgcccccggatctccgcggcttccagaagcaaatcgaatcaaaccaactttgtttcccagcatttaaagcatcgtcttcctcgtcgagtcgtcgtctccccgccgtctcgtgcccccattcgccgcagaaatccctagcctccacgatccgaagaatccctaaccactccacgatcgatcccctcccttctcccatcaatggctgatcagcttcggcggcgatgggcggcggcggacgacggtgtcctgtacgaggtcgcccgccgcatcccgtgcgagatcgatcgccgccacatgggtcgcgtatgcaactcctggcgcgtggcgctcgtgaagctcaaggccccggcgccgccgcctccgctcccgtggctcgcccttcctgagtccgacgatgggctgcccgccaccgtcttctgcgtcctcagcggctgccgcacccacgccttctccgtccttcaaggagcacgcggcgcgcgctacttcggttcgtacgatggcggatggctcttcctcgccgtcggcggccaagctcaatgccaagccctcctcaacctcaagatcaacggctttcagaccctcgacctccccaacctggcgcccgtcaactcagtgaatccgaaccgtgaccgtgagatggccatcgtcgccgccaccctctcgtgccagccaactgaacaaggatgcatcggcgccggcatcatcgaatcattttccaacctcgtcgccgttggccatgtcacccggagcattgcgttctggcggatgggcgatcaggtggtcttacctgttttgtgggcactggaggaggacaacccattgatgcggctggaagaagtggaggaccttctatgccaccatggagccttccatttcctcacccgagcggaagacgtccttgcgtgcgaagaaccaccggtcttctacagagattccgtgagtctggtcccggcaaacatgttcttcctgccgcgcgtccacgacgagaacgagactgttcttgctcgctacctcgtggggtccggcaagaagctgctcatggtggtcaggctagctagtggccggggtcagcgcacgacgtcggcgttccgggtgttccagaagaaaaagttcaacaccggcgaagaagacgagccgtcccagaatcgctctgctcattttgagtactactggagcgagctggacgagctcgatggccggatgctgttcgtcggactaggctgctccagatcctacaaggcgggtgatggcaggtaccccgacatggaggagggcgtctacttcttggatgatccgagcatccaccagatgatcatcggtgatgcacccaaaccgccgtacctctgcagtgacaacggtaaatggtcgagagcaccaactgatccccagggccaggtcgagcgctgcttcccggagcgaggcccatcgatccactcgcctccggtttggattctcccttgagttgagatcgacgacaggtttggttttcgatcggcaaacgttgcgcgatatatcaacaaggtcaagttaattagttccatgccttgatctagctacattgtgtcgtttgcttcttgttgctgatgagttcaatggtgttgtcatgttgaaactgttgctgattagtactagctagcgtttgtttgtggtgtaaccatgtaagcagtaagatgaacaggattcatttagtgcaggaatgctacagatgatacttgctgtttgttcagtaccattcttcattgcgtttcagtgcattcagctacactctgtcctgttcaattcgcaattccgtttcaagattatgtttccgattactccagtagatagactgaatggcctgcatttgtttgtggtgtaagttagtgatgaagcaggaatgctgcaaaatgataccacctgctgttggttcagtgctattatttcttcatgtgatgtgggtgtgactcggtgcattcaactacactttactctcttcaacttgcatttcagttcaagcttctttaaattgtactgaatttttaatctgcatctcaactctgtggaatattatagatgcgacaatctgtgatacctgcagattgtactgcttctttatgataactacttgctggcattatgatcatattacactgctaataatctacactactgaaattagcttgtactatacattatttagtcctgtaacatgtgcccaatgaagcaaagtgtgtgtgaagaggttgaaatctcaagattaatgcagttattataccatgttattgaccttgttccgcttccacggttgctgtatattgtacttcagagactgattaattagtcttcacttcaacggttagatgaaaaaaagactacaggtttccttttccaacaaaaatcactagcaacaaaccatcaataatcatcgatgtgttaaaactgttaatcgattgctgcacacaatttgctaccttagcaagatgttagcatgagagagagaatcgtgtcctctgctccgtttaaattaagtgaacttgcatagttacatgcagtgccgtcctttgacgtcttgcccatccccgtcgccagcgctttctagttagcgtgtttggtcgtcgcacggttatcacgagaataggcttaagtccttgttttcagcgctttctagttagcgtgtttggtcgtcgcacggttatcacgagaataggcttaagtccttgttttcccttttttttctcctcgctccccccattccctccctctcttctttgtttgccgtttgtgtaaattttattcctcttaaggccatgtacaacgcgtgaccctagcctgtcgtctcaaaactccacgtcggagccgagccgagctggcacgcgtttgggtggtttcgcagcctgtcagcgagcttgtagaggaaccagggcaagcgccgcgcctgggctcgggaggcacgaagccacaagccgaagtctcacgttggaggagtcggagctccgcgccgttgcctcgtccggtccccccgtgccgtggtcgtcgtcgcctcgccagatccaccacagccgccgtggtcatcgtcggatccagcgagcccgccgccgccaagctcgccacgccgtcggcgagctcatctgcgccgtcgtggggggaagaagacggcgacgtcgagggacagccaccgcgttgtggccgccaccgcccgatccggcgagcccgccgccgccaagctcgccacggatccggcaagctcgtccgctgccaagctcgccacgccgtcggcgagatcgtccgcgccgtcgtgggggaggaggacggcgacatcgagccatccgccctcaccgctgctccccgccgccgccagatccggcgagtccacgtccggatccggcgagcccgccgctgccaagctcgccacgctgtaggcgagcttgtccgccgccaagctcgccacgccgtcggcgagatcgtccgcgccgttgtaggggaggaggacggcggcgtcgagccatccgccctcaccgctgctccccgccgccgccagatccgccgctgccgccaccgctactccccgccttcgctagatccgccgtcgccagagctcgggcggcaccgatctgccgccggaggcagagagaaaagagagggcgacgaggggaggggagaggagaagagaaccgagcaacgctgtcggtggagaagaaatcgaagagagagagagggagggaataaaaaagagaggggatgggaagaggctgacagtgggtcccaagttgtttaggggtgcacatatacttcttttggttactatagggttcaaaatataaagtttcaataggtttgataatacaagggctgacatataaatagataggggctgacatgcaaaatttgttttggagtggcttccactgtgggtagtgtgacttttgtgtagttctatcctaagtggcgtcttgagaccacagttgcgtgtggctaccattgtacatgtcctaatacaaaagtgcacaattcttttacgtattccaaagaaagttacctgcagtcaaattttgctcattaacatctagcacactactgtccctctgcttgaatgattttatactagtactagagtaatgctgcacatactattctttttttacaaaactcttacaaataaagatcataaccatttgatcgagtcaattggtagttattagaagtcaagatgcaatcagggtttgccatatcagctttttaaagagtttgtaagaatttgtgttgcatgtgaaacattttaatttatgctgcgagcaccttatatgtgctcctaatattgtcatcacactgcaccttaccagcaatcggattatctttaagcaggtcggattagagaccgggacacgctaagcatccaatgggcctgtcaggaagccgacgatcttagcgtatcatgggcccagaatttccactaaaatccaggccattttacataggaattagtccactttgactcccttaaagtggcttgaatctagtccataaccctggaccgcaaaactggatatcttgacctcctaactattgaaaccggtgtaatttgactacctcagcggttttagagggcggttttgtcagtgttgacttggtcttcgttccacatgacgtttatgtggcattagaagttaaaaaaatatgtgggacccatttattattcacagccaaaaacaattgtgggatccgtatgccattctccctttccttcccttgttccccctccctctcttccttatctctcccttaccgttcgtgcgccactggttcgacggccgcttgatggtgcggtctccctgaagatggctctccaccgcacccactgcgcccttcgtagtccacttcatccaataagaatgtcgagcgggatgtcatcctcctagatgccttatgagtgattaagttataggtgggtggcgacggtgagtggcccatggctagcggtgagcacagaggaggccaagcactcagtgtgtctagaagcaatagagaggggtcaatgccatggcgggcgagtggccctggccggtggctagaggcgagcatggagagtgagcactcggtgtggcgtggggaggagagggaactcgatgtggcgagagcgtgaagagacatcgaaaacgtcaacatcacgaagtagagagcactgcgcctgagagtgcgacgagagggaggtttattttgggtgtagcaggaggaaatgttgaggggcccgtggaggggacgacgatgtctacgatagtgaggctgggagcatggggagacatgcacggtgcttaacaccgataatggggaagatgagcggcctgcgagtggagagagggaagtggtggaagaagaagtttagaggtagtcacttagatgtgggtttaacgtctaatttttaaattctttaatgactgaactatcacatgaatcccaagtcaaccaaaccagtcttaaaatagttgagggggttattttacactgattttaatacattggggaggtgatgtacctggtttcatggctgaggatgcatagtaaatttgatcaatagttcagagttgaatttacattttgcttttgaaaaagaattttttttttgactaagtacaattgacggagcgtggggctcctcaccgggagaccgcgcaggcccccctttgccggttcggccgggggcgctaagtgagtttcttcgccctcgatctgaggaacgtcagcgagagaggaaatgcacaagacacgggcgacgtagacaggttcgggccgctgagaagcgtaacaccctactcctgtgttctggtggatctgtgcatgaaggaatacagcgaggccgagagcgagagagagttcaggctctaaaaaccattcgccagagtccccactcccttctcccctaggcctgggcctcctttttatctggtcaggggtcaccacatgggcctctagctgcctaagaagggaaacatgctttttacaatgagggctagtctacagccggaagtgacctctgacaagcaaagcacacgcctcctgccccgctcgcctgctttcccggtggacgcccatttcaaccttcatttaatggctagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggcagcctgttgccacctaacccgcgatctgaccggtctgtgaccggtcacacaccccggaccggtcacagacactatcagcatgctctgcgccagattaaatagccagagtcaacactcatacaacctgctgtaaatgccgataggagcacgaactatgctaaaatgaaatttagaaaaccatactatttacaatggcatcaaaaatcattaaatccttgggaatagatttaacaaaagaagtgcaacatgtggacactgggaactgggtgagtcattgatgaaaggaattaaaacacaaacaaatgggaaagtaaatgtcttaatgggttggaagagttaatactgtttaaacgtccatacccatccaaaggag

SEQ ID NO: 3771 - DNA, 4795 bp, Oryza sativa
  unsure (1)..(4795): unsure at all n locations
agagattggggatgagggaaggtagctggcgggagagccggacagaacgtgcaagatgatagagaggagaggagtatgcgagagagatcacgggtaaggtgataggacatggagagcagagacgggggtgagggtggaatgaaaacgatgacgcatgacgttgtgtagacataagggatggtacgactttcacggattgacgcataagcagtaagagatgatagtgtgaagaaatgaggggtaggagagagagacagtgacgaatgtaaggactaggacattaaggggataggaagtagaagcgtttaccgttaaaggtctgagggtgaaaaataggtcgaactggacgagatacgcgtataaatgaaatgcgtatgcccaccttaacccacacacgtggcgccaaaaccacagggggtcggggcgccctagccctcggggccgaaacgggagcggcccgacccctcggggagacagagggaggggtggccacgtcaccctcgggcccgaccccccaagggggtcaggccacgtgggtgaccgcggctacccaagcctctagtcacgatacccccggccccatgtcaccgacaacaatagtaggctataagtcaactataagcacatgtgaaggagataagagaggagaaaaaatagaagttaattatagatttgtagtcagatgtaacatggaatcaaagacactttgtgtgtatgagatgtgagatcagatattaccgatgtggtatatatttataagtaactactgtataaataagttattaaattggttatatatatgatttggagctagtaatttggttatattgctctaagtacgagtgtgaggaaactcctttgcaattgttccacagcaatttttgtcccgttgtgttcaaatatgagactgaacagtaaatactcgtttgcgtgtccatcgcagaacctagcaaatccgtaaagacgatttgcaaatctccagtatcttcaaattttgggagactttcgtccattttgttcttcccgagtgttgtcacgatccatttctgccgccttcgcttcttcctctgcctcggccttcgccttcgcctctgcctcagccttcgccttcgcattcgcctctgccgtctgcttcagctcgtcgatcacgatctcgaggcgggaggactcgtcatcggagccggcgcgcttggccgtcatgaggcactcggcgacgtcggccggcgtgatgctctccctgccgaggatctcgccgacggggccgaacagccggtggtcgtcgacgtccaggtagttcttggcgagggtcttgaacgcctcgattccgcagtacgacatctcgatgcgcatgtccatcctgccccgccggatcagcgccgcgtcgagcttgtcgacgtggttcgtcgtgaacacgacgatccgctcgccgccgcacgccgaccagagcccgtcgatgaagttgagcaggccggacagggtcaccatgctgccgtcacggtcatggcgcctgctgccgtcgtccctgtcgttctggcgcccccgccgctgcgtggcggcgcggtcgccggtgaggtcgagggagcagtcgatgtcctcgatgacgatgatggacttgctggtcgtctcgatcagcagcctgcggaggtcgttgttgtccttcaccacggtgagctcgacgtcgtagatgtcgtagtcgaggtagttggccatggcggcgatcatggtggacttgccggtgcccggcgggccgtgcagcaggtagccccgcttccacggcttgccggcgcgccggtagaagtccctgtcgctccggaacgcgtcgaggtcgtcgatgatctccctcttcctggccgtgtccatggccaacgtgtcgaacgtcgtcgggtggtcgaagtcgatgtagctccatgctttgtaatcgtaccggctgcacagtcacatcaacgcaatgatcagcaagatcgaaatgaaaaaaaaaaagaagaaaatgtgaaaatgtacaaggagtcgccggatttgttgttggtgtagaggcgtcggcggcggttgctgaagaggatctcgcggcccttccggcggacgtgcggcaggtactcgtcgacgacgagccgccggtcacggtggtgtaacgtaaggcgctggcaccgccgggtgtgcgccctctgctgcccctgcgaggtcctcccgcaccactgacgtccaccacagcgcggcgccccggaactcgtcggcgacgtcctgcccgtcgcgcatgctgatcacgacgccgtcgccctcggacgcgccctcggcgcggagctcgcgcgcctcccccgcgcacccgtcgctcaggtacgccttcacctcctcgtaggtgctgtcgccgctgtcggtgacgcggccgtaccgggagtagtgcgcgctggcgccgcccggctcggagacgtcgacggtgacgtaggggtcgacgacggcgaggaggcgccgggcgtgccggcggaggaagaggttgaagtaggtcttgaacagccgccgcggcgcgtaggcggcgagcagcggcgccaggaggagccacagcgagccgaagttggacagcaccgagcccaggttggcgaacgcccagcgccgccactggacaactttgcccgtctcggccgagagagccatggacggcggcgacgacgtacggcaccaagcggtgagttcgcagcacacgggtctctggctctctgtccgcgcgtgcagagatttatgtagcgcgcttctgccacatttatatctttttaaagaaaaaaaaatcccacgatctcatttgaccatttattacctgctagttaagcttaaaagtaaccactcgatgccttctctccgtgataaaatatagcaactactccctccgtattttattttaatgtatgacgccgttgattttttgataaacgtttgaccactcgtcttattcaaaatttttatgtaaatataaaaataattatattttcattaaaattttgaataagatgagtggtgggacgttgattaaaaaatcaacggcgtcatacattaaaatacggaggaagtggtatttaattaaatgccatctaatactacgaatttaaaaaatatatatatctaccactattaatttttataattcgtgtagttaaatatgctaattatatattatataattattttctatggtgaatttaaaacaaatataaatatgatgatgttaaactatataattaagtttgtaaaaattaatgagcaaagattaaaatgtttgatttaaaataaaattaaacggcaaataattcaaaatgaagaggatagctcattgagttactccatctgtctcaaaataaattaaccttgtacgtgatatgacacatcggttggtttattttattaagggagtacgatttatgacaatgaatacctacccacaaataattgggagagactacagaatgggatcctgttagaacgtgatattttaagtgactcctccccacttccacgtgtgctctctcctgatacgtgatacctggtaccttaggtactagttgatacctggtacctttggtatcggctgggtaccggctgatacctagtatctagatactttagtatcggctgggtaccagctgatacctgatacctagatctttaagtagtgactccttcatggtacttggtaccacctggtacccggtacttgcgtactgaatggtacttggtacctggtaccctggtatcgagctggtaccaaggtctgatacctaggtactaggcgtgatacccaaagagatagtgaacgaagccatcccagcttcgcttgaggcggagagacgctgcgcgtcgccggccaccgcggctgctactcgcacggggcaagaccacggcgacgcaacacgtggcggcgcggcacctggaccacaccttcgagaagctcgcgtcggcgcacctccagcttgtgatggcggtgccgttggtggacgcgttgcgcggttcgccctccgagctgctcgcgctccccgaccacgcccaccacttcccgctccagctccaccggcgaggcgcgctccctctctccctctcactcaccgcgcccgctgccgagctcctcgctgtcactacctcccccgcagcggcggccgccggctccggcaacggtggggtgacggtgacagggagagctacacctcgagtgccatctgatttggaggaggggagtgaggtaggaggaggggatccgaataatttgagagaggagggtgaggtaggaggaggggatcgatcgatttgggggaggggagtgaggtaggaggagaggatccggatgatttggggaagaagggtgaggtaggagcaatttggattagtattccgtcttcactaaataccggtgcgtagattttctctaaacaattgtaacatgtttgtagaaaaaccggtctttaccgtctaacccacgcggacaagtcttctcttcattgagcgtcaccactcacctcgaaggtaccaaacaaatacctaaccacaatttgttttttacaccttgtcttcactcatgacaatgacgtaaagttgtagtacaacaatttccccggttgctagagttgacttgggtgctcatagttaatcaagaaaattggagattcatatggcgtgttctctcatgattttgtatcgactatttcaaactactccctctttaaaaaaatcaatctaagaagatgtgatctctcctgaaataatgtatctgaacatattagtgatgngttccagtcgatctgcaaatcaatggcgcgcg

SEQ ID NO: 3772 - DNA, 15358 bp, Oryza sativa
  unsure (1)..(15358): unsure at all n locations
agaaaaataaaaataagagttaagtaggaatacaatttataaataacaaatattaagaaaaattgaaagaacagtacatttagaatataaaatggtggcaaatgaccttatataggatagggatagcaggcaagccgtaaaggtagggtggtggcggttgatcggatatataaaagaaaaccctcaatcattactatattctatttttaaaatgctaacgacgattaaaaggataagaagtgggcaagccattgtaacgctccgcttttcgtgaggcgttaaaaactaactcggcaaaatcctaattgcgaaaattttcgttctttgtgtgagagtctaagttgtgccaaggatctcaatttaatcccgttgttccctctcatcgaaatcagaatcctccacctcgaaaattcctcttccgattcgagtctccgaaatcaaattccgaaagtcaaatccttcctttgaatcctcgccaaatacttctatgaatccagaattattcaaatcccgcctcgaatcctttccttgactccaccctattgaatcctttccttcaatacccaaatattccttttgaatcttttccatgactcctccttgagtttcccttgatacatccctaaaccctcgagtttgaatatcaaaattgaattcgaatccaaaccctaaatctctccaattctatccaaatcagttttctctgtaaaagtctattttacctccctcgtgatgatttgggccgaaacctgccgttggcccatctcttctcagctccctccatctccgcgtgcgccgcacgtgaccaccaagagagagagagcgctggctctctctcccttccctctctcggacgttctctcgctctctcgtcctcttcctctctctcgctgtttctctctctctctctcgcgccgacgccgttttccgccgtcgccgtccaaaacccgccaccgccttcgctcttttccgcgctcgcgcgtggccgaccggccggtcgttgccgccgtaagccctgccgcgcctgcgccgcgcagccgcccggttgccgccgcgtcaagccctggcgccgcctgcgtcgtgccctgccgcgctgccgccccgccgctccacgccgctagcttccaaagccgagagaggcatcccctgtctcaatcccctctccctcctccttttcccgtttcggcaagggtcaagccctcctttccctcttcctttcccctttttcccgaccaccgacgatgtcatccatggtcccagccgcttgcggccaaagcgcggacgctggtcgtgcgactgcaccagctcaccaccagctcgctctctttgaccgccaccaaggacggtttccctccctccccaaaccgacatcgcctccactataaaacccaagccgccccaaaccccttcttctctcgttttcgctcgccacactctcaccgcgccattgttgacgccttgccgccgctcccacctcttgccttcgtctcttcgccgtcgcacgcgtcggaggccggtgcgtgcgtggacgcgagacgaggactccggccatccctcttcttccccttccccggcccgaggccagagagctcgctcccgcgccgtcggccgctcgtcactgcgcccgtctcggcttggtagtgccaccctccgtttcccccttctcgctcgtcctctccctccctagctcgcgtggtagctcggctagccccccgatcacgcatggacgctgccccaggtctcgccgccgcccgccataggcttgccgccgttgccgcccgctcccggaggccgccgccgtcgccagccctcctcggcagtcctccgccccatccggtgccggaaatgagttccccgtgccccggagatgctccctcctccttgaatcgacctctcgtcgccccgccgcgatttccccttttgatctccggtgattgctgccgccgcaatccaccgtcgtcggctcctctcgcgtcgattcctctcgccgccacgctcccggggatccccttgacctccccctggctgccccaaggccgtcggccttcccctttgtctccgcgccgtgtcgccgcttccgccgccgcctaacgctgccgtgcgtacgccgccggcgaccatcgggtcccacgttcccgcgtgcgcatcgcggtcgcgtaccggttcggctaagcccgagcccgcgcgcccttcgcacatctcgcgcgcggccacgtcggcgtgccggcgagattggtcgccgccgccagccgccgtcgtttttcccccggctaatccgctccgttgaatcgattccccttggcctcctctctcttccgttgctaaccccccaatccacctcgccgccgttcgccggttcacgtcgctcgtcgacggccatcggatcagcctgcccggcctcctctcccttccccatccgacgtggcatccacgtggatgccacctcagccgcccggccccgcggagaccggtcaaaggcctcccggtccaccgatccaacgcgccgccttgcgtgcaccccgctcgcgcgagccgtgtcgccgccttgtgggtcccaccttgcgcccggcacgatggaccgcgtccaccggcttgcgtcgcctggaccgcgcctcgttcggccttgggccgcctccctcccgcgcgccggcccactcgcctcgaccgcgcccgcgcatctcttcgggccgcgccccttcgctcggcccaagtccaattaacatccctccatccttttctttttcagggatttaataaatcctatttcctttgtcccataaatcaattccttatttcaaaaattccataaatcttttcccttggtcccgcacgtccgtgactgccaataatattcttgagaatattatttctataaatttcataaatcaatttccccttgttccacaaatatcttcctttgcccagaaattccaattaaacttccaaaattcatatctctcgatccgtaactctgattgactccgttccacttcccgtatttccataaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcatgaagaccttgagcaaggcaagtcaccctttgatcaattgcccctataattgaaaagtcattattattttgtttgcaacttgcattattagaatcacacacacttaacttgcttggcctcggtttgcatgccaaaccgacggacctacccagtagtcgtactaatttccgtaggtcgtactaccctgaatccttgtcgctccacccttgtggtacctcggtattcgtgctctctgagcacgtataccaaatatcccacatacaccgttgcttgtcgaaaatttgggaaatgggtttgtgaagccttcaaaacccgacatgtggtgtcggtgtgtttgaaaataaaatgaattgtgaaaactcgcgatgcggggggttgtgcctatgtggcactatcccgtattcgcatataaggaccgattcctgtgggaaactcatcgaacataatcaaagtacaaccacaaggtggaatgggacaccctagctaagtaactagtcggttcagggaaacctcgcatgccaatagttgggaacgccggggcggggtcggttggagccaaaccgggttcctggtaatgcaagaacgagaagcttgctgaattaccgatcgaggtggttggagtttgatttgtgaacgcctaaaatggcctatgtttatgtgaggatttgatccttctatgtggcatgaggtatccctgggtcggcttgggaaaggctttgtcgcgaatctctgacaccggccagtgtttggagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctgtgtggcagatggatgacctgagtggtcagaaacgaatctgtgtgattcgggatgtctgtgggcatcatagactaggcttcccgagtggaagcggattgctttgctgcggggcagctggactctaggagtctgagaaaatgaaaaaggctatgggagccgattaatcaagtggaatggctctgggagccgagaagtaatgatctgacccgggaggtcggtacattactaaatgagctgttgaaaaacatctcttaaagtcgaatcgagacgcaagtctctcttttcggcccaaacttaaaaagaaataaatcacttagtgatttcaaaaaaagtcttcaaataaaagatttgcaaaacaaccttgcctctcttccaagcttgcattaaacacctaagttcccgttacttgctgagtacgaaagtactcacccttgctctatatatagttcctccgccctgaagagaagataaagtgaagtgaagattagggtttcgtcctggttcccagccgtcacctgtggtgttgggtgttagaccgttggttccgctgctgctgctgctgttggtgtttcctcgtccgcgtcgtcggttgtattctcgggctgtctgagctgcaacctaagttaaggtaaataagtcctctatttattttaaggattgctatgattcatatttgtcaccgtgggtactagcactatgtcctgggactggtaccgagatcacggtttcgtaggaagcggttcgcgccgttttccctacgacacgctcctgtcaggtgccgttgtacggcggtatcagattggggtgtgacagccatgaaaggagcatgctatgatggttgacgggacttctagatagtaaaaaaaaaactaacgataatcatcaatttttgtaatcccaataacactaaacaggaggatagcgagtggaccgtacaggaatacaataccgagttgtgatgagacttcttaaactataaaacgggaacccgactttgatgggacttcaacaattataaagcctgaacctaacgatataatgaactggaaaaactacatgatcgaaaatttaaaggtttcaagaagcatgaataaaagccttggtagattggcgagcaaataaaggagatgacagttggtgtgacttttaaaaactataaaattaaaacctagatattgataattaagatttgatctttaaaaatcatgacataaccatataactatttaataattcttaaagaaaatcatatgtaagaaaatataattttgtacagggtgctagccgcgcaattgcttgtgtgcatgaatttttttatttcatcatgaattgacataattgctataattttctataaaataaaacttaaaaaagttttaaataggaggaaaatcaaagcgacgaaggtggtactattcatgacaatttgtatctgtctgttaattttttgccataaagcatacacgcaacaagatggaaacacctactcctatgctgctactttccgctgacagctgtcatgccgcgtctgtccgacgggcggggctcgtcctgtcgtgtcgtccgcgccaacgacgccgttcatctcctcgtcgccgggcaagctggcaatggcgacggcggcgccgtccaagtccctccccttgccccagagcacggtgtacagccccacgacaatgatcacggcgccgataacactgcacacgcaccacgccgccacaataagcaaggattacaacagagttgtgagcaaacaatcgacatgtaattacagagtaatctgttcatcaagaacacaacgatgatcaatcatgatcgaccgcgcacgcgcctacctcccgacgtgtatcttctcgccgaggatgccccagccgacgacggcgacgacgatgagcatcagcgggctgaacatggacacgaacaccggcccgcgctcctggatgcaccacgacatcaccgtgcacaccatccccgacgccacgatcccctgcccatttatatatacacaggtgttcgatcagttccctctcatgtcgtgctaggacgtactgactgactctgcatagtttaatattaccgcgtagagcgcgccgacgagcctgatgtcaaggccgagctcccacgccgagaacctccgctccgccgcccccgcgatggcggcgcactgcacgctggcgatcaacgccatcagcgccgtgctcgtgtacgggcaagcgaagctcttggacagattcttctgcgaacaccacgaattaaaatccattcaccatttcccgccgcatgatcatcaaattaagttgtttgtacctggatgatgaaccagatggcccacgcgacgttggagccgatgacgaggacggcgccgaggacgacggcgtggccgccggcgtgcgcggcggcctcggcggccatggtgccctggacgtagggccagtggacgggggacgccagggtcctgacgagggggccccggtagaacgtcatgagcatggatccggccacgcacagggcggttccggccaccttggcccggccggcgcggccggcgacgggctccatcttcagcagcgccgccaggaggaaggtcaccgccgggagggtgttgttcagcgccgacgccaccgtcgggctgctgtacttgaggcccacgaagtagagcacctgattgagtgttgctctgccaagggacattatatgttttgatattattttggagtagagaatggacgtacgtgtcgactgacttaaaataggtgtagacagtcaaaatatacaggaacacttcggttgagttcattttagcaatttgaaagagcaactttcttatatttatatttcgttaggacgtttctcaaattgctagacagtgtgttttgaggaaattaaataaactgatttgtttaagtttgtgatagttaatactcaattaattgtgatgttcttgttttgtgcgctgcgaaaaagcataggcaatctgccttgtcgaagaaaccttaacccaatagcttgtagctcggtttgaaataaattattgagcggactgttattaataaatagcttaaaacaaattatttaaacaaaaaataatagatattttttgagaaaatatagttttcaaaccgtagagtaaataatcagattaataatctgaaaaaaaaacttcaatctatatatcctctatctaaaattccagccaaaattagaataaaacttaatgactctagtttctactaacaatttgcatccattctctttcatacacacttataatttggccagtactttttataattatatactagtgaacttatttgtggatacaatgatggttggttgaaacgccatttggagtaaaacccaaaaatatttctagttaattatgctagtcaacagatccattccagtaaaaaaaaaacaattccattccagtaaatcgaaatcccaactgtgcaattttgtcacataaaactatacacaagtacaccatcccggtccaaataccgttacagttctctatatttttcagctgtttactgaatgtaagtcatttaagaactattgtatgcacctttttatcttttacctcatattttccttgctaataaataatatttatcacacaaataatgattcatctttataatgcagcataaatataatataaaggagaacaaatttatttgaattcggagtcttttttaattcttttttcacaagacaaaaacaatctacatttggaattgaagggagcatacatgtgtgctaaatttatttcatcttaatcggagtagtggaagaatatctttttcatatatattgttttcgctatggttcaattgtgtgtgtgtgtgtgtgtgtgtgtgtaacttaggagcagtggttaaaatttggtataagccccagttaactcaatctttaaaattatggaattacatagcatccttctgattagttaatgctactattatccaagaaaggggaactggatcaaataacttcattgaagtacataaaatgaaatagtcacccaatgctggagcatatgaatatctggaataatatcttcttactaattgccctccaagttttcctgcaatcacacaagaaactcagtttaccactttgaattaatggcattaaaagtcaacatggttttggttgtacattgaaagatatacaggtaaatgagtggaattgaatacatcattatacagatataggtcatttagataatcagtggaattgcatacatcatatatgaaagtggacttatacaggtaaatgacaatattaagtaattatatgtaatgatttcgtttcactttgaatattaaagttggatatatctgaagactacatcaccaggtttagaatctatgtaacattcaaattttgtgttaaaaaataacattttggatacatgaagattacaggatagatcattttacttaaatacttgcaaaatataaatttataaaagctagtatatgtcggtggaagactggaagtaaaaaagacaaaaatgtattgaataccacaacagaaggaaataaactagcaaaatgaatcatagtggccactcaaaagtggcactaacgatatacatagggatcctagcccatatatcagtgtcttatttacgttccactccttatggagtggcaagtctgagagttgacatctccactatgctatgatagtagggaagtatatattgtatcaattacaccaatatatcaagagtaatacttcctccatctcttaatataagaaattttggaaggatattacacatcataattatactacgaatatggataggaatctgtccagattcgtagtattaggatgtgtcacatcccttcaaaatcctttatatatcaagagtaatactccatccgtcttttaatataaggaatttcggagggatgtgacacattctaatactacgaatctggatagggggtttgtccaaattcgtagtattatgatgtgttacatctctaaaaaaaatcctttatatttcggacgggggagaaaaatgtttaagctaatgaaaattgaaaacttggggaagcaccactgatatggtggtggagccgtggttgcataactccacccaccagagtttaaatcctggtgttcacgaatattacgcacatgaaggtggattttcaacaagactttagtcaaatcacggatatgtcgctgttttacatctcttagagcatgtgttaggagatgcattcgtcgtgggggtgtgagtgtggtgttgtgtatacagtggtgtgtgtgcgtctgcgtctgccgtataatttcaaaaaagaaaaattgaaaacttcaattgtcatgaatgtacctttcaacaaggaatgctatgggagcgaggaaggcggctgcgatgaaattccggtaggcgaggagaacataggggctcatgcccgaggccatggtcagcttggacatcacattcaaaccagcaagccccagttgcaccagcaccatggcaaggagaggcaagtaggtactcaaagtactagcttccatgtctagctatcgggtaagtacgtacaccctctctttctctcccaaatgttcaacagttcttgtgtacttgtggttaccaatgctatggcaacacacaagaattgttcttgggagagaaagattgggggtgtagaggcacaggctgagcagagaacatgtgttaatgtatactatatagatggagcgtacgcgtactttgtagatagtagtagtgcagctgagtgaaaagccagtacaggcgtttccgtttcatgtaaaacaaagtagtaaatactgttactcttaaattattcatttgatcatgaagatcatgctatctttggagacatctagcttatatttatctcttattactcctctctctactttgataatgtacatcctgttttgccacaccccattggttgtacgctccatattttcacacgaactgccacatttcctggtgaccgttgctggtcaattgaggagggaatgaatttaccatgttctaaaaaaaatgacctgcatgacaacgcaatctacgtgaagatgaaaaccagttcatttcattttattcatagatattaggattctccactaaaatattgcaagatttttttaatataaaaatatcattttgggtcagtcaattcaagcgagaatcaaatgttagatgttttgcttttattttctaagattttgtttctgattttttaattcattagagatggcatcctactagtgttttaagatcatttaatgacatctattaattgttatagaataaatagataggagtagaagatagatagacatacagatagatttattgaataaatcgacagatagatatgtagatatgtagatggatgcattacgccagatcctcacacctttgacagcatatttgtgacgggcataagtactgttggtcagtgatgaagatcacctttgacgggtcctaccggatgccgtcttcagtgagccatccggtttcgacctagtcacctgtgacgggccggaagtgaaaaccgtcaaaggtgaggcttacctcacctctgacgggttccattttcaacccgtcacaggtgactagctacctgtgacgggtcgcaaccggatggcccgtcagaggtgaagtttactcacctcaaacgggttgaagccctaacccatttgagtgagttgtgttactatatatatacccgatatatttcttctcccttgagataaggccagcttctccacttctgtgtattcttctctacttatccactctctctccctctctctctccacagacttctctcaatacacgcgccgagcaccgggttcggcagcggcatctgcttcctcctccaccggccggcgccgcctcccccggccaccttccgaccgtcggtcaactcctcctcccgcaccccaccgccgactgctagatccggcggtagccgcctccactgcggcctctccccaccgcagatccggcgcctctccaccgccggtcccctcctcctccgccaccccattgccgcctgccagatccggcggctgccgcctccaccgcatggttgggcgcctctccaccgccggtcccctcctcctccgccaccccaccgccgcctgccagatccggcggctgccgcctccaccgcaccgccaaccgtcggatccggcacctctccaccgtcggtcgcctcctcctccgccaccccaccgccgcatgctagatccggcggctgccgcctccaccgcaccgccaaccattggatccagcgcctctccaccgccggttgcctcctcctccaccaccccaccgccgcttgctagatccggcagcggccgcctccaccgcaccgccaaccgtcggatcctgcggcctctacccccgacagccggcgtcgtccaccatctcctccacccgctaatgccgccgccatttccaactcttgtaggttgtgcaaattttcattgccaaatttcagattgggttatactctcagttgcttgtgtagatttatagtttattactcaaagttgtgtggatttgtgatgtatagtacttgtgtggatgtgcttcatgtgtcaacatatctgtcaataaaatgcaaagttattgtgtcaagagagattttgaaatgttcttcatgtcataagatatggcttgtgggctgctaaggcttgagagctgagagctagaggctgagggcttttgatttttttttggttgcttttccacacctgtgacgggtggtgagttgaaacctgtcggaggtgtttatcacctttaacaggctgaaaagatccactcgtcacagtgacgggttattttattcggtccatcagaggtgtcaatcatcattgacgggctttcacccgtttgagatgaggtgcagtcatcagtgaccaagactaaatccatcaaaggtgagggttagagcctgtcacagatgactaggtccagtgtagtgatggttgcatactttcatgggaaaatatataatgtaaacctatataatgtagtataaatgtggaaattattattggataaaatatagacatatgatatttgtccatgtcatcttgagtaaactcatactcatgattaaatttaggagtaaaagctttattcatggtaacgtgcagatgtttaattttgtatcgaatggtaatttctaggtttgcattacatattttccctacatgcatgtcttgcattggataaattccacttcacatctcacatgtgtaagggtcgggttttaatcctatctctcaaccgtgaaaccagatattaggcatccctcatcttctaaaacatgtgtaatatagttccaaggaggtattgaggcatgttttggctaatgtagtattatgtgctccattggcatgagcccctatgtgtaaatgtagtccaaggtggtatttacactggttttataaagatgaggaatatgttgtatctggttttgtggttgagcgacacgatcaaaactcgacccatatatatgagggacctaaaacgaacttctccctctaaggagtagggacagtcagatacattgggccacaaaattaggcccactgaccaggcccacataataaacgagagaataggttgcgtcggtgctgaactgtggcggaatctcagactttggcagcattcaaggttgctgccaaaccactggccaatcagtgtcacgtgagtgagcggcgtgaaagttatggccgcacatcacaggccatctgtgtctaacctgtttttatgtcattgtgtcagataatgtttggattctccttttacataactttggccaatcatgtgtcctattaattcttcctttatgcatacagcatactgatactattagttcttaatgctacaagtgtaacactgctaatgattgatttccattattgaaaaaaaaagtgtaacattgctgaataacatgccatcacagtaatacattgagcaaaactaaaaatgaaaattcctgttccaattaattcccaatgatgcaatgtgctttgtaaaagtttcatctatagcgtggtgtaaactaattacacttgcttcgattttttttttaccttttaccaccccagcaaaagaatccaacgaactccaagaattgcagagaacctatgctgctatgctgccgcctgcaggtcgatctgaacagggaaggacagcgacagcgcgtcgtctccgacgaggaccctgctgactcccgacggcacgacggtgtacgccgtctcctcgacgatcgcgaacgccttgcacacgttgagcgcgaaggccacctcgacggcggcgcccgcggccacccgcacccgccggaacgccaccagctgcttccgcggcgcgccgtccacctccgccggcggcgccgtgtacatcggcacgacgtgggtgccgtccctgccgcccgtgttggccaccgtgacggcgaagctgacctcctcctggcacgcgtggctggccacgttcacggccgggcacgccggcggcgaggacaccccggccttgtaggtgagctgcttgcagtactcccacgcgccgaccttgaccgtgaccggggcggcggcggtggccgacgcgtaggtgaagttggtgtagctgaggccgtggccgaacgggtagagcacgtcggcgccgccgtagaacttgtaggtccggccggggtagccgtgctcggcgtccggccgcagcgccatggacgtcatcgggatcttgctcacgtactcgttcttgtaccacgtcagcggcaatcttcctcctacaaaacaaaaatgtttcagaaaaatgcattgaagaacagagaattaatctacatgtacactcgattctgtacctggattgtattttccgaagagcacgtcgccgatggccgtgccgccttcctcgccggggtagccggcccagacgacggcgccgatcttggggttgtcctgggcgaaggagacgtcgacgccgccggcggacatgatcaccaggacgatcggcgacggcgaggcctcggcgacggcgttgatccagctggcctggctccacggcaggaggaggtcttccctgtcgttgctctccctctccacgctcatgttcaggccggcgacgacgatggtcgcgtccaccgtcttcgccgccgcggccgccgtgtcgcacgatcccttgtcgcatgcgtgcaccgacgtcgagctgaccaccttccgtacgccgtcgtacggcgtcaccaccctgcaaggcttacctctgtagtctccaagcatgacgtcggtggcattgatgtgttgcagctgcccgaacagtgccaccgaattgaccttctccggcgacaacgggagcagcgcggcgtcgttcttgaggagcaccatcccctgcctggcggcgtcggcggcgagctccttgtgctcctcggtgcagacgtcggcggcgccgagggactctagctccgggatgccgtcgaagaagccgagcctcatgagtgtaaggtagaggttggtcagcgcgttgtccacggcggactccttgagcttcccctgccgaacggcgtcgacgccgtaggtggtgaagaagtcgtggacgccctcccagaacatgccgcagtcgaggtccaggccggccttcatggcggcggcggtggcctcgacgccggtgtagccgagccacttggcgtccctgaccatgacgcggacggagtcgcagtcggagacgatgtagccgtggagctgccagtcgcggcggacggtctccgtgagaaggcgcgcgtcggcgcaggccgggacgccgttgatgcggttgtaggagcacatcacgcagctggcgtcgccgtcccggatgcacatctcgaacggccgctcgaacgtctccaccatgtcgcgctcctggacgcgcgcgtcgaacgtcagccggtcggtgccgttccacgcgtcgacgtcgtacgcggcgtagtgcttgcagcagctggacaccttgatgggcctggagaacgcgtcggtggcggcggcggcgaatgcggcggtggtggcgccgtcgatgtcctgcattccgcggacgaagttgacggcgtaccggccgacgacgaaggggtcctcgccgggggtctcgctggcgcggccccaccgcgggtcgcggacgacattgatgttggggctccagtacgtgagctcggcgtggcccaggttgtacatggccctgatctccgtcgacaccatgatgagctnctgtaccagtggtactcactngccac

SEQ ID NO: 3773 - DNA, 1374 bp, Oryza sativa
  unsure (1)..(1374): unsure at all n locations
aatcagatgacaggagtttcgttttgtcagtgcctccctttgggcagtgcgcacgtatgtgttgtctgttaacctttgatgcaacaaactctggggcgtacgtctgcaaaccgcagcaactagaggccgtgagatctggcagctactagcagttggatgtggtgtgagtgtgacgatcgacggccaactgacgaagagccttccttttatgggtttcgcttttgcataactgcatttgctgcctttgtcgttctagatagccaaggcacgtttgccatctggtcatacactcatacttaacttagtttgcccaactttgtagaaatcgggaaattcatgcttcaaaagataacacactgcagtaattaaacccgggctccatgaaacggccacaggatttcgcatgcaagtacgtcactcatttagtaaaactcgaaaaagaaaaaaaggtttctaaaaaatatacatttgaaagtttttcacttaaaaaatatacatttgaaagtttttcacttaaaaaacactacatttgtaactacaacataattatggtataactacatttgtaacaagcatgtaactagatataactatactgcaactagcatgtaattacacaaatctacagtcaacatgtgttggtgtggctggctagcttggctggcttgtgattggagctctcaggttaaaaccccagcaaacgcgtgtcaatattttttttctctcccctcactactagaaaaagcattttccctaacgttgggggtcttattttcacagtcggacgcgattttttggagccaaatgaccgcctacaaaaatataaattggggtgatgttcgctgttttcgcagacggaccacttaagcagatcattttcgcaggcgccgcttaagtggtgcgcctgcgaaaatagacttaatataaataaacaggcgggcctaaattttttctaagtccctcacctcttctcctctcccctcccctctccccggccgccggccggagacggcggcggctcccggcggtgcggcggcgtgtgctctcggcggcggcggcgggcggtgtcggaggaggcgaggcggcgcggccgaggagggcgacgaaggagggcggcgcggtgacgtgtgctcccggcgacggcggagggcggtagcggcgggcgagggcggcggaggacagcagcggcgaggaggcgcggcctaggagggcagcgcggccgaagtatgggcgacggcgtcggctcccctcccccctccctcacagatctggccagaggagggaggggggaggccggcggcgatggcaacggcgtggagtggtggcagcgatgagcctgatgnggtncggtnccagccgtagtctgtcatcccg

SEQ ID NO: 3774 - DNA, 806 bp, Oryza sativa
  unsure (1)..(806): unsure at all n locations
tgggccattgatggctgctgtacnctatcagaacagcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgagaactgtgtaagtcattgatgaaaggaattaaaacacaaacaaatggaagagttaatgttttaatggattggaagagtcaatacttgtaaaatgtccataccatccaaagtgatgtgcc

SEQ ID NO: 3775 - DNA, 3467 bp, Oryza sativa
  unsure (1)..(3467): unsure at all n locations
ggccggctagaagagtgaaggaaacgcgaaattgacaaagacgatgatggaagagaggtccgtntgatgtgaaggtcggatgctcacncacccccccccccccagcgcnattgtgnatcactgctnaaanacnncncaaaccaaanggaaacggaaccaccccngggccncnncccacanacnnnaaaaggcacaacaagacagcacaancagttgcaaaaccagagancggcnncaggcacacggggcaggaccggggagaaaaggagaccaccagcacagggcaagcagctcttgatacggaagtgtttaaactaatggagtacttggttggtggcagaacaaaagagcatcctttgttggaaactggtattgtcaagctgcacgccttgggtggatggatttccggaacaaaagcaaaaggtagtatagcaaattatatagtatatgcaattatatctagaacatactagctactattcagaacataaatctagtcatccgtataaaaacttgcgcacgcaagacgcaagtgcatgcatggcgtgagtgcatgggatcccattgtattcctcaagaaaaacaaaagcacaagaaacaaacgatatggcgtgagtgcatgagatgcatcccattactcttcaaacaaaccaaaaaaaaaaggcacaagaaacaaacgatgtaacaatgctataaaatgctccgttctagcaataacccagggattcagctcagcaattcatgattgaaacggtcatacagacagacactgcctctcaccaaaaatgggttttcattcaggagtgatatatgcgtaccttgattagtactttgacaaaaaacgagacattaattggaatgctccttacgcccttatccatcttgtaatcaaacattcaagctaacagaaatcagggtaaaaaaatggaatcatcgaggcgcatcggtatataaaatatttaatcatttgcttgtaatcaagcattcaagctaacagatatcaggtgtacaaaatcaacctcgaaataatgaggtgatatgttgatacatgccaaacatttcaacattgaacagagttgtttaggtgtttaaaagtggcacacaactatatcacataacaatagaattaactcatgtaagtttatcagagtgttaatacaaaagaatgatcaaatacaatcaaatagcttgtaaccaaacagatgtctccaactcttcacacatagaacttttttggcttagccctacaaactggaagacttaaatctgatggtcggtgaaacctgatagaggctctggaatgaaatatggctcaagcatacatacgtgttctttcttgcttgatacagcagagtgaataaagttctcaagtcaagggcagaccaatatacaagccccaatcaataaccactcactccatgtcttcatctgctttacagaatatgatggtagaaggcatgcccaagcagggtgcacgtagaacaaaattagggcccattcaataatactgcaggccatgctgttctacggaaccaagtagaccaacgtaatacccgattagtgtatgaactgtctgctcataatcctaagaaggcacattgcttcttagcatgctgtggaaccaacttcacaagaaattccattgatgctcctttcagctctgttcaagttcagtagttagcaaatcaggatattgctgtcagggtgtttcagttggtctggcattgacaaaaatcttaacttaccacgaggcttgaaattgaatagtgggggaagagtacggccatttggtaagcgagcatttggatctcgtagttcatcgaagaatggatgaattaacacctccaactggtgcgaggagaaaaaaaggaagatgtaaaatgagtacatagaaacatttacaagagatttcctgatatatgcattaatacttactgcactgcaccggaggtgtggtgagtactgcagaagccgagacacaagatctacagcttcagatggcattcttttatgaaagatctggtgaaagtatgcataattagaatacacattataatttataaatagtaagcaggagacattaactctgaaaataagaggaacaaaataaatgtgaaggctcctaccttgtgccatgggtgagctttgatttgggggaacttaaactcagtgtagttcggattcatatgtttgatttcttcccttgttggagtacccagtacctgaatgaagtacagtaagtctcctgcatgagctaaaagaaaagggggaaactacatagaataatattccactaaactaaatcagatgttaccttgataatttcaacaagttggtcgacgccactgtcaccaggaaaaacaggctaaccaacagcaaataattcagagaagttgcttcaagaaattgggtaatgtatgatgacaactaggttgacttcttacctgccctagaagtagttcagcaagaacacagccagcagaccacacatcaatagctgtcgtgtactctgtagccccaaatatgagttctggggctctgtagtatctagaacagatatatgaaatatttggttcccctttcacctatggacacggcaaggtaaatttaagaatttcagatagcttataaaagatatgtgacctttttttatgaaaacatatgtgagtgaagattactctaattgatacaagggatcataccaggacttttgcactgccaaagtcacacaatttcaactgatgattatgtggattcacctatgacaggaatatcttgtcagacctcattaagctgaaattatcatatacggaaaataatgttgctagtatgcactactcagacaaatgataaccagttaaccacagtacataccaatatattctgtggctttatatctctgtggcatactcccacacagttatgaatgtatgccaaagccctacaaatctgaaagaacagaaatgacaatgaacagttttcagttaaaatcattatcaaaactaatagtgcatagctatagttgtgttgtaaggcgcctgcaaccttacctggtacatataaagtttaacataaatcaatggcatgcgttggctcatcttattgtaatgtctaataacacgatgaacagtttctggcacatattcaagaaccaagttgaggtatagctcctccttcgcagtagtcgagcaaaagtaatgcttcaagcatgcaacatttgggtgatcgagaacttgcatcgtttgcagctcccggttcttgtatctcgcatcttgaagaactttctttacagcaactctctcaccagtttctagacacttagcctgtcaaagataatttaattagtaatctctaaacagaaaggtaatgacagaatggcatataccaatggcccacctggaagacaactccaaatgaaccacgcccaacagcactgatgagctggtgtcgcactgcattcattgccg

SEQ ID NO: 3776 - DNA, 1774 bp, Oryza sativa
  unsure (1)..(1774): unsure at all n locations
catgggcaactgattgcgatgcacatgnacaannactatcattacaccctaaatattaagtaaaataacggatggagtacacgtcgtgttttctcccctttgatttctattaaatacgtatggcgtgtgggtattttgtatatactaagtttggttaattaggaaacataaacaatactaaagttatatatgagaattcatgcattaaaaatacacttcataacaagaacttacttaacaaaaatgtactttagtctatggtgcttaaatatttataaattctctaaacatactaattatttctgctcttatttcaaactaaattcattttctccacataatataagagatcatatgagaaaaaaaaagaggagggagaagaagtaaatagaagtctgccattgaacagatagaataaagacatctataacatacaagaaaatttgttgattaaggtttataaaccccaaatgtaagatatgctaatttctaaaaaacacacacacatggtacacataatagttccatatgaagcaacactattgttgtgaaacaatagtttctcataaattaaaaaccacatggtttaaataaatttgatttagaatttatatgttgaaaggtaattggaagaaaattaaaagcaacattcacaacaatctcaaataaattattgataaaaaaacatgttcagaatagagtaaaaaaatattttaagaaatactcatccacacataagcattcataattaaaattcaagcaacattaaataaggtgtcccgcgcatgtgcgcgggctacctttctagttaaggtaaaagaaaaaaaaactacaattgaaatgcttgctccaataaagcaggaaggtggtggcagagccccactacacttctaacaagcccccaaaattaagcaatagcgccagcagaagaccatatacgaccttccagaaggattggctccagaaccattgagaccaaggaaagtgaaagatcataaacactagaattcagctccttccacagctgacaagagactaggaggactaggaagtcaaagacgatgatcaccatacctgaagtgagcaaccacagggaggagtgaggacaacccagccaggggacgacaacacagggtgccagacctgacgagtgaacacacagtcgagtaggatgtggttcgccgtctcaagatgttgagtgcaaaaaggacagactgagtggctatcgataccacgtttttgcataacaacacgtccaatagcgctgctgaaacataaatcataataaaaacttacatttggcgggaccttttgcttgccaaagcagatcggcacaaacaaaggagtgctgaccgagaaagaacacctggtaagacgagtttgctagtaacattggtcacttgttcaacaccagacaagacgatcctccatgcccgacgagagttggataggaagtataacattccaaaccaccgagggtatgtatgctcgacagtcgctgcagctggtagccacgctggtacgtgatactcctattatgtaattggaagtaattttatgatcaattccaacttctgaactcactttgtctagcatgcatatgtgtgaatacactttctccgttccaaaataactttatctttaaccttgggtatttaaaacaaaatagaagaaaaaactaaagtatcctttattaataggaaagtagttttatacttttagtgtgtgggttggtaaggatgagtaaaaggtaagtacaaattcctcgatttgg

SEQ ID NO: 3777 - DNA, 1412 bp, Oryza sativa
tctcaactttgattgtttgtcttatttaatttttttaaaaaaaattaaaaatataagccaatatttatgttttattatctcataacaataaaactgttaattataaaaaaatttaaataaaacggagaaagtaagaaataagacggagggagtaacaagtgaaccgtgacagcgcacagaacatttcacctgaactctgacaacacaactgacattattccgtttgctccctgcagaaattagcctggcatgcagcagtggcctgagataacactattatctgaaagttattttttctcctaaattaagttgagtttaaattggaggtttagtatgaatgtattttatgcctaccatctatctctaataactgttttataaatttagagaacttttaagcccctttaaatcgtaggaatgaaaaaaatagaggaatagaaaaaatgtaggattataataagaatacaagtgcaaaaatagaaaattgtaaaatacagaaaaaacaaaagaatgaccatttgattgaaccgcagaaaaaacacaaaaatcgaatgagagaaatagactcgaaggaaggttttcaagaggttgaagttcttgctaaattttctcctaaatctccatagtatagtctattccataggaatttcaaaggatatgacatgattcgatcatttgtttcaaagggctttataggaaatttttctataggattagaatcctctaaaatttctatgttttttctccaaatcaaaagggcccttagttctgttttttatgggattttctatgtatatttccgctacatatatagctgcatctctgggcatgatcttcacaaggcacaagacatatattatatatttatattcccaaaaaggagaaaaggatgatccaatccaacatggcctccaagcaacaaacctgcattattagagagctgttcagatcatgaacagggaatagcaaaccaatcgcaggaccatacctctgccctgatctcttggtgtgctcttctctcttttgccgctgtaagcaagcacgctggatgcaagcagcactactgtgaaatggaccacatgtgattggacatcaaaggagagcgactgattggcgcgcatgttttcagcgaacttcttgtctgaaaacattcgtcgtctgacgggtagacttggatgtgttttttccttctgacagaaagtgttactgttcggtctatctcaacttgcaagaaaggagctgcaggttctgatttctgaagctctttttttttctcaggtaaagagcaacaaatgttcgtgtttcccagtctgatgacagtatataattactgttctaattcagttagcttagacaaccggtgaaaaattggttctaaatattccggaatggcctaaaggtcaagcatttgt

SEQ ID NO: 3778 - DNA, 16161 bp, Oryza sativa
  unsure (1)..(16161): unsure at all n locations
tgggttatgattgatcgtggctacgacgtagctattagttggtctcaactacattaattttgccatgcattatcaaactgacgcttgcctaatgctgctgaaaattttcaatgataggcctgcacccaaccttgcaacaaaactaagctagattagatgaaccatcacttgagcctagtcagatgcccataaaccgatcaagatatgaaaaaaataagcattgttcacaaaagagatcaagaagaaataagcagacaagcaggtacagtgacatcaagcacggaccgcaaagcctgaatgtatggtgtgcatgcataaaggcaatagaacttttgtgctatgctgcctcactgtttggctttacaggctctcccccctctgtttgctgctcatttcaaagctacaagatcaagcaaatctagagagagagagaggagaaagaaagaagaagctcagctaggttgccagataatgtttctttggtgaacaaaagctgcaaaaagatggtctcccccataaaaaaactcacaaaaagggggccatatcgcagattagagaatctcacaaccaaagtttcacaggagtgggcatgcaagcgtagcttcttttattttggagcacttcaaccaccgggcaaatctggactgtagccattgttatcttgggccctcggcaaattcatggaccggatttctagtacctgcttgcctggcatgcaatgcaatggttgattgtgaaatgctccaattttttctttatcattatattcagagaggagcactcgttcatgcatggagaaaaaggttgcagtttagagtttttgcaaagaagatgaatgtggataataattgcatcagaggagatgaacctatgaagcgatatgtagcgttaccttaaaaaactgccacaattttttgagtgaaaaactttcagacgtaactataatataactgaaatgtatttagatggtaactacactgttattgtgttgttgcttacattagaaaaatataacaagcgcatttacgcatttagacgaacaccattctagcttggcaccaaagattactacgttcttaagaaaaacactacctctgttgatttgaagatatattgtaattttaatattttgagactaaactttgaagattggtttttttaaatatattgttaataattatatgtcaaatattgtgagaaaattgcgatccctatggtccctacatcactactaaggggcgtgatatgggtggcgatccatcccaccagccaccactgttctccttccttactgctactggaaactgcatggctaaaaggatggcgccggtgatgcctcttcttcttccttcagcaggtaggggtggtgagctacggtttgggaggggggagggggggggggttaaccttgtcgggtcagctatgtgagtgagccagcttccacggtggtgaaggaggcagctgtggcgactgcaggacagtgtcggatggatacgaggtctccttttctgaatctggaactatagcctatatctatatgactacctatccctcccatggagagggtggcccttgggatggggagaagatgtttcaactggataaagaatatagtttttatagcactccatgcgtgttcggctatttttttcttaattaaccatgcatttgtatgtttttcgagtccgttttttccgtaaactaggttaattcttttttcttcatataaaatataaaacatgaactccatgtcctccagcaaaaattaccttgaaaaaatattataagtaatttaaaatataaacatattgatatactttctaagcacttaatagtaggcgcacatgcacagatgtcattaatttatcgttatacaataataataaaattaagtaatatcatatttgtttggatttaaatacgaatccatctataatatcctgatagctgggtcctcaatcctcgacgttgtggcgttcatttcaaaaccgtatgtggacttgacagttggcaggccagagaggaacaaagtagagttgggcctccactagccggactagtcggcctcatactcatcttcaggaatatgtgtactgtatgtttaatcagcctaacatccttgactaaggtgaaaatagcttatgttgagcccatcatcctccagccgtccagcgatcgatggccccccaacacgtcaccatcgagccatcgaggtactcgtgtaaatcctctcgctcactttgtccccaccacaaaatgcgcagcccaaccggcaacaatgagcttgcttatagtccattaattatggttctgtcccaaaataaaagaatataacataatctaatacaatagattttgaaaaaaaagtcagatttgtggtattagattgtgtgacttgtaacacattcttattaaggttggtttattttgtaatggagggagtactactttttttttaagaacaattcagtactaccttcgtacgtttctttctagcatataaaacacaaattaatagagaatataaataacatatgtccttcaattaaactagcttattaagttgtgcgttcacgcaactgtaaccttcctctcttttagatgtattttcattttgtttatagtaataagtttaaatgtataatgataattaacaatgtaaacaagtgtgtgactctgtgtacgcaaacaagtgtgtgtacgatatcattaatttcacatgaagtgtagctgtaaagccatatatatctaaaccgtaatttatgataattgtattatactttaaatttgatttatttatctttatttataaatcataggaccctaaaccctgcacattcatttaaaatgaggggaatgaaagatctaaatgaggattatgggcatgagcctaaattaaccgaacaactcctatgaggagcaaacaaacaaacaaaaaaaaaagattacggcttgactcaaggagagatggtacactgaaaggaaaattttgatgcaaacaaaaaggaaattagagagcttaaggtattgcaatattgttcattgatggaaatattaacgtaaaagcatggacagataaaaattgaactactattacgacagtttggaagctagacaaaataaaagctatttgtgacaaattggaagctagataaaaacatgaggaccatacaatttagcattctgaaaaagttaatgaactaaatgcttataacagtattcttctaatatactgaacaattacagtcaaaattatatatgctaaaacttcaattacatgcatgactgaacatttggcaagagtccttatcgacaacttgatcttgtgaaaaattgttgtggttagaattaggtatgtgcatccaatttaggcattgtaaatcacatccaccatccgatttagtgaaggtatcaccaataggggtgaaaacggagcgaatacggacggataatgctcttaccgtatccgttttcatattgttaggcggatacggaaacgaatacgaataactcggatacggaaacgaatacgaattatcgcggatacgaataaggatcgaatatgatcggacacgaatacgaaaacgaatatttctcggaatatagagaccactcaaactgctcgtagatacaaatgcaccacatatatttatctaatttaatataaatatcatcgttgtaggacgcatcacagattaaacaaagtgtatcgtgttcaaatcgaaacacgttgaaaagttcaacacatattgagttctagttctataggtaacaaagataagatcaaaatagtaattagcccaaagcaattttcagtacacttgcagtccgatgcatgaaaactgcaacatcattattcatccatttcatccatcagaatatcatcctattccatgttgtcggtgacatggggccggaggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgccctgaccccctgtggttttggcgccacgtgtgtgggttaggtgagcacagcgggttcacctaaccgcatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcggcctgtcacacgcctcgccccgtcccgtcggaatgatgaaagcttcctggctctcgtccctagccggagccggcatgccaactccaggagttggtatgtcagtcccggtcagatccattccaggcttcagtgcaagtatggcaaggaagtcgctggccattaaatgaaggttgaaatgggcgtccaccggaaaagcgggcgagcggggcaggaggcgtatgctctgcttgtcagaggtcatttccggctgtagactagccctcattgtaaaaagcatgtttcccttcttaggcagctagaggcccatgtggtgacccctgaccagataaaaaggagacccaggcctaagaaagaaaaaaaaaagaggagaagagaggaggggagttgggactctggcgaatggtttctagagcctgaactctctctcgctctcggctctctggattccttcactcacagatccaccagaacacaggagtagggtgttacgcttctcagcggcccgaacctgtctacgtcgcccgtgtcttgtgcatttcctttctcgctgacgttcctcagatcgagggcgaagaacctcacttagcgtccccggccgaaccggcaaaggggggcctgcgcggtctcccggtgaggagccccacgctccgtcatctggcgcgccaggtagggggcgcgcgtgtctttctaagcccttgtcctctttcgtgtgcgccaagcttctcccgctcagcccaatggccgaacgggcagtggcgcacagcctctctccgaacgctagcggtgacgactgggagcagaacccgcaccatcgggctcgcaccccaccgtccccctctcgccgaaatcttgggcggggggaggcgctcggggaggtcggaggatccgcgacttcgccgcccgcgggcgacgggggagggcggcgagacggggcgcgtcgccgcctcgtctacggcgatggcggcacgccctagggcgcgctccaggctgcgggcgcgctcctgcgtcacccgcccgtcgtccccgatccagagactccagcccgacgttggctggatgatgtggccgacttggtcatgacggcgcagcagcgcctaggcgccggcgggcggtcctctgccaccgaggcctctggcgctgccgccgccggctccacgtcgtcgaggcggagggcgcggcgagcggcggccgttacccgccgttcgtccgccattccttcgtcaacgcctccgacccaagaagatgtgcgtggggggccggatgcccgcctcgatatcgagcgccggcgtgacactcgtcgcgccgcccacgcaacggagggcgcttcctcgtccggagcgccacttcggtccgggcacgggggccggccccccgtgtccccggttggcggtaccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgggaggatttgtgccagcagttcaccacgaacttccagggcatatatctgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagattgcctccaaggagccccagaccaccgcgcagctttttgagctcgcggaccgtgtggctcgcaaggaggaggcctggacctggaactcctccggttctggtgtggcagctctggccgcccccgtgtccgccactcggtcagggcggcgggacaggaggaggaagaaggggccggcccgttctgacgacgagggtcatgtcctcgccgtcgagggtgcttcgcgggccccccgaaaggggaggcctgcgagcgacaaaaagaaggaggccggcgctcccagcagggagcgcccaaccggcaagtggtgtaccgtgcacaacacccccctccacgacctcgcggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgacgatggcgacgatgacctggggttccaggagcctgaggccaccgtcgccaccgtcgatgggggagcatgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagattgcgatggtggtttcccccaccgtttgcaatgtgaagttggggcgtgtcctcatagacgggggtgcagccctcaacatcctttcccccgtagcctttgacgccatcaaggccccggggatggtgctccggccgtcccagccgatcatcggtgtgacgtcggggcacacctggccgctgggtcatatcgacctcctggtcaccttcggtggttccgccaacttccgcacggagcaggtggacttcgatgtggcggacctcagtctgccctacaacgcggtcctggggaggcccgcattggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcgccacctccgtcccggccgccccaaggcagcggatggtcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagattggcggacatgcccggggtccccagggaggtgattgagcaccgtctcgccgtgcggccgggcgcaaggccggtccggcagaaagtacggcggcaggccccagaacgtcaagccttcatccgcgaggaggtggcgcgacttctggaggccggattcatccgtgaggtcatccatccggagtggctggtgaccccggtcatcgttcccaaggcgaacggcaagcttcggatgtgcatcgactacaccgaccttaacaaggcatgtcctaaggacccttaccccctgtcacgcatagatcagattgtcgactccaccgcggggtgcgaccttttgtgttttctagatgcatactctggttatcatcagattcgcatggctagggaggacgaggaaaaaactgcattcattacccccataggaacttattgttacaccacaatgcccttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccctagcaagcttagggatgtgcagtgcgtcaccggctgcatggccgccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcctggtcgccccggagccagatgagccgttgttactctacctggcggcagccccgcaggtggtcagcgcggcgttggtcgtggagcgcgacgaggacaaccctcactccgcgcatccccaccctgcgtcgactcgacccgggagagagcagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtgcgccccgcgtggcctctcggacgaagagcgccctggagatgcggcccctggcgaagaggatcggccccgccgaaaggtgcagcggcctgtctacttcgttagtgaggccctccgggacgccaagacccgataccctcaggcccagaagatgctttacgctattctggtggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcactgactttgtggcggagtggaccccagctcccgagcccgtctccgcccccgaggccagctcgggcacatcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactctcagttggtcgttaaccaggtctataaggagtaccggtgctctgacccgcagatggacgcttacgtgcgccaggtgcggcgtatggagcgccacttcgacgggatagagcttcggcacgtgcccagacgggataacgcggtcgccgacgaactctcaaggctcgcttcctcgcgagcccagaccccaccgggcgcctttgaagaaaggctcgcccagccgtcggcgcgacccgaccccctaggggagacggacgcgcctgaacggcccccgaggcccatcggagtccaggcctcgggacccgaggggagcgctcccagctcccctagattgattgcttggaccactgagatccagacgtacctcgcagataagactctacccgaggaccgcgaagggagtgaacgcgtccggcgcatctccaagcgctacgtgctggtggaagggaccctctatcggcgtgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatcagtatgtcgctgtcgacaagttcactaagtggcccgaggcttatccggtcatcaagatcgataagcactccgcccttaaattcatcaggggcatcactgctcggtttggggtgcctaaccgtatcattacgaataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgtctttcttcctcgtctacggcgcggaggcggtcctcccatctgagctcaccctgaggtcccctcgggtcaccatgtattgcgaggctgatcaagatcagctttgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctacctaacccgtggaacatcgaacaccttcgtcgcttctacccctagtgggggtcgggtgtcatgtctcgggctcgggccaaccccgcacccctctccggggcgtgcagggttggccgggggctaccacatgcatatacttaccttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagccccgacccgcgccgtttgaggctggaacctgggcacgagcccttgttcaagccaagacacagaaggaccgcggcacagaccatcctcgtctcatacacacaacaaacagagctgacgcagaaatttcctctttacttgattacagattaaatcagtctatacaagaagggggcccgaaggcctcggaagaagaagcaaaagttattaagactggcgggggcctggggcctcactccgacgcgcccgggtcgtcggcctcgtcgtcgctgtcgtccgcaccgtcgtcaccgccctcctcgtcggagtcgagcgcgaacgcgagccgaggggctgtaccctcgaagctgtggacgatgtggtcggcggcgtcccggacctgcgcgcgcgcgtcgtcctcggttccgggagggaactcttccagcgctgcccacggggagaagtcagggtccctggcctggtagcttgccagtacaagctccaccgccccctgggcgaggtccctcgaggatgacttgatcgtctcctcgagctcctcgggaagccgctcgagggccccggtcatctctgagaggcgctaggcgaggcccccctggttggcggcgtacttcgcgtgccgcccgccccagaggcccgcctgccgcccggcgcggtctagacgggagacggcgtcccgaagtatgccgggccctacttcgctcgccaagcagagggcctcgacctccccggcggacgagtccagcgccctgcagctcggcgatggtgtgttcggcggctgcgaggcgggcgactaggtcgccgtggcccgcggccgccccgccgctgcgcgctctcccgtccaactccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagctcgcccccgctcggtgagcgcgtcctcgcggaagcggagtgcggactcctcttcggcgcaggcggcctcgtgcgccgccagtgttgcctcccgggtggcgacggcggcctcgcggtccgccaggtctctctccttcgcgtccagggcgcgggcgcgctccttcagcgccgtggcgcgagcctcaagggcctcttcgcgccgccgggacgccgcctcgttctccgccgcccgccgttcccgggcagcggcggcgtcaaggactccccgggcggcgtcgagcttctcctccagctccgccgccaggctcccgtattggaggcggaggtcgttccgcgcctcatcgagcacggcggtggcgatgagggcagtctcccgctcctcctccacctcccggcgatctccgccaggtccctacgacgggcctcgagctgtgaggcgtgccggcggtgtgccttgcgacccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaagggctccgcgctcagtggggcagcggaaggccgaggggagagccccctcggtgtgggtgccgcgcggctcggcccgccgatcgacgtgccggactcgggggcgccccccgaacctggctcgtcccaagcgtcgcccgaggggtcgggcccgagcggcgcgcccgcggcctcgtcgtgggtggcctctgaagtcgtcgtcgcctcgggcggagtcgagtcgggggtttggcaggccgcctggcgtgcgcgcgccgcctctgccacccggacggactccccggcccggcggagtctggcctcctcccgagcggcctcctcagcctggcgaactcggacggcctcctgggcagcctcctcggcttcccggaggcggtccgcggcttctcgccggtcagcttcccgcctccgggcctccgcggtcaccgtctcctcggcctcagaccgaccggacttggaatggcggggggggggggagggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccaccttgggggcgagatgaggttctgtcacgccctgaagtgacaggttcccccggcatggtacgatccctcccatcttgcggagccgtttcttctttcgctccccctcgggctgcggcgtcggcacggctccctccgggcgcctgctgctggcacgcaccgccccgccccctcggggaggagatgggggaggagtaccctcctgcttcctcttcccccgggcgtcggcagggcggctaccccccgggcccccgtcgcggggcccagaagcacgaccccctcccggggtagattgttcccccctgcggctcccgcccgtgccatcgtggcctcggggggcccgctcccccgacgccccgaccacctgcatgatggtcaggatcttggcgcgctctggatcgcagcagagggggaggaccccttgggggatgagggatgcctccacggagctgagatttagcacccgttggaccaccatactgaagtcctcagggtcctagtcccatttgcgcccctggtgggtcctcatgtagtcctcaggcccggtgtactcccaggcgccccgggcgcgccgctggagcggcgcgatccggcgacgaaggtagtctccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcctcgccgaggggggtgtagaaccaatcgctcttccagtcgtcccactttttgcggaggacgcatggaatgtagcggttcagcacctgaccccgcggctggaagtagcagccaccgactgccgtcggcggcgacaccggctgtacggtgaagaaccaccggaacagccggagagatgggcgcaccctgataaacatctcgcacaggtgcgcaaagatggccaacgtcattatcgcgttgggggtgaggtgcgccatctggagatcataaaactccagaatatccatgaaaaaaatagagaatggcgggaccagccccgccattgcgaaagagaggaagaagacggaccaccccgggtagtgtggcgccgggcgtcccttgcccagcgcgaccacctcccgaccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcaccagaaacgaagagttagagcacaagtggcgaaggcaaggggaagagtggcgagaggaaagaaacgaatccctccctcggcgtctttacacccttgaaaacgctatgcccggctcctcgattcccgcgcccactacctcgcccccttgtttctcgcgcccacgcctccactaaccccgctcgcccgtttgcggcgcacgcggcagatgtgcggccgtggcggtcgagatggggcagatcgtgcgcgcattaactacgcccgccaaccgtgaaatgcgccgtcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatgaggccgggggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgccctgaccccctatggttttggcgccacgtgtgtgggttaggtgagcacagcgggttcacctaaccgcatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcggcctatcacacgcctcgccccgtcccgtcggaatgatgaaagcttcctggctctcgtccctagccggagccggcatgccaactccaggagttggtatgtcagtcccggtcagatccattccaggcttcagtgcaagtatggcaaggaagtcgctggccattaaatgaaggttgaaatgggcgtccaccgaaaaagcgcccgagcggggcaggaggcgtatgctctgcataacaaaaggtcatttccggctgtagaaaaaccctcattgtaaaaagcatgtttgcgtcttgttagccaatggacntgatgngctggttgcatacgaagtcggtcaccaatcccgccg

SEQ ID NO: 3779 - DNA, 5124 bp, Oryza sativa
  unsure (1)..(5124): unsure at all n locations
atgggggtcccccaaataaacggccaaccggccagaaaggtgtatctttgctttgaagagttcattccggcttgtagacaagccctccatgtaaaagagaatgtttcccttcttaggcagcataagggcccatggtgttgccccctgcccagattaaaaagaagacccaggcctaagaaagaaaaaaaaatagtagaagacaggaggggagttggaactctggcaaatggtttctagagcttgaactttctttcgcttttggctctctgaattccttcactcacagatcccccagaacataggagtagggtgttacgcttctcagcggcccgaacctgtctacgtcgcccgtgtcttgtgcatttcctttctcgctgacgttcctcagatcgagggcgaagaacctcacttagcgcccccgcccgaaccggcaaaggggggcctgcgcggtctcccggtgaggagccccacgctccgtcacatgtcatcattattctcctctttttcctacaggagtcgaataatattgttgttatattaagaaaaatattcatagaggtaaaataagaaaatagctcaccactatcaataagtttgccagatgcctctctacgctttcaatgtccaactcattgatgatagcctgagtcttataacctaagaatgatgccagatcagatcatggatcagctatacatatattgatatatacaaaaaggaatggccaaataagcaatgaacacagacacaaagtgtaccattgttagctgctttaatccaatctttggtgcaaactaaagcttgcacagcctctggatcaagacgggtgcgaaatggatcaacaacacggccaccagcactaaatgccgactcagaagcaacagttgacacttgaatacataagaaatcacgagcaagtttgcagaggataggaaattctgcttgtttgagcttccaccaagacaaaatatcaaatggatctttggaagtccatagtaacagtggttgttccatgtaaatttgtaactcggttttatcactacaaattggctgacttctctcaagcaaaaatctttgaaaatgttgctcatgatcatggctactgtcattctcattaaagatatcatcaaactcatcagtattatgaacaggatcagattgaatttgaagttgatgcacatgcatttcagcacctttcttctttgatgttgcacacgcactagtagcataaacatcaaacaattttttgataaccccattgaactcatcaaatttttctgcagcttctaaaccataaatcttcataccatagtactctattgaacttgttttgtaacgtggatcaaggaagtatgcaacagcaagagccatattcgacttctcccagtacttatcatatttagtttgcatggcgtttgccatggtttttattgttccatctgtactgttacaccaatcagcaatataaagcttgatggaacaaaatttaccgaaaaaatgatttgctgttggatatgtagtaccagagaatagttcagttgcttcatgaaatggcttcaagcacttgcatagtgctattgccatagaccagtctaccttggtgggagcacactttgcatactttctaccatgccgaagaaacaacctatcaaaagcatttctgtagtagatagcattcttcaacatgagaaatgtggagttccatcttataggagtatccatggaaaggccctttgtgttatccaaactaacttccaaggcacacttctgaaatgcctcaaactgcagtggcgagtgctttagaattgaaatagtatttctgatctttaatacagctcctgtgatttgtttcagaccatcttgtgcaacaaggttcaagatatgattgaaacatctcacatgaaagaagatgccatcgcaaattaaaggagagattttacggagttttaaaataacacccttaacacaaacatcattagacgatgcattgtccaaagtaagtccaacaagccttctatcaagattccaatcaactatgctgtcataaaactctttgcacatattacttcctgaatgatgtccttctacatgcataaacttaatgatcctcttttgcatcttccaagtgtcatctatccaatgaactgtgatgcacatataacttttattttggttagatgtccacatgtccatggttgtgctaaaacggcatgagagtgtaagcaaatgctgccacaatttcttcttttcctcttcatatatgtttataatatcctttctcacagtaatgcgactcttaattggaaaagtagggcgtaaatacttaataaaatccacaaagtaatcatgctcaacaatgttaaagggatactcatgcatgatgattgccatatagaactttttcaggctaaccgtctcatcatacctgtatgtctcaacagctccttcagtaccatcttcactctttttcatctgtagttgttgttgacctgacttgatgttgtgcttgttattcaagtgattccagaaaacagaagtgccacaattactctcacaccgacgtttatatgagcacttgttgcatttaacatactcctctacaatcacagtgtcatctgaccctttcttgcttaccttatatttagtgtagtgctgccaaacttcagaactacacttcttttgcttcttaccaggaggaggtaaaacctcaaaatcatcattggttgtcaaatcaattgcatcattgtgtgccaaggcaccagcagtaggagaagtgtcctgcgtagctgccgtagcatggcttggaggtgctgggagttgcaaaactggagattatgcagtggtacttgcagctgcacttgcactacttgcactaccagactccatcaccaatctagacacaaagtaaaaaaaagcacatccaagatctacatcagtttatcgatctcatgaaaggcacaaaacaaaggttacaggagaagaacaaatcaatggattacctaagagattagtgcatgcaagaggccttgccgccggcggtggtgacggctcctagcctcccactgtcccacgatttagggagataggaagcacaaacaagcactagggggattgaaggccaatgcccagcaactccagcaaggagccaaggagatctaagacagccgccgccactgtcgccggcttgccgctgccgtagtcaccaccgccgccgccgccgctgtcgcccatctggcagctagggtttagatagccgagagaaaactatgtgctgaaattgaagggatgggctggaggctggaaagacatcaagcgttacgcggatatccgcgcatcttaatctccggatattcggctccgtattcgtattcgccggaaactgcgttaccatattcgtatctatatccggagaaaaaatatccgtattcgtatccatattcgaactatccgaaaaaaatccgctccgaacactatccgtatccgtttttgaccggagcggacggaaactatccgctccgttttcacccctaatcaccaatgacaaacaacatggatacaaattaaaataacatccaccatcatccgatttagtgacaaacagcacggaaaaattaaaatcacactaaaatcaactttcacaaatgaatctttttccatggtgcttactgccgatttagtgccggggtttgagaggagagaaaggagcagaactggagaggttcagaccttgtctatgcatgaggtacggccgccaccgaagccctaccttatccttgtcgggatggggaagatcaaggcaccggtgtttctaatgaggaggcgcttgtgggaaggatagcaggtaccgcttcctatgggtcacggggaggagtaggaggaggtggcagcgacggcggggtgagcgggaagagtcggcagtgatgacatgggagaggagatgcctgtggtgaggaagaggaaggaggggaggctgcgacttgggagaaatggtggagcaggcggaggcactgaattcggcaacgacagctacactgagaaggagaagggggtgacactgagcagatgcggcgtgaagcagcaaacacacgagaatgcttttcttttctaagctagcgatgtggaagtacctttttgcgaaaagaagtttcttgaagaattgtgaaggtatatcttactagtaagagtatccggtggctcatatcatctatatgtgtaatcagacggtttatgtttatcggatgacgttgcgcaataaatttgtgaaaaatgactcctttcacttatttagataaggaacgattagaattgtaggatgattgaggtaagatggaaataattttaaataagaaacgattgatagaacaatagtacattagatgtgcacttattaggacaaaagtgctagaaatataattatacatatacagagggagtaagctgcaaacagcggtcgatttaacccaaatgttttttcctcacccaatcaataatcaaatttttttattgagaactaaaaaaatataataatcaattttttttgtgagttctgagatgcactcgatagtgcagtagcaagggtgtgtgatttaaatctcgaggtcttgtgtccaatcctcatcatgctcacaatttcttcttaaaaaatatttgaagatgcgtctctccctccaaatctcgtttagtgttcacgaaaaaaaattattgtgaggtctacaaattttatctctgggtttagtacattaggtatgtactccctctattttttttttttacataactttagtaaccaacaaaaaaaaatagagatagtattacaggagtgagctcgcacatgtgtacatctccatcgtgcacataataaaaggtggaaagatttgtgagaagtacatcttgtctgcatatcttggaggcgccaacgaagatgaccgtccgtgaggacaaacccttgtcctctgcccagtggtgtccccacgaccacgtacccttagccgacgaaacctccagctgccaaatgcgaatttctacgtaagatctctttgcttttgattgattcaatacagttcatatacggatcggtttattccatcaaaatcttgtggnctntaccagcagtccacgtgccat

SEQ ID NO: 3780 - DNA, 1637 bp, Oryza sativa
  unsure (1)..(1637): unsure at all n locations
tgggnttnnaaatgataacantgttacagnacnccatcacactgaagactcaatttagtactttaggtttcattttgtccatacaggtcatctaagtatttgttttggcttaaaatcatccttggacccacttgatttgccatatggctatttttagtcaacaattctattagaaagtgtcccttttgcctttaatttgtatacaactgtgcactagaaaaaagaaaacaaaaataaataaacaacattacatatgtatttcccattatttcaacatgtgcacatgaaacttgagcctaatggctatcgtatacacttgtaagtatataatttatttttgttttacataaattgctatgcattgtctataaaaagaattcattgtatgcaattgttttctcttacacacgcacgcgccgccaagcccgccgctcccgccagccgcgcgcatgctgctaaggccgccgccgagccgcgcgatgccgacggccgtgcccacaccggcttcgtccaggaaaatcttctgtactagtccaggaaaatcatttctctaatagtgaaaccgcgggtagctaacgtatattcacagtcaaatttgtttttttttcgttgagagatgtgaatgttgaatttgaacttgaatgtttgaggagtgatatatcacatattaatacatattctcaaattggtttaaatttttttcataaccatttgagagacatgcaaataacgaggggatattccctcaaggaataagttcactttaggtccctctatttgtcgactagtctgattttcgtccctgcaccataaaaccgggtacgacccatccccaacttacgaaaaccgggcaaacaaggtccctcggcggttttgatagcggttttgactaacgtggcgcctacgtggctaatttgactcggactttatctgacgtggcgcttacgtggcaattcgatcctgaaaaataagaaaacccgtaggacccacatgtcagtttcacacacaaaataataataaaaaagtgggacccatgtgggccccacatgtgatcctcgctcctccctccactctatatcctctccctcccctcttctctctatcccttctctctttccggtcgatggagcggggcgagcggcggccggcaaaagcgggcgacgggaggggcggggcagcgagcgagacaccgacggcgagagctcgaggtcaacccgaagaccagtctccagccacgcgcgcgccgcgcaacggggtccgacgccagtagcgccgccgccgccgacgcgatgggagtgctccgggcggcggtgcccctacagccggaggccgacctcgtcctggctaccggcggcggcgaacgggggcaggtggggctcgtcctcgtcgatggctccaacgggttctgcaccgtcggcaccgggaacctcgtgagctacctcccccacgcctctccctcttttctcctagtcctccttcgcccgtgccttaccgcgcgcgacgaggattgatggctggcgttggaacgcatggtggttgggctgctcgtgagccactccagagctgcaaatggtagagatcaaattttgtcaggcaccaaaagaggaccattctcatgtcagcgtgggcaaaaccat

SEQ ID NO: 3781 - DNA, 1431 bp, Oryza sativa
  unsure (1)..(1431): unsure at all n locations
gcgcccccnaatgattccataggacacacncatatgaacatagaacgagtttatacctctggttatgtagaggatgtgtgtgctgcatctgcgtaaaccgtaacatgaagtttatgctcaataatgaaattttatatgaacacatagtattcgaattcgactcacttgacatcacagtactatttttggccttacaacggaaggttgtaaagccagcccacctgaactcgaagcgtcatggtaatccactactggaaagatgaatccaagctttttagtatttcattatatcaaactctaatgcggcaaaggaactgtttctgtgatatattgtgtttttaagggataataagcagggtagcttcgttttacttttctgtacctttctatacccttctatttcactaagctctattttatactagtaccagttaacattgaagcaagaagttgatctattctgtctccctctcctgaagtttcttcccttttccctctcaaaaaaaaaaagaagaaaaaagcctctggccttgaccaccggtagttacagacaaatctacttatctaagatcatttctctgttttgtttgatgatgtgttaggtagctggcttttctagctgctatgtttggttttattcaattgaaattggtataataaataccaacttgacagctatggactgttgatttcatgtaactctgcatatcgattttcatgcactatctaatccatccaaagtgctcctagatttgtataagtgcattgaaaatatttgaagaagggagtgttagtttgatgtttcaaagtttttataaatcttgagccacatctgagaaccaattatccatactgtcattcttctttatatgtttattttcctcgacatttattaaaattcttggggaaaatttgtttttcaatacataatatgcacttaactttgttttatttgtttcagaatcaaacaataacgatttggctgaaatacggaatgacaatgttccagcttcaattccacaaaagcagaaaacttctaaagcagagaggcgtgctattcaggaagctcagcgtgctgctaaagctgctgccaaggaggcaggtaatatccttgttctcatcttctcatccccttccactcccttgtggggtgtgctgcagcataattataacattagtttggacctgtagggttatcaggaaagtctgcaggcactggttcaggggctaatcctgcaatgcccaagcaagccaaatcatcaaaagtttctcagaagaaagatgtgccccaagctgcatctactgctgcttctgagaagaaggttactgaacgtccttcagaaagagataggaagaaagatgcgcctcaccctcgtatgcagtttgatgatgtgcaccgggtggagaaagcaaaaaaacgtgcaattgtaa

SEQ ID NO: 3782 - DNA, 8365 bp, Oryza sativa
  unsure (1)..(8365): unsure at all n locations
ctgtannnattaganacttagtagccatgtgancancancgaattggataaattgattatcatcaattttggttgaatatgaataactcaacaggtattcactatgtttcaggttgggctccaatatttgtctggtgaggtttctggtggaaatggtcgttgtatagcaatgcttcttgcattccaagtggcaataaaagattactctacacctcccaaaaaaactctgagtagagatcttacagcgaaaatcagcagttatgtgtcgtttcttattgagtgcaggcctctgtcaattagcatgggcaatgctattaggtttttaaagaacaggattgccaagctaccactcacattgtcagaatcagaagccaaagccagtcttcaatctgatattgatcgattcattaatgaaaaaatagttgtggcagataaggttattgtcagtcatgctatcacaaaagtcagagacaatgatgtcttgctgacatatgggtcatcgtcagttgttgaaatgattctggatcatgctcatgaacttgggaggaagttccgtgttatagtggtagattctcgtcccaagcttgagggacaaggattactacgtagattagtggaaaagggcatcaactgcacgtatacacatattaatgccatctcatacatcatgcatgaagttacaagagttttcttgggtgcctcctcaatactatcaaatggaacagtttattctagagtcgggacagcatctgtggcaatggttgcacatgcatttggaattcctgttcttgtgtgctgtgaggcatacaaatttcatgagagggtgcaacttgattctatatgtgctaatgagcttggtatgtatatatcttttgaatttatgctttgtaactatttttttttaccatgcataagaatcataacacgagtcttttacccaggtgatccagatgtcattttgaaagttcctgggaaggcagatttgggccatcttaagaacttggcagacaatgaaaatctccaactgttaaatcttacgtatgtccttgaattccattttttttaagataatatgtccttgaattccataggtgacttgttttcttagttctgtcaatgttccctttgattgagataattttgcacattgataggtatgatgccaccccttctgactatgtgtcgatgatcataacagattatggaatggtaaaatacctttcacctctaattgcagtcatttacttgtcctatttgaagatattcatataagatgtccttttgcttagttttcctcacataagcatctggctgttgaattataggtgttagcaagccttttctatggatgttttttagcaacaaacatttttttcatcttttaagttgcacttgtatacttttttcctcaaaattaaatcttgcagaaaacattaattgatgccgattgcatgtactgaactacttcctccgtttcacaatgtaagactttctagcattgcctacattcatttagatgttaatgaatctagacatatgcatgagtttagattcattaacatatatttgtatatgggcaatgctagaaagtcttacattgtgaaacggagggagtaatatattctcttctacagttagacaaatgtcttttttatgccaacttttttagatttttatgaacaggaaaaattttattcaatcccttggaagtattatggttggtctatttaacccttgtaggcttgaattcagtactcttaccacctaaagaacaaaagccggtttaaataactccttagggtagttttgtaagtagttgtgagatgtaaacgaagatgtagcaggtggtggtgtctgctgaaccaatttcagccaaacaggctcggcttctcccatgtattgtctgcctggcagatacatgaatccatttctcccaaacaggcccagccgctccctttctttctccaattgttgagccagggaacatgtcaccactattgtgcttctacgagctgcctactagtcaaaacattatttaactgaatacatcgccaagctatcctactagtagttaaaaatatatttgaccgaatacattgtcatgtcattgcacttgtcatagcccatctggacaaaacctctttcaaagccacttacctttgatagtttggagatagattacctgttgatatttgtggtggtacatacctggtttactttaagggcccaagtagacattttcgttataaatatttaagatgatggctctcttatccggttcattgaattgctgatggggttgttttgctttgttccagcttccacccacaagtgtacctgtcattgtgagagagtatcgcaaagaacagctgtggatatagatgtactgcattatgacaacaattttggtaactgttgttggcttgctgcccaaagtgcgggatgcgtgaaacatgtacttctgtttgagagctctcagccgccaaaccttttttcttttgagcttatcaatttgtttgccacaagatggtccaattttgatatcaccatggctccgtctatgaagattgcactctggcacctctagaggggttatgttggtggtagtcatcaaacgttgtgatgcaactatgctcgtacctatgtcttcctgagcctcctctggtcatgcgcgtgatagtaactgggacctgagatgaattcgaagctatatttgtaacagtattcacctgtccaatacatcatgtagattggggggacttcgcgattacgcatgaggtatcgggatagggataggttgcggaaatctcatacgttgcctgagcacttcgcgatgcctataatttactagtaatattttgcaacttggggatagttagatacataccgattttcaagctgcatggaattatggtgacaagttcagagtttttattatgaaatcatacattcagtcactctcggcctggagtgaccgacttcgtacgttcactgaacttcggaacgactgaatcatgataatcgaacattataaaatcttcttgcagtaaaaacatgtttaaatcctagaattcagcatgatacagtgcacgaatatatcctgtggagcatgtcctcgcagctaaagtacaactcagaatacgaataaaaatggctataaataagcctataccacaatggatacctcgctacatgggcaaaacgatgaacaaaaactttccacgcaaagaacaatgtataaacggttgtctagattactggcatatttgctcaacggcagccacaatctgggcaggctgcacgacggtggcatcctccagaggcgcagcatacggcgtcggcacatcctgcgacgacaagcacatgatgggtgcgtcaaggtagtcccagaagttgtcgatgatggccgatctcaagctggcgccgatcccgcccgtgcgcatgcactcctccacaatcagcacgcggtgggtcttcttgatagagttgcctatggtgtgcaggtcaaatggcttcaacgacctgatgtcgatgacctcgggatcataccctttgttcaccagggtcttcgcagcctgcatcacatggtacctcatccgcgagtatgtgaggatggtaacatgttctccgggacgcaccatctcagcctcctccaggcatagaacatattcctcgtcgggaattttctccttcaggttgtacagaaggacgtgctcgaatagcaccacggggttctcgctccttatggcggctttcatcagacccttggcgttgtaaggggtagagcaagcaaccatctgaaggccggggatcgactgaaagtaagactccagacgctgggagtgctcagcaccaagctggcgaccaactccaccaggacctcggatcacgattgggattttgaactggccaccagaggtgtagtgaagcattccgcagttgtttgagatttggttgtaagcaaggagaaggaaacccatgttcattccttcaacaacaggcctcaaccccttcatcgctgctccaactcccatgccggtgaatgagttctcagcaataggggtatcaaggactcgtaggtctccaaacatctcagccagacctttggtcaccttgtaagaacctccatagtgaccgacatcttcaccaaagacacataccgttggatcttctttcatctcttctatcaaggcctcgcgaagagcctcaaacagtaagacctcatgactgaataaaagttacagaattaggaatttgccttagattacatattctatgcactgaaatgttatttatttggataagataaaaaaaatcagaaatgtaacacctaaactagcacaagtgcacaacacatataagcattgtaatgaaccagggcaaatactgaattctgaataccagtgttaaccgattcgttacaggtaccgataatcctacagtcaacattacaaagtaaatgtaaaccaactaagcttgacagcctgaagcaattttttatgagtatatgcagcctatataatagcatggtaagtggccaattgggttggaaactaatctctctactttaatgtgtctgacgttgggagaactaaatgactggagggagtaacagaacagtttgtgtcacccggtgaggagcatattccactgagctcaatgtcaaatttgaatggctagacgttataaattctgtgctttccagccctatgtccattatatagattagtaatagccaaaggggaaaaaaactaaattcctaatttcttttttgcaatacaccaaacattggacatgtctacagtgcaggtaggagtataaggcagtatgcaagtcccatcagtgtttcaatcaaggcctaaattgatgcttccaaagtcattccctactcatatccaagaaaatatatgtcaaattgtgaatgccagccagcagcagaagccatagctgaaagctgatgggcaagtcagttgaatgttctactttgttgattgaaattcactttacagtggtctctactggtagtaaaatcaatctagacctttcatcttttcttatataataataataatgggccatatctatcctactactggtaatagacctcataaatctaaagaccgctataaaatactcctagtttctcggatgcttcaaacaatttcttcatgaactgtttctagtcataagttctctaacttcaattcttcatacaagcttagtaacattcaactagccccctgtatcaactttcaacgaacggaaggctgcaaaattgcatcacctaacgagcagaataacaagagcccaacccctaaacagatccaagctccaaaactggagtatagccccaacacacaatagactaagaccaacacaatccagccaaatcaaacccagattgagctgaatcgatcggtcttatgaacagaagaaataattgaacgcttggttaccgtatggattctgtactacacaattataaaattagaggggtgctgaattctttacccgtcagacttggaggaggccgcgctcgccggcgattccgccttggactgcacgcgagaagaaacacaaacaaacacaacatagagcagttcagtgaaaccatcagagcccagcagagcatcgtagcgaacggaagtatatcagctcagagagcagaacgtctcacgcaactgcaacggcggcccgcgccaccatccttccccccgcccgccgcgccgcgcacgatccggccgccgccgccacgcgcacgctcctcgccgctgcaagagcaaaacaaacaccacatgaatacacaataatcccacggaaccagcggagatccgacgagcaggggaggaaacctcgcttaccggaggctgatctgcggccagcggaggaggaggaggagaaggaggaggaggatcccacccgcggggcggcgtggagggaggaagcggccgccattgttgaggtcgggatctctctctctctctctctctttctcgggaggacgcgcaggcgatgggttggtggtccgctatataaaggtggggggaagtcttggggtggcggcggtggaggaatggaggcggcggcggcggtggcggagagaacgaggtgaggtaagagaggagaggacgagaaatggagagggagacgatgggctgtggaccgggtctatggacatgatggggggtggattttggttttgatctcggccgctggattttgatccactgtgtgagaatcttgaaaatggattgtttgctcatatgcacgtacgcacattcaaacactatgagatactggacttttatactccatccatccgtcccgaaatatttgatgccgttaacttttttaaacatatttaaccatttgtcttattcaaaaacttttatgaaatatgtaaaactatatgtatatataaaagtatatttaacaatgaatcaaattataggaaaagaattaataattacttaaatttttttaataagacgaacagtcaaacatgtttaaaaaaatcaacggcgttaaatatttagggacggagggaatatattataagattaacggagtaaacatatgcgtcttgttgttaatgggtatgtcgcctaccattaaaaataattagtcgtatatgtgagtatacatgtcaaatatcatatattatatacttgattatggataaataaaattttcaagaaataaatttaataaatggttttaagcaagtgatcttagtatcgcattagaagattgtttttaataaatatatgtatttttagaagtgtggattatcatctgcagtaataatcagatgaagaaaccgaaaagaacacggacataacgtaaggactcttggattaagcacggtccatgcgaaaatcctaacgagcgatcaatcgccccgcgtgatcaccccctcctccacgctacttttctattttagtaaatttatacacctcaagtttacacatctaaaattcatacacataatctaaaatttatacacataaagattagagacccaaagtttataagttaaaagtttatatatccgattcaaatttaaatttgaattcaaatattttttatatgtagtatttctatacatctaaagtttatagacccaaagtttataagtcaaaagtttacccgattcaaatttaaatttaaatttaaatatttttatatatagtatttctatacataaatttttctaactttattattttttattttttaaaaaatttttgtggtgtagtaggaagagaagaaggggaggaggaagagggagaggagcgtattggtggggggatgggaatgatcgctgtgggcgatcacccgtccattagtgtcacccaacgcccggtccatatatatatgtctaattatgagattatttttagattggatgtacaacacgagcccctttgaattggcctcctccctccttgtctcttctcctcctaagctaggccaccattagaaacacccttttgctccaacttcgtaaccactctgacttttatgttctcgtctctgaccctgttcactgacgtcctataaccccataattccaacggtattatcaccaactcattacctaccattgtcttccatcgactacgaacatccctctaaacatgagaaaacaccttattccccatcatcaccgtcaaaaagttgccaccgtttcgctggtgagttacattgatacctcctcctccctcttgcccacttacggcttgcctaaattcagtgttcccatgatgaaacctaaaaaaccatataatgatgagttgagaaaaaatggttattgttttttctttcttaaagagtacaccctccgtaaaaaaatatatataaatcctagctatatacatggaccaggtttataattaggattgttttttaggatggagagtacatttgaaagcgcacaaacactatccagacaacaccacaacatttaaacaccgagcgtcaacacacacttatactttttccataaaaaaaaacctagatgaggtgtaacaccacctcaacgaatctggatataaggttgtcaagattcgttatcttaggtgatatttgcattggtttttccgaggccaaagggagtacgacccactcgacgcgagcgtgtgctcaaaaaattggtggacaatgacgtcccttccaaacatgtatcagtttctgacttgaatttggactctctcgaatggtaagtttaggcacatgactcatgaggtcacaattaactattaccatgacattaccagttgcatacaaatatgtttgagtaaaatgcaccagcggacattaacttgggtggnngtctatgcgactgctctaatttnnacagtca

SEQ ID NO: 3783 - DNA, 4781 bp, Oryza sativa
  unsure (1)..(4781): unsure at all n locations
cgggttgagtgtcacattatgatagaacatacatgctncccgctctatgcatagccggtatccgttaggccttatgcctagcagtccacgggtatccgtgaattcattatccttacaccattagcacgatgcgaagccttacctgttatacccacccgtttttgataccctttatagtttacgtttacctatcacctatgacatcatttttatactaccctggtttttcgttgtcgagtaatgctttgcattccaagcatccaaagaattagtgtaagtatcccaatagggttgaatttccgtatggttgggtgtgcccggcctgtatgttttatggcctataataataagagtttttgcgtgggaagcggtccgttccattaaagtcgtttgcgggcttacctgcccgctccgaaaaaacgtcggttggagcggcgtatttcccgggtagggagtattcgcctgctcgggagtcgagatagaaaaggttagcgtgcgtgtgggcgtgcgtttccgtagcgtgtaacatggaaagtctggtgcattttactcaatatcttttcatgctgcaacttatacttctaagagttaccataaaagttatttaacacatattagaactctgacggtatcaattctgcaacaaaaagattatatatactagatgaaaaacaggtatatccgcatgaaaacaaacagctatagtagtaggcaaggttatgtttcttatctgagttgttaaaaatgtgtatatatggaccgagtgcaggccaattgggtcagtgtggaaggacctcaatggtcagcctcggtctcatcgatgctaaaaccttgtggccttggcctcatccacctaggccaagtggcactaccctttcaacaaagtgttgctgaatttttcagtcttttgtcttgagtttcatcttgcagaactgagaaatgacaggcaagagagctgtttagtgaagggaaaaaggcaaaatatttgtcaccagcaaccacactatttcaaatattactgcaaatattaatgggtgaatagctaatttagttcctcaagcttcactgaagactcaatttagtactttaggtttcattttgtccatacaggtcatctaagtatttgttttggcttaaaatcatccttggacccacttgatttgccatatggctatttttagtcaacaattctattagaaagtgtcccttttgcctttaatttgtatacaactgtacactagaaaaaagaaaacaaaaataaataaacaacattacatatgtatttcccattatttcaacatgtgcacatgaaacttgagcctaatggctatcgtatacacttgtaagtatataatttatttttgttttacataaattgctatgcattgtctataaaaagaattcattgtatgcaattgttttctcttatatatgtgaatgagggggtataagtgacatttatcaagagaattgttggttatgtgggttcaaggataagtttgaattaaaataaaaacttgaagaagtaatatgaacagattgaaacattaaggactaagccgatccttgtatgaaacttggaggacatctttggctattcacccaatagattatggactaagctgatccttgtatgaaacttggaggacatttttggctattcacccaatagtaatctagagagaaacttttaccacttcaaacaagtactagtatgtttttcgccaaagcattttaatgatacttttctttactaacaaattactccctccagtaatacatatatgacatttagaacaatatttgatcaaattttttaaacaaccatcaacagtttacgagtttcttagtttaaaaaggaaaaaatggtatgcacaaatttgcctaaaaaatcattataataatatcagaagctaactgaatttaacaaaatattctaatacgaatttgatagtcaaagtctttttaaaaaagttaaccaaatcttgtcctaaacatcatttgttttaggaccagagtactacacaaacataaaaaatgacaacttggtgctcttgaaagaaagatcaacaacgcatcttcaaacttaaggaaagagcttgaaaataacccaacaattccaaggaacatatttacagagactatcaaacctgaactacagtagctagaagtaagaacagtggaatactacttattccattaatccagcacatgacaaattgataatgtctccaaggctgcgggcaatacatcatctgagctacaagagagcacggccaggctaatccaaccatggctagtcctacagaaagcaccaaagtttcagcacatgtttttagtgcatcacaagtcacaactcgaacaacattaacaacagcagcagtagaaggtgacacaagccacccagcatcccgacggcctcgtagccccggcgaccaccatttcttcccctaaccctcatcgccactccgccgggctggtacgccatgccggggttccaccctgccggtatggcgttgctggcaacaaacatctggccggagctgaacgtcaggcggacggagaacgggccctgcagggcggagccggagttgagcctccacactgcgccccatgactgctgcatcggaatccatgaccccgaagcaccagcaccaatcggcatgatgtcgacagccgcaaggtcactgtcgttgtcatcgtactccaccagcagggccaggtagttcgggttggagccagagtccacgacaaaggttagccctactccagtccattcacactccacactgtacaccacaaaagtaacagaaaagattaaacatactgtttgttacatgatgagaaacatagcgaaaaccagacagtttgcatatctgcgtgaagtgtcatatgtacttggccgttgcagcagccaagaataatagtgtagctgagtgcctgtgtactatatatgatgatccattattcatgtgtaccgggtgtactgaatttggaggaggccagcaccacggagttgatcagcctggccaggcctcgccatggcaccgaatgctgtcccgctcatgtcaaagtgagctgcttcattcatgcattgaccatcgactagctcttccaagcatgggccaccaggcccctggtcagtgatgacaacggttacagggataccagagcaagcttcattaccagcacacaccacctgataaatcagttatttccaaatgtcaaatggcagacatgcatgaatgagcatagcttcagctgctaatggtcaatggatacacacccggtagcacgaaccacatcccttgccagagtcatagatgtaggggctaccagcagcaatcctggatgagaacggtggctggtcaacagcatactggtacccacatgcaccgcctacaacaaatttatgcatgagacatcacattttcgcaccacaagccgctttgagtagagtgcgtatattcacagattttattttttgtggtatctaccataccttcacttcctgcaccattaggatcgccataccatgtagcaatgccattcgaccagccagagagctcacggtggagctcaatggacgtgcaaggttggaacaccgaagcgagcactgtaatggcaatgaagtacaagagctgaagcctggaagccatgtgctgcactctgtcacattatggctgataaggactaacacactgttggtttgcaaggtcaacaacacaagtatagattgtatgatatgtattcaatgggcatattttgtgctggaggtaatgaagaacaggacagcaagaaaggttattgttttggcttcaattgcgcctcagaacataattcacagcattgagaatgttttcataacaacacttcactgagttctcattaaaaaaacactccactgaagaaaatgaaaatgccataaatgtggtacagctgttttctgaagttagaataaaaaatggattttaaggagatgatagacaagaagggcaatgtgccgtgaattacaaaaagttgttgtcatggattatggcaaacatgtaaaggagggtgttagaaaatttccaattactgatgaccattgtcagctgattaacctttagtttctactttacgatttgtcaccattacccaaaaacatagcacctagctactaaccaaaagaaacacatgcccaaccttaaataattatgtcttgaagaagtttcgagagcatactgtttaagtccaaagagcaaatggcacagtaagccattactccattgattgaaaaaggcataccgatcatgttatattcagttcgttttctaaatagaaagatagaaatgacaaagttttattcgctaacagtactacacaaaatgaaatatgaaacactattcatgaagactaccaacagaacagcaaatgtttgagaaaaaaaatacaagcattacttcctccgttttacaatgtaagtcattctagcatttcccacattcatattgatattaatgaatctagacatatatatctatcccatattcatattgatgttaatgaatctagacatatatgctagaatgacttacattgtaaaaaggagggagtatcacctagacaaaatacaatgctttgatgaagtactgtaccagtggaaatcaaanntnaacatttttttgtgttttttnttgaggagaggataaccaactggtgcatatcggagtntaaagtcgagtaaangggagaggganagtgatattatgagtaanagagatacgataatcgtcgatgaa

SEQ ID NO: 3784 - DNA, 43662 bp, Oryza sativa
  unsure (1)..(43662): unsure at all n locations
ttggctggttttctcactaagcatcttgataagcattggtccacgttatcttgtgtttttccaaagtcatattttagtttatgcgtatcagcatagtcgcgtagaagtaaaccattatgccaagattgttctcctgctgtatcacggttcaacgagagtaccagttgaatagaacctgtctctattggtataatcgttgtattagctacctcagaagaaccgctattcaactgtctgtgcttggtgtaagtactaggtagttgtatatttacctgtccattcacatccaaatatgtgaacccgtcagaagatgggttaagtgtatacccttctagaacaatcacctattgtctatttagtagtgcaactgctctattttttttttaacgtaatggtgttagtggggggggcatcgtgctgcatcctcttaccgatggggctcgaaggccgccatgcgcaggcgctgcggatccaccaccaccactttcacctgcccactcaagaacacagcagagttcagcacattgcagtagctaataaagccaacgactcgaatcagcaagcacgcaactgcaactgcaacggccgtccgctcctccagcttccctccgccgcttttgtccctcgccacccgcacgcccctcgtcgctgcagagagagaaagagagagagagccggaaaatgtgatccgactgagggaaaaaaaatccagcggagaatgagctagcggcctcgcggggtggcagcgggagagcgtacctgaggcggatccggaggcggcagaggccacgcgaggggcggcggccggcattgggggtgggagtgcgtggcgaagctgcggaggtagcgagactgaagtgacgggggcagtggacactgtagttgtagagtagtggtggtttgggttggctggccagggctagagatggtaaattagtaatttcaccatgcaacctcattgggataaactaatcagggattatggatttagggagcaggaggggacgagatggtcatgcgggtgcgggctcgacggtcggcctcggtagcataggcccgaccacgtgtgctcgccacggcatgcgcgctcgctcgcccgcgtagctcggcccctcggcgcgcacggtgatgcggcgttttcttggtgcgggcggtgggccactgcgtggacagaggacgggagagaccgaggggagtcgggattttggactatctgccatctccttcaacggcgcactctcaaatgcgagtgaggggaggttttaaggaggtttttaccctttatatttggaaaaaagtccacataaactcctaaactttagatgaaagtctgtctagcactctaaactttaaaaccggacattcaaccccctaaattttacagtaccgtttatataaccctctaatatagttttgcatagtggtttgtatctaatttatatataagttggatgagtttgctcacatgtcattcactttggacatatatattaaaattttgacttaaatctttctttttctccttattaactcttacttccaaacaaataccaacataataatagtatgatatcaccgtataagaataaattgatgacttataactgatgatatgcaaatatgttatattaattattcaaactattcgtttaagcttctaaaatatgtaaaaccatcatccaaaactacctttggagagtaatatggatggtacggcaaagtttagggggttggatgtctagatttaaagttagacgaacttccatctaaagttaggggggtatttggacttttttcttatatttgggttaattaaattcctatataagatttaagatacaaaatttaatatcgagtacattttagactgttttatagatgttttatgagcatattttttctctttaaaaaaactttatgagaatgtagttttagtcatgtaggaagtttcagagcaagaaggttcattcatgtataaagttagcaagttgtacttcctgcaaaaagttctataatttggatgttatactgatgtaaacttcacaacctttgatgtaaacaaagtttatatatacaaattttatgtacaagtacacagtttttttttataaattttatgagcacaaagttttttttaccaagtttatgagtataaagttttataatttgaatgtctgtttacttcaaagttgtgaaaattttcaatataaagtttttcaatacaaggttatggtttaaaataaagttgtgacaacggaaagtttttcaatctaaacttttgtgtgtactaagtttctattccaccataaagtttcaaaagaaaatttatactcataaacttttgtgtgtactaagtttcaattccaccatagaattgagtcatttgccaggaggaaagacaactgatgacttttgttgctatgcaaatttacagtgcatttccaattcgtttgaagtatgtactagtcatcaccttcagcatggccaatcaatattttttcaaagtctctgggtcactggatgtcttctttcagtatttttggatgtttttttttgcaggagtttacatcttgtcacgtgtgtgttcctgacttgaattttcgcagagggcaaagcaaggcttcgccaattagaacattgtggtattgagatgtcatagctttttaatatgttggatgtgcattactctttagtttctcgttttaaggtaggcatcgtaatcctgagttaaaaaaatataatcacatcgggtatatgccatttactctatgaattgatttgtggacttcagtattggattctacaacggttgtttctcgtgcaagaattaaccttctgtacctggattgtgagtgttttcccattgtttgtatgatttagctaaaacatcatatagttgtgcatatacagtgatcaattttttttcttaaattattgcataaacttgcacattttttcacaaggacaacaacatacagggtgaactgccaccaaacaatctcatccgcatgtatgacttcttttttttaaaaaaaaatcccctattttttttctgaagtttaaaagttacggatctttgatgtcaaaagtactttttatcacctttgaaagttttattcatactagttgaaaactaactcccgacctatttattatccctatttaccccctcacagaaagtaaaggataactcccttaaaattgtgaaagttataggtcctactagttacttcctccgtttcacaatgtgcatttcccacattcatattgatgttaatgaatcttaaataaatatatatgtttagattcattaacatcaatatgaatgtgaaaaatgctgaaataacttatattgtgaaacggagggagtaagaagtttttgattgattagtggaaatgttttctccttatgggtcagaagtttctttctatgggcctggaaacgcataaaagtagacaaaaaaaatcgcgtgaggagcacctatgacatcactacgaaagggaaaacgcttggagaacgtgttcgcgcacgacgtggtcgcacgaacggtggcgcaatagcctcctcccccgacgctcttgatctatttttaattcccatcgtgtgcacaaatctcaatgcggatttgatggccgaaaattcaaaactttcttctctaattttcttgctacgaatagcaattccgaaagtttgaagaattaagaaaaatagtgtgcgctagttcgctaaatagcagtccccttaccatatctatcaaaataatattatttactatctcgccaaattcaaaactactaactcactcctattttaagcacggttatggatttctatgtctaacgtttgattgtccatcttatataaaaaaattataaacattacagaaccacggtctttttacagacttattaatgttgagattatgggcatataatgatttaatttattccataaataaatcatgacattacagatgaaaactagtatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaatcgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgagcgagcgcgcgcgtgtttcccctcttctctccaccacacatgcttcaagtagctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttctgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccctgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtctcagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatataccaggcttcatcataaccattacaggcaagatattgtatgaagaagggcaaacatgcagattgttaaactgacacgtggtggacaagaatgaccggtttatgaccggtctgacaatggtcatgtcatcagcagacagccatgttcccacgtcgcgcctgcttccggcggaagtggaggtaggtataggccgtcccatcagaaggtcattcggacggcagccatacaaatctccgtccattaatgaagagaagtgaagttggagggaggagaggatgagtccccacacaaaagaaagagagggagagatggtgcatgtggtatccccttgagatataaaaggaggaccttgcccacttagagacgggaggaaacgatcccagaacgatcgggggctggctcgcactttgtagcttcttcatacacagatccaccaaaacacaggagtagggtattacgcttctcagcggcccgaacctgtatacatcgcccgtgtcttgtgctttttccactctcgcgaaccttccacacacagactaggagcttagaatctcacccagggcccccggccgaaccggcaaaggggggcctgcgcggtctcccggtgaggagccccaagctccgtcagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcacgagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgtcaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagacgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctatagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagattattgctagcatcagtagcaccgaatttagtattcagtgcatcccacaactccttagcgtcggtcatatgcatatacatctcgaccagacgatcgccaagaacgctaagaatgcatcccacaaagagagtagtggcttcctcgaattgcttctgctgttcagcagtaagaactcgttcaggtttgccagtactcacccagaagcatttcatagctgtcagcgacagagtgaccctgatctgccatctcttaaaatgcacaccggtgaatttatccggcctcagtgcatcggcaaaaccagccatagtaaaatcacagtgcctatgataaggtttttggattgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgttggtgcacgccggcgagcgggatggagtagtctacgagcgacggcgcatttgcagcaaaacaaaactgcaaaaggaagacctgctctcccgatcgctggtgcacgccggcgagcgggatggagtagtctacgagcgacggcgcatttgcagcaaaacaaaactgcaaaaggaggctgcatctgcgcaagggtgaggagccaatttttcggaccattcgacgcgtacgtcatgcacgcgcgccgcctgccctgccaggccaggcgaggcgagcgagcgcgtgtgtttcccctcttctctccaccacacatgcttcaagtggctaggagggcatcctcccttttaaggaggtccccctctcctagaataagcaaggtggtactaaactccacatgcatgccatcccatgagatgggcttttgtgattttctaaagaattaatctttgagtgggctaagacccattcattaattgcaacaattaaaatatcgtatcataaaatggaatacaagagacagcgtaagaaggtggtacaccatgccgccgaacatcccagcgatcccgtaaacccggaagccacggccggccgtcgccgcggcgccggcggagctctccaccggagacgacgacgtccctcctacggctgcccccgagccaccgccagccgcagcgcacggcggcgcgcccaggtagctcgcctgcgcgccgccgtacctttcccggccgacgcacagcttgtcgttgccccgcacgtcgaggcgcctgcccagccgcgccacgaactccgccggcagcgcgatctccccggccagccggttctggctcaggttgagccgccccagccgcggcagcgcggcgaggctcgccgggatcggcccgtcgagcctgttccggtcgagcgacagcgccgccaggctggccagcgcggcgaacgcgccgcgcgggatcggccccgtcaggccgcacccggacatgcccaccacctgcagccgccggagcgacccgaccaccgccgccggcaccgccgtgccgatggggttctcctgcaggagcaggtactgcagcttccccagcccggccatcgacgccggcagcggcccggcgagctcgttgtggctcaggtccaggaacaccagctcccgcagcgacccgacctccgccggcaccctcccggcgagctcgttgtggctcaggtcggccttctccagcatcctcaggctccccagcgccgccggcaagccgccggcgaggctgttccagctcaggtccaggatggacaggctctccatgcctccgatctcctccggaatctgcgcgcgccgaacgtacacgtgtcaccaccacgacatgtacacgtcgtacgagctcagtgacatgacacctacctcgccggtgaggttgttgtagctgaggtcgagctgctgcagcggggcgaggcggccgagctccggcgggatctcgccgcggaagccgttctgggacaggctaagcacgcgcaggctcctcaggtcgctcagcgtcgccgggatccggccggtgaggccggggttagacttgagcacgagctgctcgagggaggaggcgttggtgaagagcgccggcgggagctcgacggcggcggcggcggcggcggcctgatcgtcgtcggtgttgggaatcaaagcaactcacgcgaatacaggctacactttctgaacgaggcagagaggaagaaacagagaggaagaaacacaaacacataagcaaacacacaggagctttgcggcaccaaaacaacttgtgcccttttcactggttttttctcttaactaaatgattacaatgagcagctatttataacacagcacatacacacacgaagctggttgttccgcttctcgagccacacacgacgcccacgtcctgtttacttggccgcaacttcacaagtactgagtcctcgccgacgtcgttgcttgcaccacccaactaacctgcatgcatgcaaactgaccacatcctactcataatcttgtgcaagactcggctaatcactagcccacaattatgcatggctaactaactaagctacatacatgtgctctcatctcctggctttttattggctcactactcactgccaaccactactcactaagccatgcagcacccacgtacatatagctagctctccaggccatgcaatacacacatgcatatagataaacatgctgaaattaagaaacaacaagattaatttctaacagtcggcgacgacgaagcagccgaagagggagagcgtcttgaggtgggggagtcccaggagcacgggcgcggcgagcctggcgccgggcctgcacggcggggtggcgacgtcggggccgaagtggagcctggtggcgcgcaggtggcgggcgtcgtcgggggcgagctcgcactggagtcccggccatggcgtgtccgtgcagggacgccggtggagctgcggccacgtcgggtcgccgaggaggtcagccatcaccctacagatggcagccagttctgaccttggcagctacgccggcggcgcctccccggcgagctgcgcggcggtggacatggccatggcgccatggaggaagaagaggaagaaggagatggtcagcgaggcgagccaagcagccattggatttggtcgatggtctaccctaggcttgcaaacctgagaatctgagatggattcatggttttatagtacgaccacactcaagagtgtcacacacagtcatactgccacacagtgtatctctctctaatggtaaaaaggaagatttacttggtatagtagccttttgtactgtgtaatgtacggtttggatgatttgttgatcggatctatggcccttcacagttcttctacatggaggagttacctactgcgccagctcagattcacgcgtacatggcgctgagacccgcaccttcgctcggccgctcgccccctaactgggagacgtgttttctcgctgcaacgagggcgcgtggcgaaggaaactcgcactgtggaagtcattgcttcgattcggcgcgacctcgcctcctcctctttctccaccttcgcctcctctttctccaccttcgccgccgctcgtccagagaggtgaggtgagaggggagccggcaagggaggagaagagagatcaatccgcctcggcctcctcgaccgtcgccgctccggatccacgccgccgcctcggcctcctcgccatcaccgctctggatccacgccgccgcctcggcctcctcaaacaccgccgctccggatccgactagatcgagacggacaaggaggagaggagagttgctacctggcggcggcggcgtcgtctccgtcctctcgccagcgaagggaggaggggaggcccgcggaggaaggaggggaggctggcgacggcggagggaggagaggagagctggagaagagaggaggggagccggcaccggcggagggaggaggtggcctagctcgtcgatggtgcggggatgacgagaaaaagctgcacgtggggatgacttccctaatggagataaaggatgaccataagttctcggtctcgttatctcgtgtcaaatagcatttcccaaagacttggcataaatctgtctctctaaatatttgtttgactagctctttataaatttgactcttcatttttttatgctccaagaaactctctatttaagttctccgatataaccgtgggacacacatgtaaggttgtgttattcccctttctttcccaacccaccttcatcttttccgcgcgcacgtgttttaaattcttaaacaatatgtttattaaaaagttatctatagaaaagttgctttaaaaaatcatattaatccatttttaagttttttaggctaatacttaattaacacgcattaatgggtagcgtcattttccgtgctaggaggtggagtctgtttactcttcttcttcccaacaccactaaccaaaatcttcaactaaccactatattgactagcgcctccacggtggagcagcaacaataacatctgtcaaacaacaccgaggacccttacacgaacaactatatgaaggagatccaaggcaacaaagagaagactcggccgaactctggactattgtaccataggattataggtggccataaggcccgaggcccgatggcctggcccaggcacggcacgccctggttggggtcatgcccaggctggcccgacccggcagctaggccatgcctgggccgatgccttggcatggtgggctggcccggcacggcccgattcaatgaggaaggaagaaaattagtttagggactaaaattagatttaatgcagccatataattgggatgcaaaataaacttattacaatcatttagacatggccaaggatggaaattagactttttttatgaagaagcatgatgggctgtcgtgccttcgggccgacacggcacggcccggtttgttggtcgggccgtgccggcccgatagattctggcctgagcacggccgtgccgcccatatggccatctatacataggatgatttggaggagccgaagctcgggactctacgctgctagccaatctagagctccaatgttggcatcagggcttttcttccacggagtggatgctgtggggggtagtgacgaggacattattagatacgctcgcaactccacaagttctaatgacagtttcaagtccagttcgtcctctagatacaacactacaacactgatttcaaatggacatagcaccttcatgctaactctgatttggatgatctttgacttttttttcgaaagcttgtgttgtcacctgttgttaacaacggaacgcatccggcattgtatcaaatttttttatgagtcaacgggaatcgtcaaaacaagacagtgctattgctggaactgaatttgagtctttcggtcttgtaatagactggacccatcttgagtgtgtgtctatcctcctccactatccataatctatcccaagctctttttttctctataaatatctatgtacacccccaaaaaaaattaggttttgtttagctgaattttaccaagtgtcattcggtttgtctctagtcctgttcgtttagtcgatgactataaatttagagccccaataggccaatagttggtgtgttgatttaccgagtcgattagatctatcacttcagttgcaactattcctttgtgcttagttacctattcacgacatttagattgcatcttaccttgttcttgtagtattcttttgattgaatttcagggatcatcaaccgcgcgtcacggttggtatgacatcatttgttgtgaagcgaatgcatgacgtcctggacttgttttggttggttgccaagttgcaaaagtcgtattcgatcaaagcgagcgttatcccctcaccagaagatcgggtcgcacgagagagtgtcatcaggtgggccttcttccactaggagccttctaggtggatgcaagcggtggagctgggaggccgagaaaggtgacaacaacacagacaacggacaagaaggatgcaaccgatcgtgatgacttgttcggtgtcaaacagaggagcgaggcaactctattagcaccaaatgagaggatggacggaaggagagctcgatacgagtaagagagatagggagatgagctgagaacaaatagtgctaggaggaggagagacaataatcataggcaatcttggcaccccttggcggtttggcattagcatcatttgcacctcacattcgaatgaagtcccctctcctcttccaaccttctttttaaatcatgttgatttggtatcgaaatttgtggtataccctacttcgtttgtcctaatttttatctttagaattaaactctagttttgagatgagggtaaggcgagacggacaaatgtccttctcttgatctcctccatccctctcttcgaaccatattgaattggcattggattttcatgggaagtagacaaatcaaagtagatttccggcaatttgttctcatttttaggattaagttgtgcaagcatgcatgggagggaggttagcgctaacgggactagcgtcaacccttatccattttatcgagcacgaagtattagggtcttagtgtcaagataatttgtatggagacatttaacatccgtgccaatgattcttgccccccgagcttcggatctatttataaaataagttttgcgggtctctattatagagtgggtttattttttacatcaaatgtgaaaaatatctgggattaatactcccataagtgtggatcataaatgtggatgtgtattgttgtccaaatctaatcatgcgaaaactattgataacatttacatttaagcaagaattttggtagtccataattttttctattgcaaattatgcatgattgtatcttcataaatgtcttctttaaaggatgaaacttcaaagtatagtatctttatatccactgacaagatatcattactcgttgttgtgtttagttcacactaaagtttagaagtttggttgaaattggtacgatatgatataaaagttgtgtgtgtatgaaaggtttgatgtgatggaaagttagaagtttggaaaaaaaaactttggaactaaacaggccttaagcagatgctggaccagcccggctgcctctattaacaaactctatgaccaaatcactgtaaggcccaagtttagaaataaacatttttgtacttggtcacgaggctctttttgtcttaaaagacagattttgttgtagtgcctgtcataaacaagataaactggcagcacagggtacggtctgacactgacactgtgtcaccaagaggcatgaaattgtactgcaaaaatcgtcggaactcgaagacttaacagcgagtcgatctggtcaaaatccgccatagtataaactagacgtatttataggtaatatagttaagttcttgtcatacattttatatcaatttaagtgatcaaagcttaacactatcacctaacgaccattttgcgttgctagtaccttaaaacaattgcgcctcaccaaagtttcgataggatagcaaacttaacaccagggcaaagccacgatgtgctccgctagtgcattgggcacataataataataacaaaaaatcaccaaagcatgttctttcattgcacgtgtaattgaagtatatatattagagaaaagtacattttacccccttaacaactgcagttgaccgaaaaaccccccgaactcaaaaaccggtcatttctcaccctcaactatcaatactggatgaaaaacctcctgagcagctttgcaaacggttttggtctacgtggcagcccagtcagcaattcttttctttttaaatcagcgggtcccacatgtcagtctctcaccctctcttttacccacacctctctatctctccaaaatcctctctcttctctcttcctcaccttgaggacggcgtcctctctcttctctggcagagctcaaggcgacgaagggggcggcagagctcggggctgcggaagggacggcggaggagccaaggccggtgggcgggcgcggaggcggctgtgggcggcgggcgaggagccgaggctggtgcgggggccgaggcggctacgggcggcactcgttcggacggctagttgcggcggccggctacggaggaggaggcgcacgcactcggacggccgtcggccgaggcggtgctcgcccatgcggcgggcgaccgaggcggagctcgcccgggtgtccggcggcggtccgtccgctctccccctctctatcccaatctctccccctctctatcccattctctccccctctctctcttctccctcccctcaccggtggcgggcaggcgaggcagagctgctcgggcactggcggcgacggcgggcggctgagacagaggcggagtgggcggccgacggcgaaggcggagctccctgggcagctgagacggaggcggagggggcagccggtagcgtaggcataaagcgctctccgacctcttggtcctccccgccgcgaccttgtccgtccggaccactgccgacgccgtcgccttctcctcccggaccgcctccttagcacctccatctcaagcttcgccgccgacacctgtgagtcgtgttcgtgcccaccgcgccctccccaccacgcccaccgcatcccccagcagcgaagagagaaaagagagagaggggtgagccgaccagaggcacccatccgtgcccgtcgccgctcatcgccgaccagttcgtcctccctaccgcgcctgctgcctgcctgcttgcccaaccgcgtcggtcttgccacgttggactgccatgtgctcaagtctccggtcaaaaccgcccaaaagtatggttaagggggttaagtgtccggttttattagttgggggtttgaaatgaccggtttttgagttcgagggggttttttaagccaaccgcaatagttgggggggggtaaaatgtacttttctctatatattaagagtgtgatataaagaatgaaacataggataattcatattctagcttcgcccgtgcctaacccttcaccaaaactttactttcaccgtaagaaaagcaattttttcagactgccaaaacatatttgtgtgtgtgtgggccgcccgcctactggaaagtgtatgcaaaaaatgctatttttacgtatgggtggcgcacccgtacacaaaaatctagtttttgtgtttggatgcttacgtcgtctgcacgcgtggcacatgtggttactttgttaatctcaagatataccggatataccggcccaatcttttaaagatgctcataaggatataatatgagtgtgtgcatttataaagatgagtgtgcgtgtgttacgagtatctgtgtttgtattggatttaaacaattgcggcgtgcaatgcaacccgaatacaaactgcactacagacattgcacaaacgccaacacagctgttgccatggtcattcgggtttgtgtgataccagtccacttggagtgcaatccaatgtctgtagtgcagtttgtgtgataccagtccacttggatggacgacgcagagagcaggcgtgcattcggtagatggtaattggtagtcatgcaaatcggtagatcgatgcgacgccatgcattttcttgtgctgctcgtgttacatatgtaatctcaccaagttactttcgtaaaattttaaatagttttatttagaataaaatcgaaacacctttacattctaaatgtaacgggtggagtattactgtacaagtgtatacgtgcgcgcgtgcgcgcgcgtccacggtatactgaagtactacttcatattctaatgtataacgccgttgacttttttccaacgtttgaccattcgtcttattaaaaaatttatataattattatttattttattatgatttgatttatcatcaaatattcttaagcatgacataaatattttcatatttacacaaaaattttaaataaaacgaatgactaaatattggtaaaaagtcaacgacgtcatccattggaataggagtattatatagcctagttgatgtgtttttgcacgggtccgcacggacgttgcgcgcaatggggcgtgatggtcgtgtcgtgtcccacgattccatcccatcccatggccacgcacggacgtgttggtaatacttggaaggctgcatgcagagagccctggtgcagaggtaggcctgtcccagcccacataaaactgtgtgttgcttgcagtaatcagggcctctttatatcctatcctaaaatttttcaccctattacagggaacgtttgatcacatacatatagtattaaatataggctaaaaaatactccttccgttttttaatagatgacgccgttaactttttcttacatgtttgaccattcgtcttattcaaaaattttatataaatgtataagatataaatcacacttaaagtactatgaatgataaaacaactcataacaaaataaattataattacgtaaatttttttgaataagacgaagggtcaaacatgtgagaaaaagtcaacggcgttatttattaaaaaaacggaggtagtaactaattgcacagattgcgactaatttatgagacgaatcttttaagcctaattactctatgatctgacaatgtaatgttacagtaaacatttattaatgatggattaattaggcttaataaatttatctcacgggttactgacggattctataattagtttttttattagtgcccgaacatcccatatgacattctatataatatctataatatctaatgtgacacgtgaaaactttacgcatcttataacaccccctcaccagtccatccgtagaaacaagtactgtacagtagtaatagtccacaaagaaacagtagaagctcttctctctctctcgtgtggactgtgtggtcaaacatgtgcatgaaaagaaaagacgggtaggctcaaggctggcggagttgcaggcgggggcggacgacgactagctttggctcggcgcgtgctgtgcagtgcagggcggcccaattgctcaacacaacagtggccactggccagccgtctgctgctgctgccgctgccgcacgcagagcaatcgcaagtgggcggcaaccaggcatgggctcccgttgttgtacttgtccaccagaccagcttaggtagcggcgagacggcgagagctcgtgctcgtcccacgcggacgcggctcccctttcccgtccaggaagatctctattcctctgccttgtaggcttgtgtgttcttaggtatggggttgggtactaataaaaaaaatcgaatattagagaatgacctaatatcaaataattagaaggggtgaggtttcaaatctagatcgtctagcccactatcttgtggagctagccggaagacacctaggtgtttttcagggttgggtactaatcaccatacatgaaaaatggagcggtagattcacgcataatcaattaagtattagctaaaaaaactttaaaattaatatgagttaatatgtttttctaaaagcaacttacctatagataatttttgtaaaagaaaatacttctactatttagtaatttggaaagtgtgcacgtgaaaaatgagggatgagaggttggaaaccaccacaaatgaactcagccttagggctacagtggatccataccaaagaggacccacgtaccagtaactcaaaattatgtaacttaagtcagagaatctcaattctctttccgtgatgtctaccaggcgaacttatgtaccgtgtgtttggttgctcgcatctctcttacttacctcatctccctcatatagggtaagtttagctaggctaggttaaggtaaccgcctctccgacggttacttggcgactggtgactagtgacgacgatttggtatgggactgtcatgaacgagtcggctggcgccctttgggcacgttgaatggttgtggatttatgcggatggcttgtgaaatcccaaaagcatgggataatagataactgttatcagattttttttattttcaaaataacaaagcgggttggatagtatgatctgatagaatgattgatcgggagtgggtttgaggggcgaattcatcgttggggcatgttggggcttcagccccagctcccctcgatgaaccccaggtgccactcttcatccgcagtagcgcctgcataggcagaagagaaaagggtgtgtagtagtagcagcacccagaggaggaagactattttctcttggttgggttgtgacaatcccgcgtaataggtgctcaatcaataagaccatacagattaacaagacgtgtcaattggttacgttatgatgtgccatttagtcaacacaaacacaccaatttatttaattattttttctttgtgaaatgttcctaatacttataaaatgattggtaatttggcatttggccggtttgatggtcttgacatgttcatagagatgaaaaaattggttttaatttgtattttggttagggcagcacgtatttgctttcactctatttatatattaatttaattaggttacctaaaatattaaatttgtttagcaaatgatcggcatacacatattttcatgttgttaggccttttaaggcaatgttggatggtaccggttagtaactaatccttcacgcacgtaaatatagcaacccattagcacatgattaattaggtattaggttaaaacccttaaaaatgaattaatatgattttttaaagcaagttttctataatttttttttaaaaaacacatcatttacaattcggggaacgtgcacggctgtgcgcggaacgatagagtaaaagtcaggagaaggtagtatcaaactcagcctaaactggcttacatggaggatggagcacccctcaacttttatcctagattcgccagtttgatatgtataattttatacatgtatgtatataaatatacgtataaacatataaatataaagtttatatgtatactccctccgtccaaaaaaaaacccaatccacatgtgtccaggtttaaatctaggattgggttttttttgggacggagggagtacgtataaaccttttacatatgtatagtacaaactttgattaaatgggtcaaacccacatgatgaaagtggataaaatacgtcaagcctatattttataaaaaaaaatgtaaacgggcttaagcccacatgacagaaatgggctaagtctacatttaataaagaaaagataaacgggctgaaaaaaaatcacctcgattaaaaatggcatataacgggctgcgccacgcgctactgatcgctaattagtgacccgcttgagaaccgctgatttgaaaactgcccgacccgattcttttctgggcaaactgcaaaagacacagatcaaacacatatagcctcgatttcatctcagccatccgattcatgatggccaaccaaagggatcgtaatgacgccaaccccaacgattacatgacgcatgcgatctaattgacagcaacaccaaagtctgaaacataatcatgaaggaggacacccttcatctgttggcatcgttgagaaggcacccaaggctagggcccagggacctaatctcatcctaactccagagtccaaacaaaacactactgtcgttcttggtgaggtgagcatatagctcaactactcgtagatttcttagggtgaaatcagctaattacggatgctcgtatttatggttaattatttttttagtggtaataggcagcatacccatcgatagtgaggtgtccgtaataattttgttaattttaagatatgtgagtttagtttttcggacgagattataggggtagggtgtgtatgtttacgtttataggagtaactattactgtgtttttttgaatgtactatattccttggtaatacttgctctgatcatcattaactgtattatattactgcaaattagggaacagataagacttagaattatgccaagagaagccggggaccggacaaatcgcaactttgcaagcagattgtatatcgttgccttttgggaaaggcatgcatacgaaactcgtgtctgatgcctgaccatggcatgatcaggcagtggaagctaattattactactacttcgtgcgatgatgactagattatctcactgagtacgtctcattctgccttaatataattggaaaagaactggactttggtattgttgtcaatatatcaagtcctgatggctactctcttcaatttcttgtccaattcgttaatagagtgcatatttaggctgtgttcaacacaggatgttcccaactcctctctcttgtgttccacgtgcacgctttttaaactgttaaacggtactttttttgcaaaaagtttatatatgaaagttgtttaaaaaaatcatattgatctattttttaaaaaaattagctaatacttaattaatcacgtgctaatggactgcttcgttttccgcgtgaaagataggttcccagcccatagaatcgaacacagcctattttgttaattaagagaagattagttcttgatttttttttgcattttccaatatatatgtacaacgtactgcaaattgaagtgaagtgaatgcatatcggttggtcctcaatataatatcctcactaatttctcttctgtttatttaacagaaataataccaaagaattatccattcattgtgacctgttgttatttaattttctaatagcttacttcggttttaagattggtagcaacaaactccgcagttggtcgtcaaattgtaatcattcagtggtaatagctgtgcaagtagccttttccacctgtatcaaggaaattaaccacggaacccagtaataatgcatatctgccttctagtaatctctaaccaaacgggttagcctcggagaaagaaaggaaatgattagctggctttgttcctttattttcgacgcttgatcgatctagttggtcacttccaaagcctggatttgaccaggtgaatatccatggcaactttactacgccacttgtctaggtctagggaaaagttcaacaaagatgaaggataatttatactcctcattttctccccttcctcattctctctccacaataatgaagggcttaatactttttaaccttatgttaatgtatttttcactagctaaaacaatagttttttttagaatagatggagtacctctgttcattaaattctttggataagcaaatgaactatgttttgccttaagttgtactccgtccgtcctagaatcatttttattcctcccatttgtttcaaaataagtttatttttaagcaatcattgcattgaagtaaatgaaagtaggggataaatgcatcaggatcaatggataaaaagaagaataattgcattgagatttgacgaagtgggagtattatatttttttggttttgtattggtatatgtggaataggtgaaaaataaacttattttgaggaaagattatgtactaatgacaaataaaagaccagagggagtaatataaatagctggatttatttttttttctttgcacatttgtaaatgaacttattttccctaaaagtttgaattgtactccactatgtaagaaaatgatgtggagacaatgatttgatattactggcatattgaattctaaaaatacaacacatgcttagctaatagatgatgatgttgcacacttacatgtgctttaaaatactctagataataacttgctactgaatgatgatgtgacacacttgcatgttgagttttaaaagttaatggacatcaactatatagacggtatagataagaatgtatagtatggatagtctaacccgaaccataaaagtcaaatgtggaacaaaagtaaaacaagcgagcttttcagaaggttgggtgcaacctaccgttgtctttgctacttgcgacactattgctgttagctacaccgcagtatcgctgaataacccacactattgctgttagctacaccgcactattgctgaataaccccaaggcatagattagtcttgtggttttccaaactacttttttagattaccactatccgatggtatatcatgattatcaggataaccgtgaaaaccgtaagtttaccatgaaaaattgtatggttaaaaatttaacaaggtaaccgcatataagtacctccgataatcgtgacgtaaccgtacaatattgtaatcgaggacattgttgtccctgtaggatggaacacgtggccatacatgaagccatcctagaatacaattcacgattcacgcactacaatgaatgtggatttcacccccaattattgaagaagattggaaacttatatgaagaatattttagcatatgacgagacgtacatcatgtttccatcaaagatgaacactgagcctgagcctgagtctgaatatttctggtgactgaagaatgagctggctagcaatcatagtgaagtaaaccattcttagctggcaggatctcgccgagtaaagcctgatgttttcaatcagcttcgattgcaaattcccgtgaaaaaaggaatgtttttaagttgctgtgccaggtgctgcccttgagcatcaccagtgtggtgtgtgggcaattgattgaaccgtacaaggttttgattggtgatttgccaattgattaataaattaatgcccgtagttgcatattgttccagagcttaattgggtacttgattacatcatcatatatagcggcagtggtatagtatactaggtatataaagtttctagatcgaaactccactaaacactgcagtctcatatggtactagaaatactatatatttctacctccgtttcgaaatgtttgacgcagttgacttttttaaacatgtttgaccgttcgtcttattcaaaaaatttaagtaattattaattcttttcctatcatttgattcattgttaaatatatttttatataggcatataattttacatatttcacaaaattttttaaataagacgaacagtcaaacatgtgctaaaaagtcaacggtgtcaaatatttcgaaacagagggagtatcataaatggaaactctttgaaattatacttgttcccggtacaaatctaaataagtgagaagtgaagcccttcatgctgaactactgagccacgtcagaagatatggacagtccgaattttgctgcagatgttactccccatcagatccttttattggtaaaatatcttctttttccttcaagaaacctctatctacttttactacttccacgtctctagataataaacttaaatcattttccatttcgctccttcccttccctagcggatcgcgatgactcctagctctctttgcacgcaaagcgccgccaccttcatctccatcccatcccgccggtctcagcctctttctccccatcccctctaccaaagccagtcctccccatccccatcgactcttctcttcttctccgtcctctccgccgctgcctcctattcatcaccgcatccagcagtgaaagaaggagagatagaggggaaatgatagacaaggaggagagggagatgaaggcagggacgtagatgaactagcagaccgtcgatccggcgtggaggaaacattattgttgaattctgataattcacataagttgacatatggaactcatatatggattgttaatgcagtaatcatttgtcctatatatgaattattgattcgatcatagaagcaatcaaattgtacaggatatataacaggaattgcagatatatattactagcaacacaattagttacaggaatcccagatattattactagctatacaattaggatcatccggagtagaaatatatagtacactaacaataaattccacaaccatatgctttgcatttactgaaacttataaaaggagacagcgaaattatatccagggtttgacattttggactaaaatttcggatccctccgatatgatattattttggccaaaatttttcatttttttaatttttcatgaattttggtaatatttgctcaaaattgactaaattttgttctaaattttggaccgaaatttctgaaattttgtcatatcggcactgcccgatacaaaggccaaaaacgaaaaagtgaaccctggttatatctacagtgttgccatgcaatttaatagcgttgttctttttctatgcactgttgtcttatcacaataggatgtagctgtatatatcttatttgttgatttttcagcaatcctggtatatataattctatcgatttatacaagaagaagaagaagctatgttcacgtaacatttgatcattgatcttattagaaaaatatttctttgatgataaaacaagtcagaacaaaataaataatatttatataatttttttaaataagatgaatggtcaaattttatataaaaagtcaacaatgtcatccattttgggacagagggagtatatatattttttctagattaatgaagttagcacgggtgtctcgttgttgacgggcatatcgtctatcactaaaataataattagttatagatgcgagcacccgtgtcagtctacaacttaaaaattcgagtggattcgttccaccataaaaactctagccagttgaactacgctcacctcacgacggagtatattactttgtatgtttgggtaggtatgctccggccgtgacctaccggctggctagcgcctgagcacccgcgcgttgctcggcacgcaggcgtgccccaccctagctgccctgccctcttcctcccggcaaaacatgtctgccacagtgcgtagctggaacgtgccaacgtacttgtgttactaggactctctagagtacacagatgcactcacgcgccaatcattattaaccactcgcgcccacgccacagcacaaaccatcattctcgaacacgtatcaatcagccttgctagctactacaagcagctataaaaagcgcagaggcaggcagacgagatgagatcgccacagccaagctctcgcacacaccgatcagtcggtcataaacgccattagaccaagctcaagaagaagaagaagaagaagaagaagaagaagatgcggcagcagcagcagaagaggaaggtggcgtccgtgtcgtcggcgctggtgatgtcgctgctgcccatcctctacgcgtcgctgctccgcctcccgccggccgcgctcgccagggacaccaccttctggttccttctctccaactgcatcatcgccatcatcgccgccgccgactccgccgccgccgcgccaataacaacttcgtcgtcgtcgtcccacggccacgacgacgttgacgaaccggccctcctcgccgccgccgtcgtccctgctgctcctcctcctgcagcgggtgatgatcagctccccgcagaagcgccggtggccgtacgaaacgacgatgagatcaacgagccgccgtcggcgccggcggtgacatcgtcggcgacgccgtcctccgacaacccgccggcgttcatcgcctccgacgatgtcgcaaccgagggtgaacggccagatcagcaaccacaagaagcagcaaccgacggcgaaacccacggagaggctgtcaaaggagacgacgacgaagacgaaacagcaagcgacaaaaccacgacgacgaacaagagcctcccctcgtcatcgtcagaggagcttgcgattgtcacctccaacaacgacgacgattacgacgacggcggtgactctgcgtcgtttggcgaggaagacgaagggaaagtagtgccgtggggcatgccggcgccggcgacgacgacaggcggcggcggcggcggcaagcagtactggcagctgagcgacgaggagctgaacaggaaggtggaggagttcatcacccggttcaaccgagagatgaggctgcagatcctgcaggaagccggtgtctgactcacccactcactcacagctacacctccatcacagtggcggatctgccgtgaggcggcgagggatcgagtctccactactgacaataggactatgagagtctttcgagtcctcctaaaattttctaccacatatatctattggaagaagttatgtacatgtgtagtttgttcagtctcctactatttcttcttggatatgatccaccttctagtatatatgttcatataatagcatgcaactattatatatttgtattgcatatagatgtacaggttatatataatacaagcgcatcatatatgttaattagtttgcttatgtacgtcgttaatttgtgatagagtatagtgtactccttatgtcctattaaaaaaacctaatcccccattctaatcctaagttttaattcggattaggttttttatgggacggatgattgagttttttaggggtagagggagtagtgtacatgcattttctttgtgcacagtgcacatgccatgtaatgcaggtttcaggcttgtttgcagtgttatacacaagactgttttgttcgatgagagcgacatgttagatatgacatggatcgagtcagctacctaaagaagcttcggatgataaatctacacgtacgtacggccgggccggccatggcgatatcaaacattaaggctggaattaaggtgacagttcactctggagtgtgaagtgatgtcacggatacaaatcagggcacgatttagtcatggatatcgagctatcgagagccgttcgtttactgtgctcggtgaaatcatgtccacatatatacgaaatctgcagcgagccagacatagcatcgatcagtcactccccaaaacctgcaaattaactcgtccactgatcattctgcggttcatctcacaagttctccttttctaagggagcctatgcatcgccagtcttatctaacagcttaacctcgagcacacaaaatattagtactaactccacttttaagtatatggattttttgaattttttacataacttatgaacttacggtttaataaaaatttactatggatataaaaaatataaatcatgattaaagtatatttaataatacaagatggtatagaaaaataaataacattcatgtgttgggtcttaaaagaacattttcaacacgattaagcctgttcaaacaaaacctggctcggcccacatacgcaccaggctgggcatgggcctccattttgtggtctgaaagcctgaaaaaaaaggaggaaaaagtacaccgaaggtccctcaacttgtcagtgagatacaaaaacatccttgaaccgcaaaaccagatatgcggggtcccttaactatataaaacggtcactcgaggtcccttggtggttttgacgcccgatttgacctacgtgacggctgagtcagcatgggccccacatttcagggtgccacctcatctcttccatcttatttccctcttctccctttctctcacttttctcaggctggtgacgggcggcgatgtggggaggaggccaccggggggaggggagagaaagaggtccggtagccggttggaggcaacgccaccgtcagcatcatcgttgccgccgccgtggcacaacgccgcccgtcgtcggctattttgccactgctgactccgtcgccttgggacactagccgcgctccggcggcggcctcgctagcgcgatatcgtcgatggcttccacccggaaaagctcatcgtcgccggctgtagtttaagacccgcgtgccgccgccacaaaaaaaactccgacgtccgcaccgaggaggacatgcggagagaggggttggagccgtgctggccggaggagcacgacggctaccgtggtgactcaccgccgctgttcccctccactcccctctttctctttctctgccctgagctcgccagtgccgcatctatctgcactgccgccaccgccgccgcatctatctctctctctctctctcatcaccgacacggattgctccttggagaggcgtagcttcttgcgccgctgcatccacggtggtagtcgtcgccgcggcgagcggcgccggcaagctgtcgctgtgggcgctggtgaaattgtggcgccgctccctcctctcccactaacgccgccgcacgctgctccctcctcttctgcttgtggccatcggggagaagggcggcggacttggtggggccgccacgtcgccgtcttgctccccctgcggccaccaagctcctctcgccgccgccgacgcccctcccctgctcccgcgtcgccgccttgctcccctcgccgccgccttgctctcctccccgctgccgccttgctctcctccctgtcgtcttgctccccccacggccgccaagcccttttcgctgccgtcgatgcccctcccctgctcccgcgtcgtcgccgccttgcttccctcgccgccgctttgctctcctccctgttagagttagagataatgtgtgcatgtgataatgcatgtgataacagaatagaagttagagataatcttggggttagtttggattgagatgtaattctgttatatatgtaaaaccacgttggaggttgtttccaacactaatcaatatatacgtgcggcctcgtacagaggtgataacgcttcctaaaagttttatatggtatcagagccatactagccacaaacagatcaatctggcgatggcgagttcctccagcagcgccgggagtcctttttccggtcaggcggtcgcagagaagctcacccggacgaacttccttctgtggaaggcgcaaatcctcccggtgatccgcggtgcccgcatggaagggtacttgacaggcgcgacacaggccccgctggctgtgatcgacgccaaagatggagaagcgaccgtcaaggcgtcgaagccggcgttcgagatgtggataacggcggaccaacaggtgctgggtttccttctttccacactttccaaagagatcctcacccaagtcatcagtatggaatctgccgcacaagtatggaaggccatcacggagatgttgtcttcccaatcacgtgcgcgtgctttgaacacgcggctggcgctcgcgacgaccctcaagggcgatctcagcgtctctgattacatcagtaagatgaaagtcctcgccgacgagatggcattcgccggcaagccgcttgatgacgaagaactcatttcctacgtcctggctggcctcgacgacgactacgagccggtcgtctcctctctcgtcggcaagtcggaggttgtctccctcgccgagtgctactctcaactcctgagcttcaagtccaggcagaagcttcgtcatgcggctgcacatcaggcttcgtccgtcaacgcggccaggcgcggtggcggaaagggcggtggatacactcccttcaatcgcggcgggcgcagcggtggcaacaacaacggcaggcgcagcaacaatggaggtggacgtggtggccgcggcaacaacaatggagaccggggtggcaaaccacatcctgtgtgccatctatgtggcaaaacggggcatgttgtcgccgattgttggtacaggtatgatgagaattttgtgcctgaaaataagatagctgctgcagcctcatatggtgtagacacaaattggtacgtggacactggagccacggatcatatcactggagaattggacaaattgacgactcgggagaagtataatggcaaggatcagatatatacggcaagtggtgcaggtatggacattaaacatattggtcattctgttatttgtacccctactcgcaatatatacttgaaaaacatccttcatgttcccaaagccaagaaaaatttactttttgctcatcgcttagcccttgataatcatgcctttgttgaagttcattctcgtttctttgccatcaaggatcaggtaacgaggaatcttcttcttagagggccttgccgcaacggtctctatcccataccaaaatcgtcgtcatcttcgtccaagcaagtcctcggagtcatcaaacccactatttccaagtagcatagtcgtttgggtcatccgtctttttctatagttcagagagttgtgaacaataataatctcccatgtttaggagatcttaatgagttaggtgtgtgtgatgcttgtcaaaaggctaagagtcatcaacttccctatcctaagtctttcagtgtgtttagtcatcccctagaacttgttttctcagatgtttggggtcctgctcctgattctgttggtggcagaaaatattatgttagttttatagatgattttagtaaatttacttggatctatttgcttaaaaagaagtctgaagttcttcagaaattctctgagtttcaacagcttgttgaaagactatttaatcgcaaaattattgctatgcaatctgattggggaggagagtatgaaaaacttaatgccatttttactaaaattgggatcactcatcatgtctcttgtccctatgctcaccaacagaacggttccgcagaacgtaaacatagacacattgttgaagttggtctctccttacttgctcatgcttccatgcctctcaagttttgggatgaggctttccttacagctacttatcttattaatcgcacaccaagtaaagttatacagtactcgacgcctttagagcgtctcttgaatcaaaaaccaaattactcctccttgagaacctttggatgtgcgtgttggccgaatcttcgaccctataataatcgcaaacttcagtttcgctcaaaacagtgtgtttttcttggctatagcaatattcataaagggttcaagtgtcttgatgttgcaactggcagagtttatatttctagagatgttgtgtttgatgaaaatatttttcccttctcacaacttcactctaatgccggggctagactacggtcagaaatcttgcttttgccatctacactgttgaatcctgaaattgctagtaggggtatgcaagtgaatgatcatatgtctaatgctccctctggagaatctaatattatttctgagcatgcacctgaacaggaagcaggaggttcaaatataaatgcacctacagatacacatgatacagaagatcctggtgctggcggcagtactggatttgatgaaaatactgctggaagtgatggacctgacggcagtgatggatttgatgggtcagctgctggctcagatcccggcgatggcagtacagaagttgggagcagcagcagcagcgctgtcggcagtcctagcactgggaacggcggcagtagtggtgcgtcagtcaatccaggaccagggagtgcatcggcaacagaaccagcccgtcatggtggtgcgacaggtgatgagacacatactaatcagattattcctgagcaggtgcaccagccaagtcgtccaaccacaaggttgcagaggggaataaggaaggaaaaagtctatactgacggaacagtaaggtataatcttctagcctgtactggtgaaccacagtttagatcaagtattagttgatcaaaattggaaacaagtcatggatgcagaatttacagtcttaattaataataaaacttggcacttagttccgcctcagagtggtagaaatattattgactgcaagtgggtttataaaattaaacggaaagctgatggtagcctggatagatataaagctcgtttggtagaaaaagggtttaaacaacgttatggaattgattatgaagatacttttagtcctttttgttaagactgctactattagagctatattatctattgctatatctagaggttggtgtcttcgacagtttgatgtacagaatgcctttcttcatggtgttcttgaagaagaggtgtatatgagacaaccgcctggctatgaggataagagtaagcctaattttgtttgcaagctagataaggctttatatggattaaaacatgcaccttgagcttggtattctaggctgagcagtaagttatgtgatcttggcttcaaggcatccaaggcatacactcattgttcttttacagaaaaggaaatgttactatttttgtacttatatatgttgatgatataattgtagcaagtgctacacagggtgctgctgaggctttgttgaaagatttaaaacaagagtttgctctcaaggatttaggtgatttacattatttccttggaatagaagttaacaaggtaagagatggtatcagatggtatcttgttaactcaagaaaaatatgcctctgatctactaaagagggcaggtatgtcagattgtaaacctgttgctacacctatgtccaatacagagaaaatgtcagttcatagtggttctgttctaggggaacatgatgcaactagatatagaagtattgttggagctttacagtacttgactttaactcgaccagatatttctttttcaataaataaggtttgtcagtttttacatagtcctaccacgcagcattggatggcagtcaagaggattttgagatatattaagtcttctgttggtcttggtcttaagattaacaggtcttcttctactcttgttagtgctttttctgatgcagattgggcaggatcagtagatgacagaagatcaacaggtggatttgcagtctttttgggatcaaatctggtatcatggagtgctagaaaataggctacagtttataggtcaagtacagaagctgaatataaagcggtagcaaatgctacagcagaggtaatgtggattcagattttacttcaggaaattggggttcaagttccgtcgacagctaagttgtggtgtgataatttaggagctacatatctgtcagtcaatcctgtgtttcatgccagaactaagcatatagaagtggattatcattttgttagagaaagagttgctaggaagcaactggagataaaatttatatcttctggtgatcaagtggcagatggttttactaaaccaatctctgttcaacagcttagagattttagaaacaatcttaacttagataagttatgattgaggggggctgttagagttagagataatgtgtgcatgtgataatgcatgtgataacagaatagaagttagagataatcttggggttagtttggattgagatgtaattctgttatatctgtaaaaccatgtgggaggttgtttccaacactaatcaatatatacatgcggcctcatacagaggtgataacgcttcctaaaagttttatactccccgccgccgccttgctctcctccccacccgtcctgcccagagccagagagagaagagtgggagagagaggaggaagggagagaagaggggaaagagaaagtaggatgacctagacaggctgacacgtggggcccatgctgactcagccgccacgtaggacaaaaccggcgtcaaaaccgccgagggaccttgggtgaccggttttgtatagttaagggaccccgcatatctgattttgcagttcgaggacgtttttgtatttcgctgacaagttgagggagcttcggtgtactttttccaaaaaaggaagaaacctgaacatgaatcaggtttaggcctgtttttatgtgctgaaaaggcttaggccgggcggaaaaactagctggcgtgcgcgccagcagcacgcgttttttgcgtgttaacgtaactaactcggttaattaaggataatgatagtaattaagaaaagttttttcttgttttcaatttatttactagcaggttgaaaactttcaacttaatatttaaactttgaagtcaaatttgaaaactttcaactcatatttgaaaactttcaactcgagatttgaaaattttcaagtccagatttgaaaagtttttagttaagatttgaaaattaaaaattttgaaaactttgaacttaaatttgaaaactttcaactcaagatttgaaaactttcaagtccagatttgaaaatttttaagttaaagatttaaaaattttcaagtcaagatttaaaactttcaactcaaaatatttgaaaatacgtgtgctaaagattacaaaaattattagaaaaaaaagtaaaaaggaaagaaaaaaatcgtggaaaaaaggaaagaaaaaagaaaccacgcggggaagcggcgccgtgtgcgcgccaattagcaacaccctagggcgggctcagctgtacatttttggcttaggtttttataggcccagtcttgcataaggtttgaacaagcccaaatacaagattttaaaatacaaaagggatattaggataaataaaagaagttaaaaattaatctgtcctattctaatatctttcgagctacgtataaaacatgttcgatatagaggttaaccggcaacgaccaatgaagacacaaagaatattataggctaggcaatgaccccaaggagcatatcaccacagagggcaaaccaatgagaaaatggacatttagccatcttcaaaacacggttttgctagaatgccatcttcaaaacgtgattcgataaaatgccaatatcaaggccatgcaactcgccagattgccattttcttattttctcttaattccgaaatcattttgcctcttctttgtggtgattagacggaaatgcccttggggccaatggcaagtccatctcttctctttctttctctccttcttcgttttgtgccgccggcggatatggtcgagcgcggcgaggtggtcgtcgtcgttgctgacgagggcatcgacctgtcggggatgcggcggaacaagttggcgacgatggtgtgggacagggcgaggccgagcaaaggccatggggcttggttgatggcagcgatgaagaaaacgtctcagcagcggctccgagctccggcgagacgatgccaactcattccattcgatatgaaggcatgcatgtgcatccatgaggttggttaggtcccagggatggtgcatgcgcaaagaatcgacgagggggtcaccggagcggagagaatcgaagattgacgccgacggccgaagttggagaagacgatgtcgatctccctcctcgatgctccattcttctcggttcttgaggggttttgaagaggacctcaagaaggagctgatggcgtggtggcttgctccgggatggatgaggatggccggacatcgacgatgccgaagcggcggcgctccaggacgacgatggcacgacggtgttcccgttgctacaatggatcaaacgcgatggcgtcaaaagaaagtttgttctgcaagatgaattgagtatggaacgcaaaagggataaggacgaccgtggcttggtgatgaatatgatcatcgtcttcatctcggctggcgatgggattgagaccaaagaggcagcccatgcttgttctctcgatgtggtcggcagtagggtggagagtgagatgggacgacggagttgggagaagaccatagctaccgccgccgccgccactcaatgcgccggcgaggccatggtattttgtcccctgctcgccgcgctcacgaggaagggcaatttcgtctcatcatccggtggaggagaaaaaaatgatttcgaaaatgcacaaaatggcaaaaatggcaaagtggcggtgagtgcgcgtttcatattggcattttagcgaaacgcgttttcgaaatggtattctagcgaaaccatgttttgaaagtggctaaatgtccattttctccaaacgaataggggtccttcccctttagaggtagctaatgatggtcgaaaatagaggcaaagtcggtgcactaggtagaggaagtgagggattagtgaagggtgttgcatgggataataaggaagaggtgagatgggctagccaccggtcatcaaacgcatgattaaattgaaggcctctagcttaaatatacttagtttgaaaaatgttgtgatgtctataagaccaaagaaagtgatgcttgtaagtcaaggtggctagttagggatcagggtcatgggtgaggtctacgatataccattgtctatccttgacaaaagacaaacaaaataaaaattggttgcccgaggagaatgctactcctggtggcagttatcttgatgaatgttcctggataagaaaacatatgtttgtgaatgttgatttatgtattgagtctcggtaggtttatataaactctaatttagatcataatactatctttatacatctctaaatgttatatactttttttttggaaatatacgactagcgtatatacaagaacttatattcgattccaaattttatcgtcattttaccacatttcatcaataccattattcttttgcaagtattctgacagtgacgtctctgaaatactacaggcacccccgtcatccgaatcatggatatctcggtctttttcctcacaagacaaccatacaaacaacttgcaccgcttatatgttaaatgaaagtgacgcataaagggcaaacaataataaaattcagcgactttttttttctgcgccgacaacgatttcacgtgcacgctaactgaaagcataaaagatattttttctgttttttttttgcaaactagcgtaaaaggtatttcctccggtcatgtttttgcttttatgaaacgaaaagaagatatttttttctaacaaaaatccaatttactttctccaactattttattggatcacttaaccacctaaaatatttttaaaatgtgacatggctacttaggttattatattttgagacgaagataataaaaatatatttaataaaaaaagaacacaaagatgtttgtgacttgtattctctgtttaggttttattattgtaacttaaggttataagaaacaaccatttgataactagtttttaaaaaatctggagaagctatgagtttaaactcatagtgtattttcttaattctatataatcacgtcatttcagaacataaataaaaaaattaaacgatttaaataaacttttgattatacgaaaaaccatacccgctgcctggaatccctcgcagataatcccaccaacaagcagaaacatacaaacatccagacggaacgcatgccgaacggtcgaacggatggctcggcccgggacttatcgcggggggagggggatcggatcctaacgggaaagacgggaaaatctccggcatcgccgccaatttctcccgcacgccgcggcgctgctcccccttccctacccacacactccaccaccatcaccaccaccaccaccacccgcacgcgcgccgcaacaacctcactactgcctatcctacctatatggcacggggtgtgggtccctccgattcccccggcacgccactcctctcccctccccacgcaaccgcctttctccgccgccgccgacgccgacgccgacgccgaccccttctcccaatctgcggattccagcgggggtcccccccccctcccaccggcggcgcccggtggtcgtggtcgtgggggaggggagtcaacgaacgagccgagccgcccgcttgccggagctctctatctatctctctatctctatctctatccctccagattccctcctccatcgaatctctgatatttggagggagcgactcgacgcagcatcgcatcgtaaggaaggtcccctccactgtcgatggatgtgaggtttctttccaattttttttcttcctttattattaattattaatctctctctcgctcacaagcataccatgcgtttcatgtgccattatgcctcatcagtttgatatgatatacggtatggatggtctctagtctctgtcatcaatcgatcgcatttactacatagatatggaactaacatggaagaaaaagttgtcagattcttttcctccaatctgtattaggaaaaataatttgtcatcagttgatcgcatttaatacatagatatggaactaacagggaagaaaaagatgtcaccagttgattcttttcctccaatctgtattaggaaaaataagttgtcatcagttaattatttgtatttttcgtaataagtgtgtgtgtggaaaggacattcctccaatttgtattaggaaaaataagttgtcatcagttaattatttgtatttttcgtaataaatgtgtgtgtggaaaggacagggaagaaaagaacttgcaaaagtgtaattgcaaggcaattgatttgatgctacttttgtgggggtgctcctgtttatttatatatatgcctattcttttgcactaagcagcagcaccagctcgacgaggagaaccagagagccgcgctcttccactcctctgccccatcttcctctttgggagctgacggggaggaggagagggagactgtgccgctgctgtcctgcaagatggccgacgataaatctgacactgtccaggtctccgaggatacggcgcaccagattagcattggtaatttttcatcaaccgttctttgttaatgtctaggcgaatgtcttatgaatgatcgtgtgatgtgttctctcctttcttttcataattgcgatccttaagtcttcctagcctcctagttgaacaccacggcgcctgcatatatttctcctttcttttgtcctcataacctatcggacaaatagacactggttgttccttagccacagataggtaaagaaaaagaagatctgattcatattcatcatcttgaggcctaattcattaaaagagctggaacatgaagcaatttccttttgtctttaatttcttacaattttcagttgtggctcttcttactgcttttagctgttccctctgaaaatataaacttgatgcagagccacagaccatgggttgtcattttggcttaaaaaaaacattgaccttatgtggtgcgtatgattattgattgacttacgaaacactttttttttcactttcagatccctggtatcaagttggattcattctgacaaccggggtgaatagtgcatatgttctgggatattctgcatcaatcatggtccctttaggctggattggtgggacatgtggcttgattctagctgctgcaatatccatgtatgcaaatgctcttcttgctcaccttcatgaagttggtgccaaacgccatatcagatacagagatcttgctgggcacatatatggtaaatattaatacactcagttccctcatttggcaaatattcgataaggaatagtttcattctcttccctttttttcttaacctgtgcatgttttttaatcattcccctccccccatattttttgttttctttgntgggtnctgcagagngctcacctnnnggggggcat

SEQ ID NO: 3785 - DNA, 731 bp, Oryza sativa
  unsure (1)..(731): unsure at all n locations
cgggnttnnnaggtgaccactattggacagnacntcatatgcttcgccgccttcttgaattcttcgacgatggtgtgctccatctcggcgaagctgttcaccaagaatccatccgctcgccggtatcgccgtacctcttcgaggatctaccaaaacacggggttggacctatcgaggtatccgtccggcatgtcggcgacgcggatcgtcatgtccccagcgagacggagggggtccggcaggtctagcttcgtcgcgggcgctgtcttcgacgccgcactcgccttcttcgtcgcaaagaggggataggccggtggcggtagagagggaagaggtggccggcgagctcggtcgagctccgccgcctcgagggcctctcgacgggaggagggagagggggagacggaaggcggtcgacaaatgatgaccccaaggtaaatcttttacttcttctggggttaaggcaacccatccagtttctccaccaacccaacgttttggttggttcggagttttagaagagtccacccagattaaaccaacagccggatttgttggtgctggtggggagtaaacccaagcaccttctttaccgtttatagctgtttcgaagtcttctggggcttttatccacggttggggattgttaccctttacttaccttggagaagacatatagtaagccaagttagggtctttccccccaggcttcccaccaataattactgatg

SEQ ID NO: 3786 - DNA, 1926 bp, Oryza sativa
  unsure (1)..(1926): unsure at all n locations
naataccaaaaagaancgttttttctataatatttgtcgccaatttttctcccaaaaatttgacagatgtaattacagtataatcgtagtataattacactgtaacttgcatgtaattacactgtaactatagtgtaacttgtatgtaactttcaaanatctctctgtaatatgtcttatttcggtaaaatagaggttgtgggaacaaatccttacacatatgtgtgtgctgtgattttttttcttcctcaccaaaacaaatcttgtaatagatttaacgattcaaaattacgtgaaacttatatacaagttacactgtagttacatgcaagttacagtgtaattacatataagttacagtgtaattacactacgattgtactataattacatctgtcaaatttttaggagaaaatttgtcgccaaatgtataggtggtcctaaaagaaaagtctatttacgtccctccaatcttgccctcgatccaatcacattcatcaaccacgaggtataagtttccctaacttcaaaaaccggtgcaaatacagtctctaaggtagtattgagcccggttatggcttaagtgacgtccactcggcatattggctagatcttcatctcgcataacatctttgtggcacttcaagtcagaaaaatgaagtgagacccacctggaaaacacatgtcaaagactatatcttcttcttccaacctcctctcttctccatctttccacctctcctctttcttcctcatgatctctatgctagcagctaactggagaggggcagcgtcaggcaggtgaggagtaaggcagcaacgacttatcctctttatcaagcggcccagacggcagcaaccatatttggagtagctctcagctgctctcgtgaccttgaactcaagatccacatccattgtagcatcgtcgagcttggtgacgctgctgccgctgctcgggagagaggagatgacacattgctccatgcagcccatgcacccgtctgtgccacctcaagctcgccgaccactaggttgttgcggccaccgcttgagagaggggagactgtggacgagggacccatagctcccctgccgcttaccatcgaggattgaggtggagtgcagtggcgcacatgagcagcaaggttaaggcagctagctcacgcgcacgttgaaggcgtcgatggcaggatctggcgtcatttccatctccttgagcgtaaacgggggccacccacccgatctagtaggtgaggcggggggccacggcgcgagcgggagctcgatgaggccatagtggcgcgagaggacatgtaatcttggggaggctgcggggacaacattctggctcgtccgcatcctctgcgacgaggggctcgacgaggtcgaccgggcctcggtcccgtcctcctgcgcatctgccgccaacgagctcatcatcgtggttctcgtattcttgatgcgtcgatggactcacggataggggagctcaacccttgggaggctcgtcaccttgagtttgtccgcttgactgactggatttgccttctgggctcagccccgacctccggctccttccccgtcgaccactgggtttacacaggcacgcttgagatggacaacatccacacactgctttgccaatgctgggcgcgcccctagtggcatttgcgtcctccggcctatcttgcctctacgattgcccgaggagagagaaagagatgggagaagaagaaaaggaatgtaacatggtcactagatatgttttgccacatttcacttacaatttggggttatgccctgactcaacgagtctgactgtagtcaatctaccacatcataaaaaaaaatcactaccctaactaccgaagaagttgatgaacgnctgtncctagtggtagagtcattctaannnngcccacg

SEQ ID NO: 3787 - DNA, 725 bp, Oryza sativa
gcagcaaattgaagcgtgaacgacctgggcggtaagcggaggtggatgtccgccggcgagaaggaaatggtatacttgcggattcggagccgacgcctggcggcgccgcagcagcagcgccgccagatccgcgctccccttcttccggggtcgcgttgccgccaccgatgcatgcccaggacatgcgcccgcgccgtcgaccgccccgggaaggcgcctcgtcgcgcgctgagccgccggcgacggccattgtctcatcgtcgcccgtggcctgccgactcaccctccccccacccagcgctcctgccgccgtcgtcgagtcgccggccgtcgctgcggcagaatcgccgactgccaaagatgccaggagagagaaggaagaagaggaagcctcctcccacgcagcgctctcgctacgccgcccgcctctcgccgcccgtagtcgctccgcccaccgcctgctgccgagccgcttccacccgccgcccctatggtccgccccccgcccgttgccgctcgccttctcctcgccgtgtagatgagacagagagagggggatagatagagaagggaggctgacatgtgggaccacatgggtccccccttttttccattattttttgtgcagctgacatgtggttcccacggttttttattattaaacagggatccaattgcacgtaagcgccacgtcaatgccacatgggacgagcacctagtcaaag

SEQ ID NO: 3788 - DNA, 2418 bp, Oryza sativa
  unsure (1)..(2418): unsure at all n locations
ngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtcagcgacctcccccaccacgagcagcggaagcgacgctcttctccaccgcatgcggcagcggcggcgacagcttcctgtggaggagggggaaggggaggccggctgataaatcctgagtcccactcgagacactcaaggttgttattggcccgatcttttagtgagttgatgataactacgatttaggagaaacgttgactacccgactacaaccgtactagacgtgttgcgccttcgcgatcgacacacctctccgtgtgttgttgatcttgccggtgtagatcaaccttattcctgcaagcaaatcgaagaaacaagcaagaacaagataaaagcaatctgaattacagataggaattaaatacaaatgataagttggggttccgaacaacaagcagacggacggtctagccgacacgcacgctgcaagcaagtagcaattgctaaactttaatttgacaaaacccaagaaaccctgaaggggtatctagctatttatggaggtgggagaactacctaggggtgcctagggtcgtgctccacctggttggggcacacctcacatgggccccatttaggccggggtcccaaatgaagttacaagcccatatgcccattataggtgacgtaacaccttgtttctgtgattgtggccaaacgatacggaattcggggatgaggctggatccgttggaaagagaactccgagagctttccatcgagtactcacaggccgaaacaaagcttgtatacagatttggcggccatttgaattctgcaatgtcgcaggtggccgaatcagattccagcacttgatcaacttgatcttgatgcgagcgacgattgtatcaatagtagtcatggtcacatcactagcaagccgaagggggaagaggaggtcgccgcacgggaaggggaggctggcgagccggaggggaagaggatgtcaccatgggagagggggaaggcaaaactagtaaaatgtgcaattaatataggcaaattagtctttactagtaaaatggcaaaactttaccatggatctaaacaccaactagcaaaacttcaatgtcaaatcttttgccgccaaaacttttgcccaaaaaatttgccacaacaaattgatctagacatgccctatataaatgatgaggggaaggggaaactattttgatccctcatggggagatcccctcgttatttgcatgtcactctaatggttatgaaaaaaattggaaatttgaaaatgtgtattaacatgtgatataacactccataaatatgcaagtttaaattcaacttgtacatctcgttaaaaaaacaaattaaacactagtagagaaacgatttttccgtgcggtcaaatgtgaatttcgcgtgcggaggttccaactgtctggaaccaagggtctgtaaaaatcactatttttgcgtgcggttagcgcacccacacgtgaaaatctgatttttcgcgtgcggggtggttatgtcgcccgcacgcaaaaataaaaaaccgaaaaaaataaaataaaaaaacccctaaccctaaagctgccgccgccgccctcctcacggtcatcgtcgtcgccgccgtccatgcgggggacggccgccgccgcgcgcacgcgccgtcgagcccggcaattccgatcgccgccgtgcgcatgccgacgaggccggcaccgccgccggatccgggcggggcacggtcgccgtcgncagattctggacgggggtagtcgtacgccgtcgcgtgcacacgccgtcacacgcacgcgccgccaagcccgccgatcccgtcagccgcgcgcatgcttgttaggacagcgccgagccgcgccatgccagacggccttgcccacacttgtttttgtccaggaagatttttctgacttagtccctgaaaaattatttcttttattagggaaccgggggtttgctagacgttttttcaccaatcaaatttggttttttttttccttgggagaaggtaatgttggaatttaaacttgaatggttgaagaggggattttttcta

SEQ ID NO: 3789 - DNA, 28768 bp, Oryza sativa
ggccgatattcgatccggcatcttggcattctctttcccttctttccttaactgtgcatgtttactaatcattcccctcacaccatagtttttgtatcacatactattggaatatatgtccttttttttctctaactgggcatgtttcttaatcattcccctcacaccatattttttgtatttcatactatttgaattggttatgaaaaacttgctctgggttttgtttattaataaaaaaatggtaattttgcttttgcagtatgactgaattacctttatttcaggtagaaaaatgtattcgcttacatgggctctgcaatatgttaatctattcatgatcaacactggccttatcattttagctggtcaagccctgaaggtacagagcaatcaccatcacccaactcttcttatggtgaaatgccgtgttatttcataacaagagttgggcccttctattcattatctcagtatctaagtttagatttttttttctttttgggaatacacatgttgaatttcactgggaaatctttttccctcctggactcatttgtgaacttcctttctgcaggcaatatatgtattatttagggacgatggagttctaaagctaccctactgcatagcattatctgggtttgtctgtgctctttttgcctttggaatcccttatctgtctgctctcaggatttggttgggattatcaacagttttcagtctcatctatataatgatagcatttgtcatgtcgcttagagatggtattatactttggttccttgttcatctgtccttaatttcttgtgcatttccatttgttggcataacaagctactcgtacaaaaatttcattactggttttcttttgaagggattaccacacctgcaaaggattatactattcctggatcacattcagatagaatcttcactacgataggtgctgtagcaaaccttgtgttcgcttacaacactggaatgctcccagaaattcaagttagtcagtttagtacatatggccagtgactagtttatttaccatgatattaccttatgtgtattatatattgcaggcaaccataaggcctcctgtggtcaagaatatggagaaggctctatggttccagttcactgttggttcgttgcctctttatgctgtcacctttatggggtattgggcgtacgggtcctcaacatcaagctatctactgaatagtgtgaagggaccaatttggataaaaactgtggcaaatttatcggcgtttcttcagactgtcatagcattacatgtatgtccaccttactatatatctagtccaagctacattattgtcaattagtaatggttatttctttttcaatttgatttgtttataatcaaattgacactcaatgaagtaacatgaggtcgttttctatatatgccagatatttgcaagcccaatgtacgaattcttggacacaagattcggcagtggacatggtggtccttttgcaatccacaacataatgttcagagtgggtgtcagaggaggctacctgaccgtcaacaccttggtggccgcgatgctccccttccttggcgacttcatgagcctgacgggtgcactcagcacctttcccctgacattcgttcttgcaaatcacatgtacctcacggtgaagcagaacaagatgtccatcttcaggaaatgctggcactggctgaacgttgttggcttcagctgcttgtccgtcgcagctgcggttgctgcggtgaggctaatcacggtcgactacagtacataccatttgtttgctgatatgtgaggctggaaagtgcaagcatgcagccctggatcagctgtaaattcgtcctcttcttttttatttttttggttaggggatgcatgtaggtcgatagaatgatggagattgcaataaataatttggctaaaatgttgtccagatttggttgtttgaggtgcaagatgtttgcctcaaaacgtaccgctatggttcactttttaagaactgtactgctacctctgtttgcggagatttttgtctgcaggcatgcaggatgaatattattcaagtgctctaatagtttgatctcagcaacatcaaactgtccttagatatagacatagataaacccaccttttaattttgtgaattttaatcttaattcggagaatttggcactaaacaattttcctttttgtttacaaattaggccctgtttagtttagcggtgaaaagttgttgtgtgtcacatcggatatatggacacacatttgaagtattaaacgtagtctaataacaaaacaagttaaaaattccacctgtaaactgcgagacggatttattaagcctaattaatccgtcattagtaactgtggcaccacattttcaaatcatggagcaattaggtttaaaagattcgtctcgcaatttacacgcaatctgtataattaggttttttttctatatttaatacttcatgcatgtgtttttttctatatttaatacttcatgcatgtgtctaaacattcgatgtgtcagggtgacgagttttttttgcgtagaactaaacagggcttaaatgcctctgtgacggtatttcaagaaaaatctacaattcttccaaaaccactccatatcctaattttagtggatggtccgcatcatgtaaaaaataatcactaattatgattataatcagtttctaaattttagaattaattttgtagcatttttgtcactttcattgcccgcgctcttaacttaattgctaaaaagacaagtaataaatctaactaaaaaatattctttgaaatcaaactttaaaaattcaacatgcttacagctatttttagcttctaatgatgaagagtataaatagatcactctagagcttttctttggtttgcttatccttatgcttataaaccttttgatttttaaaaattaattttgaagttgattttatggtttttccttttattgtactttatcttataacattttattttgaatcgattaggacacggatacaaaaatttcacccacaactgtttttttattgctaatatactatacatatacatataagtacaagcataagcaaaataatgaagctgttattataatccgaataaagatatggtcatcgtggccattcacagtacaagacactactatgagtacaagacactactatgaggagcatcagactcccacataggatgaagatagaggtcctaaatcagtttctctcacagtgcaaagtggttctaggggtgttttaattttgcatgtcaacctatgtcattttctattttagtcctcatattttgtaatttttaggggacccaatattttacaccaaacaccctagaaataaaaataaataaattcgccctccatcctcatccagtcatcccgcactccctctaacatttcccctctccatcgctctccccccacaccagcgccgctctccatccccatctctgccacttcctcttccccaccgctagtggagctccctttccactccaccgccggcaccgcttccccttcccctaccggtggcgccgctctctctcgcaccccaaagttggcaccactctctctctctctcttccaccggcaccactccctccactttcctccactattgctcgactgagccacgctgatggccacccctgcgccccctcctcgttagatccagcctaagactcaccggatctggccttgggagacaacgacgagagccatgcgaacttctccttgacccgggccaaggtctgtgtgagcatggtttctaggaagaagatcttggggatggagagaaggtcgtgctctagtgcttggcagggagcggaggagcgcacgggtgatgaagacacggtggctagcattggctggtcgaggggattgttgggcctatttggttctctaccctaccaattcaatggtagtgccaaaatctaggcaaattttggcgctaccaattctttggtagggtagagttcatataaatgtgtttggtttgctactatttgctatcaatatgctttttatagtgaagaaagttctagagtactaccaaattaggtatgagcattgccgatgctttggctctaatccaaaccaatcaaactactatttgaattgtcaaacaattggcagggcacattttggcatcaatctaaaatggcccgttgtcgctccatttgcctaaccaccttcctccttctggtcctcgttgtggtggtaaataggagttcacgaggttggagaacatatcagagagacggagatgcttcttgcagttggtggcttggaccttgggtcccacatgtttagacggtggtggtagaacaaacaccaccactaggaacattttaaaggagtatagataattgcttttttaacataatatgatatagattttacctcgattttcattagcacacttttcaaactactaaacgatatgttccgtgtgaaaactttctatatagaagctgctttaaaatatcatatgctaatagttttctcattttatgtgcaaacttaatcttcatcttcatcagtttcaaacaccaccaataagttgcaatgttcattttatattataagtcattttagtctcgtcctaagtcaaatttttatagaaaaaatatagatgttgctaggttttttttatgaacttgtcaaacttggacaaccccccaaaaaaaaattataatatgaaatggacatttaccgggcaagattattaaaatccaccgggccctcaattacattcgttagtgtttgtattttgtatatgtgcctctgtcttagttacggcgctgggcaccctcttctgctgtaagcaacaaaagtaaatttcacaaaactacagatactatgtccaattattaaaagccaactcttgacgagtttctgaacggttgccaatgatttgaatagtcactactagaaaaacaatcttttatcctagtccccaaagcataaatatctcgattagattaaaaaccgttattaaagatgttttagtaccggttctaaaagtccaagtccctagaaacatctttagttccggttggtgttaccaacagatactaaagatgcctccagggttagttcaaaaagaaagcatctctttccaagtcatatgtgtgtagtacgtgggatggtaacgcgcgtaagggctgaggtgagagattttgagtttgaatctcgatttactggtctcggttgctacaaccggtaataaaaggggttgttaaccggtagtaaaaatgagttctcttgtagtgagttgaacgaccatgacaagatttattggtactaccgatgagtctagtaggcccaatcctaaaatcaaaggatcatgaacttcctaaaaagtgttaagtgaatcagaaaatgaggcatgccactattgtaagttatgtgagaaagaagaacatatgaaagttaagttgccatcgccaagtgcaactgcacatcaagaactaatgcaaatgtagaaagttcaatgcaacacgagttaaggaagaaaaaggtgcacctagaattccatgtatgacttgatgcttgggttaggcattttgacataaaaaagtgcatggtgcttagactaccagtagttgtgggttgtggcaaccaccatagatctcattcgttggtagaagggaagagggttctccaccatacatggagaacatcaacaatggcaacaggggcgtggatcctaagattctggtggagaggtggggagatgcggcgtgggcaagggaaggggaaccaggaaggagggatcgatgtggggtgcggaaagggggaagggtaagggagagggtttggagcattcgtttaggtgcatgcaaaggggagagggttccatgcgaaggttgagggaggtacgtgggttgatttgagccgttcgattcaatgatttttggatcgttggatttgatgaatacggtttgtagtagtacagttggtgaactatatataaataaataggaaggaaggatagaagaatagataaattagtcacaatatactcccttcatcccacaaaactggtcgttttactccttcgcgattgtcccataaagctggtcgttttatcatttggagtagaaaagtgggcacatctaatatgaggctatcatgtactactattagttgtttttgcttcacaagactttatgcccgagaagttgtaggatggtggtgtagtgcaggagaagggggacagtgaaatagttttagtacctgcaaccggtaataatttagggtatgttgataattttcctccaaagctaatttagctgcacatttctaggacttccagaattttgggacgaagggaatatcatttaggatgaaaggatagaagaatagatagattagtcacaatatgtcattttgaacttagtttacacacattagataagtttgtgcaccataataaataatttacaaatttgtacactataaactacacccatctaatccatagctgaaagcctctgtttggatttctactgtgaaattcaaaacaaaaaagtgttagaaaaatactcctactgggctcgtacaggcgcccatcttttgtcccctcgcccgcaatccacccacctctcgagctcacaaaaatcgctcgccccccttcaccttcacctcgctcccgccgccttcaccacccatctccgccctcgtccgctcgccggcaagccgctgctgctgcagctgcttgctcgtctcgtctccccatccctgggcggggcgcggtgggaggggggcgggggactcgccaccgctctccgttccgtgggtgtctctgcactctgctttgctcctcttcttccccccctctggttccacccccgcgcggcggagcgcgggggaagggatccacagatgctgttctgctgccctgcttctcctccccctccaatccaagcttcttctctcccgccgttccggacgaacagcttgtctccgaccgtacgtggcgggaatgccgcgccacgacgccctctcgcgcggtctttctcggccaagaaccggtccccgcgagcgcggaaccgccacgcggcagcaggtgatggtggtggttatgggtctccggagcaagaggggcgtggggaatcgtccctcccgaacgccgaggcgctcgcgtcctcgctgcgtgattgcggcggcgcggacggcgtccggcgggtgcacgcggttgctgtccggtcgctcgacagcctggggacgttcgtcgccaacaatttgatcagcgcgtatgccaggttcgacgaggtttcggatgccagggaggtgttcgacgaaatgccggagaggagtgttgtgtcgtggacggcgatgatgaatgtgtatctgaaactaggacactacggcgaggttgtgaggctcttctttgatatggtgggaagcggagtgcaaggtaacagcttgacttttgtttgcttgctgaaatcatgcggcgagcgttgcgatgctaagctagggcagcaggtccactgttgtattgtcaaaggtgggtggagcaatgtgatagtggacagtgctattgcacacttctatgctcaatgcggtgatgttgctagtgcttcagccatatttgataagatggcctatcgtgatgtcatctcatggacaacaatgatcacagcttatgtgcagcatgggcatgggggccaagctcttagaatgttttcagaaatggtgtcagaaggatttcgaccaaatgagttcactgtgtgcagtgtcctcaaggcttgtgcagaagagaaagctgtgagatttgggaagcagctgcattgtgctgttttgaagaaaatgtacaaaaatgacatccatatcggcagtgcccttgtcaccatgtatgctagatgcggtgaagtttttgatgctcaggcagtgtttgatatgatgccacgaagaaacactattacatggacttctatgatctctggctatgcacaaagtggccatggagaaaaggctatcttgttgttcagaaagatgaagatgcgccgagtatttgttaacaacctcaccattgttggtctcctaagtgcctgtggctccttacagtcgccttatcttggaaaggaattgcatgctcagataataaagaattctatggaagaaaatcttcaaattgggagtacacttgtttggttctactgtaaatgtggagagtacacatatgctgcaagaattcttgaagcgatgcctgaccgtgatgctatctcatggactgctctgatttccggctacaataatctaggtcataatgttgaagcacttaaatcattagatgatatgctatgggatggtgtaaaaccaaatacatacacttactcctcggctctgaaagcttgtgcaaaattggaggctctgcaatatggaaggaagatccatggttttgttaacaagactcaagatttctccaatgtgtttgtgggaagctcacttatcgatatgtacatgaggtgtggaaaagtcgacgaagcccgaagtgtctttgatgccatgccagaacataaccttgtgacatggaaagtgattattacaggatttgctcagaatggcctctgtgaagaggctttgaagtacatgtacctaatgcaacaagaagggcatgaggttgatgattttgtgctctcaacagttctgacatcatgtggagatcttcaatggaaatccatctccttctctgactcagttgctggttcagtttcagctaggcagtagattagttctcccgtggcaaagaagctagcacttctgtacagttacagagatttgttattgtgcaagatcagaagacatgtagcacaaaaaggtaactcaaggagtgcatacgtgtatatgtacttttaagagtaccactaccttcactaaccatttgccttttgggttcattacaaaccatgcatatcttcagaagaaaaattgtgaaaactttagaatgttttttatgcctgttttaattcccactatggttatctctatcattacaattgcattaacatatgatctgcataataagcataatgcttgcacgcattagcagctaaatcattcttccatatcatccacttatccacttaggctgtgttcggaatcggacgttcccagcgtgcacagtaagtacggaaaacgaagcggttcattagcgtgtgattaattaagtattggctatttttttttcaaaaatggatcaatatgattttttaagcaactttcatatagaaacttttttgcaaaaaacgcaccgtttagtagtttgaaaagagtgcgcgcggaatacaatggagaggggttgggaaccttgagttccaaacacagccttagagttcatgctgtgactgcaaaaaattaaagttcatttggtaattgaattcattatagcaagtgtatgtttttttttcatgaaattgatatattttaacttaaatatgggttttaacatctttatttcatacattctctatttgtttttttattaatctaaaccatcacagtaattcacattcactacaatatgagggcatcttgttcttaaagatcgtaacatgttcttattttatcttgtttctccacaattttcctagtttattttcaacagggatttgaagtgctgtcctaaatttaacaaactgaagactctggtacttaatgattggtgtgtggcttctgacctcaatgcactaatttattttctgcaacactcaccagttctggagaagcttacactacagctttccaaggtacaaattttgtatatggatagctgtctgttatcaagttatcgtccacgatttatttagttaaatatcattttctatagacatgaaaagattcattgcaaacaactggaaattacaagtatcttaagaaggttccatttgaccttaagaaggttgaaagcaaatgtgatgaagttgatgaaagagtttgtgaagttctcaagatcttgagtgcttatgtaacaccgctccaaattgatatgagagatatatgtgagttaaatatttaataccactcctttcaatttatcaaaatatctataaattgtaaccatgcagtgaggaaaatatttggctaattagagggaagcaattgttcaggacaggtagaaactctccccatatttcatgaacagaaagtgaaagcaattgtcaagcatcatcatacataagcatataaaatgagtttcgtttgaattacaatgtacaatcaaattatacattcagtagtttcgagttttataaagttatacattcagtagtttcgagttttataaagtgatggcattatcaggcgctgttctctctaatttctgttctggcaaactgtaagcaaacatcctcaatcctcataggcaaaataacaccctctgtctgacctttgatggaacatgatgactgtgagtgccatcaaaggttcgacagagggtgaatctatgtttctccatgattatttagtgaatatatgtttctccatggacaaatagcacatcctatacaatccttgcatatgcagataaggtaaactaaagtgattcctattaaattttggaattatggcggttgaaaatataaaaggtggaaatttcctgtattcagtcctggaaagggaaaataaaaacgcatcactaaatttttttcagtttccggattgattgatatctatcaaactagtgtccctgaaactggtttacattggcacgcatcatgtatcatgtatgcactagaatactagatgtagttagtcaggaactatcaagcacatcttgcaatttcactcatgcctattttatctgcttcgtatagttgataagatttgggttgttaattcatctactatttgttgattattcagaaatagagcatctccctgagtttcgcaagataactttagtttcatctcaagtatgtgttgctgaagacatttcatctcttataaatcttaatgttgattggatatgctgttgattgcaccatcacaaactcacctaaccagagctgcatgaattgctctaggatctcgtatcactcgcattttctgtcacacatggctaaataattacatgaataatgatcaagccgactataagctgagttgcaccatcatctgcaatttctcctgtgcagatttcaaccatatatactccccccgtttcacaatgtaagtcattctagcatttcctatattcatattgacgttaataaatctagacatatatatctatatagattcattaacatcattataaatatgggaaatgctatgatgacttacattgtgaaacggaggaagtacaactgaaggcggccaaaaggaaaaaaaaaactagctgtatgtactactgtaaattacaaacgagcctagtcaatgccatttgccaatatgcgcttataatcagcatcacaagccagtgacttcatcccttggaagactgtgctacgtgtaaagatccagagggtggggcaaaacttgtattgccgataaaccagtagagaacccacttcaagttgcacagcatgtattttagtgcttttgtccaattgtcaagtttattgaaacttaagaagattgtatagctccctactttgtcaccttcaatcctgcaagcgaagttattcaagtaaagagcggcacaagcaacgttgtgtatataagatatatccaactgtcaaaatactagtcatatgaacaaaagagaaaccataaccgcataacttactaacctgtcttaattattttgttttatcactagtaaaacctaaagtatttacattgatttcacttaggtgatgttcaatgatggctaatttgtgtcttagcatgaaccatgcaattcatatactaagagatcatagtataggaaagttgcaataaaacttacttatatgggagcttcaatgacttgtcaggtggtacattgttctctttatccaaactaacagcaaaatcagcaaattcttgcaagcaagtcagaaaccatgtcatggctttgtcaaatcgggtactccagaataaattcacaggaccgaacctgaacattaacagtgcagcctattaacttggtataatgtaattccactgtgcaagataagaataaatatacaaagtaaacccccagagtgaattttccaaaattagaacggccgccaaatgatgattttataccagtcccaaataattgcaccactcaacataacatgtgctcagtgaaagcgaattgacaacatgatttatttaaaagtttgtggatgtgttaaccaatgtaaaagaaaattattaccaccaggaaagtgatcaggtatgacaaaataagcataagttgcctatttcatgagggacatcctagattccttactagcagcagaatttgttcttcagaaaaaaatataatatacattatgaaaataaggaatattacagtaccaatattttacaagtttttgaaaagagaataacaaagggagtacaatttccagcaggaagcttacagttcatatgtattttggttgatgtctgtaacttttggatagcttcccatagggtgaattttgatccggtatctagataaatgttcaggtagcacaattatcatttcgtcaacaattgtagagtattaggatttgtccttttcaatgtacatacacatttttaatgctacttatgagagaagatctgctaaaaacacatcatgcaatccaataaaagactataatatgcaattatgcattcaccctaaccaataaccatccaacactatctttccaacttgttataacatatagacaagctcgattcatatagaataaacatattttgaacacagagccatacagaaagaacaaagcaaacaactacatggagtaacaactaaaatgcactgaaacatgtatgtcgtaatgttgtataactagttgatggaggtaaatgccatgtatgaattacttctcaagagaatgaccagcaaataaactgtagcaaaaataatgtcactgtataaaggatactcaaattttgggaagaagtactgagccatggtatgcaacagaagagcagcctggccccaagcagcatttatctcatcccactccacctaagaaaagagtaacacagttgttacattaacacaaaggatcaacatgaacattccatgtacatcttgaatagaattcaaggaaagcactaaaagatagtgaatggacgtgatatctgcacattttgcataattacctgtacattaggaaggcggccaagacgaaagttgtttattgttccgatcaccccatcatgtgaaatatagaatgcatcattgagaacatttgtacgctttaacaattctagatgaacctgcgaaacttctatcttggccaaaaccgcatctctttcttcctgaaagtgacaaaaaaatgagttattgacaggcaaatgcttgcaaacagcccagacattatgaagcttatgtataaggaaccaatacatattataatatctatgctcctataatagaaggtagtggtgaactggtgatggcagtgaatctgccaacccacttagtcccattgaaaattttataaattactccttgagcgtcttcatgttaaaagacaaccaaatctaaatggatagccacatataaaatcaaattaaggtgaatattccttataacaaaaggatgggcaacacatttcatgtaaaatatatttttatttattttaggcaatactatagtataacgtagcaaggcatgggcattcagctagttattttctattatgaaggcagcgcaaaacatgatagtacagacacagagcattattcacaaacaatgttaatttttaaagaggtttatttataccaacaaaagtacaaaacatggcagctatagacttagtttatatagctttagctattgagtatatgacaaatctggaatatagtgcatttggttgtttctatgttctgctagaaaataacaatgtttttaggtttttgtgctaacaagaagtcaaaacatgacatcaagaaaatagtgctaagtaaatatttatagggcctgtagtaggtatttacctggtgagatatccactgaaactgaaagctattgagatcatggcaatacctgtttcaaaaatatgataaatcagatttgtttaacaagtaactgtagaacttcacaaataacatgagccaaccaaatatttcagattgcacaaaaccactagcaattgttgtagcgatataacaaaacatgtgtgggatgtattatgttattattcccaaataatgatactcctattttctgatgtcgaattgccaattatattgaatagcacactgacactctgttgaataatgtctagtttcaggtgacaaatataggtacacattaatgttttcaatataacagttgtattcatagcctataacaatgttacgactcatcagaaaaaaaagagagacagagaagagtcgagagcctcctgcaagtatgcacatgcacacccaaaagcaaattataaatcactgaagactctatatcactgattcttgtagagaaacttcagagttaataataagaacattcaagaaaggacaaaatgaaaaggttaattaaaattttaacctttcttccagttcttcgaactgtttagattttgtttcaaggcacttcatctcggaacaaatttctgaatattgcttttcagcttcctcaattgcagctttaagtttcttttcttcttcctcaatctgaaatggcagaacacataatacatttagttccatgaaaatcatggccactgaccagtcagaggtgcttattcttttttttttcacataagaaaggtcaagtaggcaacttcttcaggaactgttgcacttcaacatttttataagtgggcaagaattctcttacagagaagttacaagggaattatttgttcatttaaaacattgctcactacctatgtgtttcatctatcaaaagaaacttctgccttacttatttttgtccaaagcagcaggctgtcatgcactttaggatctcattaatcacgatatgaccataaatatgtaagaaagattaccaccttttgtctctccttctgaaagtcagtttcactgaggatgttataggtttcctgctccagacgttgaagacaggcctcataagctttattgtcagtattaacatcttcaatttccttctccattttatcagacagcaacctcatacagtccagacagagtggctgttcaatctacaagtatattccagattatcagcggtcttgacattgttcctctcaaaatactaacagatggcaatgaaccctcaacatatagtagcaaaaacatgcaaatctgatgcaataactagcaactgcacaagctaataaatgggaaacaaaggtaaaatgacagaaatggcaaaagcacgtgttctcattcaatacagaggcatcttacagaagtcattgtagtacctgtgtttgtgatgtagcaatctcaaatgcccgttttaatacagtcacgctagagtgaaaattatttcctggtaaagggctaccggggttcatacttgttggtgacaactgcgcaccacctccttcagaggcagatgtcttgtatatggaagcggcagcaggtggaagcactatatatgatccctccattgctcttgttggttggttcggctcggcacgcgggatccctgcgcttggcgggcgtgggggaattccatggctatgtgatctattttgcttcgatagcacgacataagagttgtccatcctgctagcacccataacgctgccctgaacagaggacacgttcatacctgcattgataaaaagctcttgtaacaaatagtgcagcaattcctagcatttttcaaccaatcatgccccaatttcctggctcatgcgatgctaataccataccaaaaccgaataaattttctacctatcgattccgattcgagtcgatggaattacgacgagccaacaaagggaaaagggagctaatcggttgaggaggcaagggttaccggagacggcatgagcggggagcttatcggtgaaggactcgacgccgacgacgacgagcgcgcgttggcactcctggcacttgaaccgcggcagagacgggtcgaccccgccgcccttgtcgccggcagcggcggcggaggatgcagggggcttcatatcgccgcccgacagagcaggacgcgagcgctacctgcatccacgaatccggcatcattcacctcaccagaaacaacggatcaaacgaaaatccctccaatcaaaaccctatagacagctcacgagctccagcacgcgggctcaccaatccaacgccgatccggagagcacggctccagcctccaggggcggtggagtaccccgcaggaaaatcgcggctaggcggcgtcgcggggtgggggtttgaggcgtaggagatgagattccggcgggggcagagtccgtgcgaggaaggcgacggggggctcacgtgcgcggcgcggagagacggcggtcggagcggcggaatcgccggggagggaggagtcgcctgctcgggagtcgagagagagagaggtagcgtgcgtgtgggcgtacgtttgcgtagcgtgtaaactgtaaagtttgtgtgggtgggctcaggcctgtggttgtatgcgtgtgggctacgtgggccgcgcggggaagaagagccgattgagctactccctccgtttaaatattggaaaaagtacaccgaaggtccctcaacttgtcatcgggataaaaaacgtcctcgaaccgcaaaaccagatacgtaaggtctcttaactatataaaaccggtcacccgaggttcttagatggttttgaccccagttttatcctacgtggctgctgagtcagcgtgggacccacatgtcaggatgccaactcatcacatctctctatttcccctcctctccctttctctctctctctctcacttttctcaggccgggcggcgggtgcggactgcggaggaggctggcggggcagccggcgatgggcggactgcggaggacggaggcggtgcctcgttttggcaggtcctccccttttctctcccttcttcctctctctctctctctcttactcgttttggtgggccggtcggcgggagcggaagaggtctggtggccggtgacgagctacacgatggcggcagcgactttgtgtggcggcgacaaggatggagttgacctgcagatagagcgctgcctttccccacaactcccgcaccgagcgcacgtgaagagggaggaggcgggaaggccagcagcggcctgttcctcgtcgtcgtcgttctgcggcaacaccagctgccggacctcttcctctcccctccccccagcggcgcgcggcggaggaagccgcggcgccgtcctcctcctctcccgtctcaccccatcgacgcccgcgccatcccgccgcccgtcgatgcccgcgcctccccattgacgatgggggcgaggttgacggcgatgggggcgacggaggcgccactctccccagcgccaacaagtccccctcatcctcgtcctccggggcgctcgacggagacgcggcggaggccgaggcgcgccgccggctgacgagctcgctgcgggaggcactcgggctgtaccgggacatcctccgggtcacgtggctgttcgagtggcccgacgaccgtggcgattacgacggcatcgtgacggagtacgacgtggagtgcggtgtgctggtgtgggagcgcgacgagcacgaggggcggcgggtgtgggcgacggcgcggcatcgccccgtcctcttcgcgctcaccctggccaccgccgcagtcgccctacccttctcccccagggcgccggccgccgtcgcgccgccgccgccctcctctctcccgtctcgcctgccgacgtcgcgccgccgctttgcctcaccgagaaaccgcctagaaagagagaagtggaaaaggagggaagtgatgatgtggcttcctagcatgtggggcccacgtgggtcccacgctgactcagcagccacgtaggacaaaaccggggtcaaaaccacctaaggacctcgggtgaccggttttatatagttaagggacctcgtgtatctggttttgcggttcgaggacgtttttgtatcccgatgacaagttgagggacctttggtgtactttttccttaaatattatttcctccgttttacatatatatgtctagattcattaacatcaatatgaatgtgggaaatgctagaatgatttacattgtgaaacggagggagtacaagacattttaatttatgtcaaacttaacttcaatcatatctctatctttttatctctactataaaaatttaaagatgttttcacaaaaattttgatatgtcatccgtgtttgagttggtttttagtttgttatatgtcactcgtattcaattcaacatgagtctagaataactattgtacactcatatcccaacccaacccctccccctcccagcccaaaccatcccgttgccccatcctacgtgccaccactcggtgctatgcgcgtccttcctcgattggtgtcttttttttctttttagtcttcttttctcccgataattttgatcctctcctccttccaatctcctctcttctctcctcctttctctttttttcctcttttttctctcctcataaatattttccttttgaatttatcattgtttaaggtgtgcatgcggcaagccctatcccgcgcccctccactcagcatcgtgcatgcccttccccgaccggcgtattgtttgtctccttttctttctcccgataatcctaatcctctccctctccttccaatctcctcttttctcctccttttctcttttttcctcatttttctctcctcaaaaatattttccttttgaattctcattgtttaatttgttactttgcaaatatttttcatctacagtgaaaaaactttactaattgaatagtcaaaatttcaacatttgatctatgaggttgttgatgaaaaaatcaaacacactggcctgggagatctgcttagctcctgtgcaggtccaaatcttgatgagatacgagcgtgccagtcagtttgatcctgcaactgacaagatatgcaaatagtagattaaaacagtcgatcggctgacaagccgatggagtagttccagcctatagccgataatagccgatgccgatactagccgatagcgatagggtttaagcaatcagctatatgtccaatgtagataatgatataaaggcaatcggctgatgacgatgtaatgaaataacaatataatccagtataaaccaatcggcaaataatgatatgataaataaacatcgatccgaacgttaaagcatacatcggctggaggtccgatgtcatgaaatcaacaagattagattaaacaataaaacctttgttttcacaggctaaatccaacttatatatatatgcaattcttatgagccgatgcaacgtccagataactcatcggctgaaaccccgatgaaacccttattggcaatcaagaagtaggctagagattatggttctaagcatgacttagtagatcaaacttaactgatgcaacactaagtatgaaaagaaacataatatctagacaatcaagccgatgactgattttcagggtggtagatgcctaggctaatctaatctagcaaggcgatttagccgataccagcataaaccctaaagcgagaagcagctgatagagctaaattgatatgctaagactagattaacagagacatatgataaataggtaggcaaatatattatccataccagagtaatccaagaggtcgaatgtactgatgcagccttaaacgacgtcagcgtagacgatacaattggctggaccggcgaaacattggacttatcccttcgccggtgatcaaaaatgatgcagcctcgcgtcgggtgccaagttccgccagaacgtaaaaacaaaagtagaagtaaaaaggttggcgatgcgccgaattgtattgatcgtagcgattacacagaccccgggtgtacatatttatacccatgggttgataaagtccttgtcggacaagaaagaaactttcctaaatataaaaggtaaagataaagtccttataagacactaaacacactttcctaaagataaaaagaaactaacaaactattcctaattaatagataacttgccatgccgcattctttttgaactcggtctcttctggataagcttcctttagtagatcaatttccttaaccgaatatagcaagaatccgacaactgacgacttgacaactctcatcagctaatctcaggacttcgaagccgatgctgactctaagccgatgactacttcgggcttaccaaatttcactgttaacagaggtatagcaaaatacacaggcgccaacttatggaataaccacccaatcattttgtgaggctatagaaaggtgtacataaacgattcttcgtgtgatgacatgacacatgaagcgagcacaaccaggttcaatcctatatgtgatttatgactttctttttataatgttttgtttcagtttgtcatttaaatttgtaaagtttttatcaattatgaaaattgtcttcacctgttgcaactcacatgtatttttgctagtttatagaaaaatataacgacatctacaaaaataaattatatttattaaatatagctttatatatatatatattttttgaaacctaagctttaaatatattttaatactatatttgtttcatgttaaaattattattattattattttctttaaatctggttaaaattaaggaagtttgactttgaaagttccactagagagtagaacctcttgtgtgctggcacatagagcgtgtttggctaggtgcaccggggatcatcccgcgtgcagccagcaacatatttggttgtctacatggacatgtaagccaggattcgctagtgcaaaaaggcctccaagccaagctgagaggaaccgtagaaatcagtcgtacctcctcatgtaggcccgactctcatgtgggcacggagatgggcaggtacaggcgatgcacaaagagttgacacatccaatcatccccttcgctcatttgatagctgtcatcttcgtcaatgcatatcttcttcagcaactccaaccgcgcctacaagctatgtcatcagatctagcagccaagagctcgatgccaccatatatagcctttaaagagctcgagctcgcccatccaatttaactttctcgcacggaggatgtacatgaacacatgcacatgccattatgcacacataccacacgagtgtccttttttaaaaaaaaaacatacaagagatatatgcctttaaaattagatgatcacctttaaatattgtatgatgatgatgatgatgatggtttaggtaaagaatggacttagcatgcaatttacgcttttgattaatcatcgagaggttaaaaataattgaaattaaattaatatcatgtagctttatgtgatacaagtaagagtaatttatactccctaagtttcatactataagcccgctttgacttttttatagtcaaatttatttaagtttgatcaagtttatagaataatagaataatatagtagcatttccaatccaaattaaacatatcatccaaatgtattcaatgttagatttaataaaattaatttgatgttttagatgttactaaatttttatataaacttgattaaacttaaaaagaaaaaaagtcaaaacgacttataacgtgaaatagagggagtattagccaattccaaagatcagaaacgtacaaagtttaagatggtgtagctttgtgtgacaaaaaaaagaagaaaaaaatatgaattacccctccgaactatcgcggtcgtccgaactacccctgaatcatgaaaccggacattcttcacccccaactatgtaaaccggacgaattacccccatcgaatcaattcagagcggtttgatccaacgtggcacacacgtggcaatccagtcagcgtttttttaataaaaaattgtgggacccgcctgccatactcttctcttcttcctctctctcttctctctctctctctcttctctctcacggctcgcgctacgcgcacggtgaggactgcgcggggacgggcggtcggcgactgcggaggcagcgagcgcggggaggcgagcggcgggggtagggcagtggtggaggcaagcggcagcgggagctcgtgctgctcgcacaggaagcgaagtggcggctgctgacgaagccaacggctgccaggtgccgcggaagacgcagcggcagcgtcgaggcgaggcggccgccgacaccatgcgcgacaaccagccccagcccgcagccgcaccttcctccgcttagtcgcgggcgctgccttctttttcaaatggtggttcaaatcatcatccaaactcaaaccaaatttgtttacaaacagcgacatttcatcgctcctcctacacggcgttcttccacttgccgaccaccaccatgagcgcgcggcgcgatgccccttccggcaaccacgccgcctcctgcagcaccctcgcccagcgacgcgcggcgctccccttctcccctggatccatgagctccttcaccgccgccgcgacctcctctcgtgtcaccaccccgtcgccgtcgccgggcgtagcgcaaccccgaccacctccgttaggatgaccgcgttcaccttctgctccacgtacagtggcaccaccatcggcatgccggcggcacgctctccagcgccgagttccacccgtagtgcgacacgaacgccaccatcgccgggtgtgacagcacgcgcacctgcggcgcccatgacgcgacggcgaggccccggcccctcgtcctctccaagaacccatcgggaaggcacgccagtgggtcgtcgtcgttgcggtggtccgttccgaagtcgtaggagtaggactcgccgtcgtggctcggcatgcgcacgacccagaggaacctgtggccgctcatctccagcccggcggcgagctcgcgggtctgctcaacggacaggatgccgccgctcccgaaggagacgaacaccaccgaccctgccggctggcgatccagccactccaagcacgccgactcaccggccttgtcggagcttgaccggacgaacggacccaccgggtaaaccggcgggaacgcgccttgcttcgccgccttcttgaattcttcgacgatggtgtgctccatctcggcgaagctgttcaccaagaatccatccgctcgccggtatcgccgtacctcttcgaggatctaccaaaacacggggttggacctatcgaggtatccgtccggcatgtcggcgacgcggatcgtcatgtccccagcgagacggagggggtccggcaggtctagcttcgtcgcgggcgctgcctccgccgccgcactcgcctcctccgcagaaaagagggaataggccggtggcggtagagaggaaagaggtgaccggcaagctcggtcgagctccgccgcctcgagggcctctcaacgggaggaggaagagggggaccgggaagccgccgacgaaagatggggaaggggagaggcgcgccggtcggcgtcgccaccggtgggtctgccgcaaaggaggcacgccgatgtcgtgctcaacctcctctccctctctcccgccgccgctctgctccactctaccggcggccgcgcgcttgcccacttgctacggtcgctcaccaccgcccgctccactccgcctgccacgcgcttgcccgttgcccctcgccgcgggcactttgctccacttcaccggccgtcgccgccgttgcctcctccgccgcgctcgctgcctccgccgtcgccgaccgcccgtccccgcaccgtcctcgccgtgcacgcagcgcgagccgagagagagaggagagagggggggaagaagagaagagtatggcaggcgggtcccacaattttttattaaagaaacgctgactggattgccacgtgtgcgccacgttggacaaaaccgctctgaattggttcgagggggtaattcatccggtttgcatagttaggggtaaagaatgtccggttttgtggttcaggggtgtaattcggacgactgcgatagttggaggggtaattcgtactttttcaaaaaaaaaagacaagctagattggattaatcatctaaaggccacaaacaactaacattgggtcttcatgagagaagggatggatgacaataactctacttggtggggttgacattatcaaattactatattatcaaattactattgagagtatataaaccatgacagttggaatcgtaataattggctgtagctcgtttgagtaaaggctgggatattatattccatcttttagatacttaattaagctttgagaatttctcaaaatctaagtaagcagtgacgttttttctcctttccaatccatgattttaattcagtgagaatcgctaaactgagggcatgcgtttggctcctggttgactttataatcctagccaaattttaaaattagaattaatttatatagtttccccccctttttcagtagccaaatttaaaaattagaatctactccctctattctataatataaggcacaaccacttttcttagatgttctaaatataaggcatgcatacaagcatataattaattatggcatcttctctatttaattattactttttaaaatcctccactctcatgttatctaatcctattggatgcatgcattatatttattagaatgatccaaactacaagatgataataattatttcttggtatttgggttaagagtggttgtgacttatattttggaatggagggagtaattagttttagaactaattaggattttttttccctgttttcagtcctatatgtactgtgcatctcccgtttaggaaaaatgggggtttcgatggtcatgtaggaaatctccgttcaggtgttcagagttcagacgtttgttgacggacaagcggacgtcgatctgggccgtcaacagccagatggacgtccagaactcctcaaggccgtaccctgtgacgtaggcggtgactaagcgggaccttagcttccccaacgcgtgcggcaccgccgtcctgtagcccaccgtgcggaaccaaacaaatcaatccagcatataagctgttatacaaagcttcccaaacacagccaaggccacatcgagcagcgtcgtacaaaccaaagcccctctagactaacaagttaaaaatacagtttgtcaacggtgcaaacaatggcttcacatcgatgagaccaattggcatatgctaataatacatagcagaaataaatttaaacttcaaatccacaagaaaaaaattgcatctctcttacgaggagtatatatatatatatatatatatatatatatatatatatatatatatatatatatatatataattgttgcatatacatgcattagaaaatgtactcatccgtgtgtgtataaatatgggctgtgcaggcgccagaggaagacgcccaagctaatcagctaattaacccgatcacatctagctagctaactaagagtaattaggggctaattagtttcaaagtgaagtgaggcgatatggagggagagaagaagagcgtggtgctgatcaactgcgcggtgagcatgtacggcaaccgcgtccgcatcgcgctggcgaggaagggcgtggcgtacgaggagaagccggagaacctcgccgccaagagcgccctgctcctctcctccaaccccgtccacggccaggtccccgtcctcctcgtcggcggcaagccggtgtgcgagtccctcgtcatcctcgagttcatcgacgaggagttcgccggcgtcggcgagccgctgctgcccgcggggccctacgagcgcgcccaggccaggttctgggcgtcctacatcgacgccaagctggcgccgtgcgccgggagggtgtggcggtcgccggcgggcgccgcgggcgcggcggcggtggaggcggcgaggggcgagctggtggcggcgatgcggacgcttgaggcggagctcggcgggaggaggtacttcggcggcggcggcgaggcgctgggctacgtggacgtggcgctggcgccgttcacggcgtggttcgcgacgtacgagcggttcggcgggttcagcgtggcggcggagtgcccggagctggcggcgtgggcggcacggtgcgtccgggagaacgcgtgcgtggcggcgtcgctgccggatcccgagttcgtgtaccagttcgcatgcggcatgaggaagcacttcggcctcgacggctgagatcaaaatgagctcgccggcgccgcgattggccggccggtgcaaataagcgaaaccatcgcgcgtgcatgcatgcctgcatgggaaactatcatttccccgttttcgcggcaaggtctttggctatttttgtgtgcttcgcttgcgtgtgtactccctccgtctcaaaaactaataaatgaatcgaatatcacatagtataacgaatctgactatagatttgttatacatgttctagttaatcttagattggttttgtgggacggagagtacatgcgtgtgttttttttcgcaatagctttttatgtgccttttaatttgcttggcgattcgacattgacatatcgatgtgtgtgtttcttttgtggtggtgtgtgggcgtggcgatcgactgcaattcctgagttttgtcctaggtgaaatgttgtctgcttgcgtggatgctgtttttggagtttaaagtgctctgaatatgctgtaatgtacttctgtatgtgtgctgtattcagaggtggggaaaaaatatcgtgctatgtatgtcgttgttttcctttcacagaataaaagtggagtacacaagttgttacgttattgctaccgactattcatgcgtagtactcccaattattgatagcaaacaaaagtaccaaacaacggccaaagtatagtattgttgcattgtcaatatgttactgaattcagatcagcttggcagttagcacttttttttttttgggttgctggcattgtagctgtaacctgtaggggaaaaaaattctctggggcagggccgcagctcccacaccatgaggccccactgtagatgttagccacgtggatgagcacgaatcttggaacagtttcatcttctttctcttctccccccatctcccgtatttccgacctcctcccgggtcccggcggcgtccacgcaatcagcagttcagcacggcaacatcattaatcttaaaagatagaagtaaaatctattacttgcatatttcttcaccgtgatgatcgatttccattgctagctgctttgctgcttccctcccttcccatttctctattgcacggaatctcactagccatggctaatcaaggcaggacttttctcaacgttcatatttgatgtatgcatttttgaggaaggaggctaggagcagcacagaagatgcatcccaggtcgcacgtctccaggcccgtagatcgatctgatcacgcaccggcagggcggtagtccggaaccacaacgcgatcctaaaatcccagcaaccctagtgtaggttagtggcggcgatgcctacaaattcctgtgacgagatgggaggggcagagaaaggtgagcgaccgacagaagcaactcggcgaccgtggcggaaagtagcatcgacgccgccgggaggaggtcgggaatacgggagatggggggagaagaagaaagaagatgaaactgttccaagattcgtgctcatccacgtggctaacatctacagtggggcctcatggggtgggagctgcggccctgccccagagaatttttttccgcctgtaggtccttcgattcggaaggtagcaaatcaaatcactgacgggtgaccgcctaagtactactctatttggcccacacaaacaaggcccaaacaagagcacatacggcctgttggaagtggattttgatccattgagggaaggaataagttttatttgatccacctatttgtcccccaggactactttcatcccattatcacaaaaccggatacaaattatccctgatcttactaaaccgagcagaaaaagtccctcactattgctgatcccggattttatattacgtggcgcctacccacatctcttttaattaggtttaacaccatatgggcttgacctaacgcttacatgccatatgataccttgccaataatgcatacacttaggacacacatttacggtttcacataatattatttgaatgggtgcgaccctatgcggagccacagttcgtccacatactcagccattcgacttgttgtttttcatatacaccgtatacaacaagtatgccagtacaaacaggttgcattccacatggactcttgttggaacctgatccaacaggtgaaatatgctggataaatagttacgtttacaggactctgcatatcctgagaactaaacggagaaggtttactaacactacataattttcacggaattcatgcgatggtaataaggtgacaggaaagtgctggactattctatggag

SEQ ID NO: 3790 - DNA, 752 bp, Oryza sativa
  unsure (1)..(752): unsure at all n locations
ncgattgactggttagctttataagcatcttgttgagctttgtctacgttttcttgtgtttctctaacgtcatcgtttagtttatacgtatctgtatagtcacgtagacgtaaaccatttagccaagatttttcacctgttgtatcacggttcaacaagaatccaagttgaataaaacctgtttctactgggataatcgttgtattagcaaactcagaagagccactaatcaaatggctgtacttggtgtacgtagtaggtacttgtatatttacgtgaccattcaaatacaaatatgtggagccgtcagaagttgggctaagtgtatgccctactgggaaaatcccatctgaactatttgggtttgcaactgcccatggcttgtttaacgtaatcttgttagctgtggtgtcaactgcaccaatatcatatgtcctcatctgcattagctgactatacgttccatcgggataagtatagccgaacgagtttttataaccccacatgataatactacgttggtagtcttgcggtgcctgtccgttccatagactaacatcttctacaaaaacctctgtatccccgactttaagtggttttgctagttttgtaaatttaacaggggtagtagagttgtagtttcgtcccccaagagaagggtacgtaatacggttaccatctacgtcatatggggcaatcatagcatagcttctacctactcctgatagacgcttccaaatgnatccacccag

SEQ ID NO: 3791 - DNA, 764 bp, Oryza sativa
  unsure (1)..(764): unsure at all n locations
cgctgtggatcagtattcgctnctactgcagngcaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactcacggtcagcangagtttgccacgcgacatcagtcgaagattctgtatggaaatgggcgacgacagctccaggacattgatctcngcagaagg

SEQ ID NO: 3792 - DNA, 789 bp, Oryza sativa
  unsure (1)..(789): unsure at all n locations
tggggacttgaaacccnttgagtaaccnnctgaaancccntttnannnncgntnnnnntnnnnnnnnannnnccaccannannnncagtaggcgacttcagaacggccttttatgtttgtttttatctttcacgactaacacaactgccctcatctaatcaacaatcttgacaggtgaccacagcataccttgatatgtgcaataatttggactcatggagcttgaagatgggctctgaaaattgcagaaactaagttagagaaattaatcaagtcagaaccaccagtgattcacccctgctctgaaaaaaagaagagccgacaaggcagcgaaaagaacaaatcttacaagtaaacgtcgaaatgcctcatcgatttcatccacggtgagccctttcttctcaaggaaagaacgcctctggacatcaaaagaggccactacctttgggtgtttcagaaaaacgaacgggctctgaaccagctccttccttaccggttcaacggccgcaacaaccttcgaacgtcactaatactttgaacaccaattctagatgtcatccagttctgataatgcacgcccaaaccatccaggtaatatcaaatgtgataacacaagacttttcaaagtagtttcagctgaccattagtcacaaacaaagtgaaattaaacaagcaagagaatctttccaacggtcaaactaccactaatttaagctactgcgttctaattttttagacgttaaacgacaccacataccttttccgttaacttggtccatgccagaagcn

SEQ ID NO: 3793 - DNA, 1055 bp, Oryza sativa
  unsure (1)..(1055): unsure at all n locations
cagcgttgattggatagatcgcactgtagcacatcacgtcagggcgcgtggtgacagcccgccatcgccgccagctatagctgctcccgacggcgatgcacacgacgcgcggtgaagtggcgcaactcacgctgtgcgctcgtcccaggtgggacaagctcgtccgaccgattttgctggatggcttggtcccggatctaagaggaatattcctctccatggacctacccctcactcaccactaaaccaaacacccctaaaagtgggtttgccccatcccatccttgcaaccaaacactacctaggtgttacaccgttatttgatccatctttctatacaagttaatccattcatgttgtatgttcaagctgctaagaactctttaactccgtatatcacatatgcagtgaaacttttgcgggtgtccttaaacaagctggtgctaaagccaagttactactctatgaagggaaaacacatactgatgtatttttacaggttagtcattttgaatatgaaggctggaatagttacaccaggattcaggatggccctctgtgcacaaatttgctggggaaccctaacatatcgttccgttgtaggatccactaaggggtggcagggacaaactggttgaagacgttatttctgttatccatgctgatgatgcagatgcacgtgagaaggatgcattggcacctatcccaggccggctggtttctgagtggcaaataaagctggcacaccgaattagtcccttctgaagaggatccgagcaagaaggtggggatggccttctcttctcttctcccctgaatgcttttcttggattcttgtggtttcttggattcctctgaactggtatttactagtagtaactgtttactgcatgaatgaatggtaaatgctctacatggagttgcgatctcttgttcatgagaatagcgttgtgccggtagtgtggatctggttccatctctcatttgaacgatacgtttgcaatcatggcatgttcattcacatgcttacataagccaacgcgcggaatcaatgn

SEQ ID NO: 3794 - DNA, 6331 bp, Oryza sativa
  unsure (1)..(6331): unsure at all n locations
cagagttgaattgtctgatggtacagtagttcatcagtatggatacttagtcataaacataagcagctgtatcaagtttagaacttaaaattggttgggttatttccaccataagtaacataaccagttgagatacacaacttcacaaattaatcaaaaattgtattatctccgttctaaaatataacaatttttatatatgtatatggacatatgcttgtcttttttaagggaaaaccagcatgagagtgtgccttttaattaaatatagcgggagaaaaatacacccctaagagcaaagaaaagccaagtgcccaaaaaaacaggggggcggctatataacggaatcccattttcgaacgggatgatcccgagtaggtatcaggtgtgatacctatcaggtatcagccgattctacacaacaagatgatcccgagtaggtatcaggtgtgatacctatcaggtatcaaacaattctacacacgtttcaggtgatacctacaagtatcatgtgatacttatcaggtatcatgcgattttctaccacgtatcgcgtgatactcgcaaaggtatcatgtgaaacctgtcaggtatcaaatgattccacccacgtatcgtgtgatacttacgagggtatcatgcgatgtctgtcatgtatcagacgattttctaccacgtatcgtgtgatactcgcgaggtatcaacgattttctaccatgtatcacgtgatacttgtgaggtatcggatgatacctaccaggtattaggtgattccctactagatatagcatcaactacgatttatgttgtactattcatctgttttctcctttttttttccttattgacaggttgtgcaggtcgatgacattatggctttaatccatttggtaagtatatatgcggttctatgagcaacgatcgaaattgtggctttcaaggggtgtgaatttgctgtgcaaaattgtggcatttgaactgcatatatgtgttgttggggatctgtgatgttatattgggggggtgatgtatctgtgatggatctgtgactggaatatatctgtgatgtttctatttttcagagggcatggctagcaaatcctgaggctagccaatatttagcatttattttttttctggaattaactcatcagtgacgggtcggaacaaaaatccgtcaaaggtaacataacctgtgacggactagcaaataaaggcccgtcagaggtgacctacctgtgacgggcctttacttttggggccgtcacaggtagatcacctgtgacagcttctaactacggagaccccaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagtcgtcaaagatgagggtttgggcccgtcacaagtgaccttggccagtgtagtgctgcaccactttgtgctttcactaacggctgatcagctcaccatgccacgcaacacactagctaatttggactcagaccactacgtatacatgactgaatataatgaaaacataaacaacaagattaactctaacaatcaccctctaatcttgttggattttattctccacctccacaaccggtttcacagcaacgttggctcatcatccgcgtccgcgatgacaagctgcgtcactgccttggccatcttccgcggctcatcacactcgtcagcgaagtgtccgaacttgccacacctgcggcactcaatcttcgatttgttgaacttgccgcggaacttcttctcaccattgccagaggcctcatcactcttcttctctttagcaacaatggcctcccactcagtgcgtgtgagccgttgctcagcccctgcaataagcagctgctcctcccctgcgttttcacgacgtcgccccttggaggactcctcgaacgcccgcaaacgtctaattgtctccgtcaccgtcatctccgacacatccccccactgctcgatggtgcttatgagggattggaacttgtcgggaacggaatgcaagagcttctccacgacggtggtctcctccactttcgtgccgagagaatgaatctcgttcacgatcgtggtaaccttcaaagcaaaatcattaattttctcactattacccatgtacataccatgaagcactctcttgagagtttgtactcgggccttcttgacacgctcttcacccatgttcatctgcttgagggcgtcccacgcctccctcgccgtttccttctcggatatggccatcaccatggcctcaggcacagcttggacaatggcggcgagagccatttgatccatcttctcatcggctgcgttgccctccacggcagcccacacaccttgtgcacgcataaaaattttcattttcaccgcccaaacgccgtagttgttctccccgagcatggggtagcgtaacgtcacccccgcctccttcacttgctgcacgacgagctcatggccgcctaggctgccatccccgccgttgccgctgctgctgccaccgccaccgctgccgcgacggatcggtggcggcgtgtacacaccatctccattgccgctgctgctgccaccgccaccgctgctgcgacggatcggtggcggcggtggcggcgtgtacacaccatctccagacatggcacctgagctctgataccacttgttggcccaaaaccggtagacgttggcccaaccgggagaaagcctttctacaccccaaaagctagctcatgaggtaagggacccctccccttttaagttggtgccactccccctaaactttcaatgtgggactattcccaacaggcagcggctgccgaggaggaggcgccgtggggggagcggccccaaagtcgaacttgtgcagcgccgcattcgtccatgccgcgaagcgggccctcctctgcatccgcacgagcacgaccaccgcgtccgtgcgtcgctggaggccctcatgctcctccttcttcgtcgggggaggcggaggccacagcggcgtgatcgtagccgtcaccgtcgggggaggtatcatggtggccggcggcggaggaggcaccgtgggggcggcgtcgtcgaagtcgaacttgtgcagcgccgcactcgtccacgccgcgaagcgggccctcctcagcctcttcacgagcaccgcgtccgtgcgtcgctgcaggccctccccctcctcctccttcgtcgggcgaggccggggccacagcaaagtggccgaggtcgggggaggtgtcggtgtcggtgaggtcggcgtcgccgtcgccgtcgccgtcgccgtcctgctgctgctggtcgcaggcgacggaggaggaggatgaggcgtagtagcgctcagcggcggaggggaaggaggaggcgccgtgtcgaagctctccaccaccgatcgcgcccacgtcgtcatcctggtcttctccagctgcgcgagctcctcagtaatctcctccgcgcgcctcttcgcgccctcctcggtatcgtccgctggcatcagccaaggccacacgagcttgtcaatgatggatgacgcttgcttgtcgaaggccgaccacaacgatcggagcgccgctttggtcgccatggataggggatggggcggtgggagagctcgcactgcaagaggaggaggaagaggacgaggaagaggagggattgggagcaaggcggagatggagcggaaggaagaagaaggtggtgtgttatatagctggcacttgcaggcgcattcgaatgggagggaaggagctgacacgggttggattggagagaccttcgaagaagaacaaggcccaacgaggagcagccggccagggccttccttgctgctcatgctcgatcgatggaataagttcactttaggtcccttaatttatcggcaaatccgaaattcgtccatgaaccgcaatattagatataacgggttcctcaatttgtaaaattggatcacccgaggtcttaggtagtattatatccggttttagctgacgtaacaagctgagtcagtgtgagatccacgtgtcagggcaattcagtctaaataaaaaaaatagcatttggcgaaccctacacattagtgacccatcctctcctccctctctccgtttctctctactattttatcaccgacgtaggtgggacaatggttttgagggcaacagcggcacacggccgcacgaccacctagaaggggaggggtgtggctgggaagaagccggtgagaagatccgcggtgaggatgaggaagggaggggagagaagtgagaggtggaagaaagtgtttcaattaacatgtggggcccgtgtggatcccacgcagactcagcttgccatgtcaattaaaaccagacatagggcctgttcactttgatgccattttcaaccttaccaaattttggtaaaattatcaaaaaagtgactacatttagtttgctaccaaattttggtaactgtataagaaatcttgccaaaattttgacaatgccaaaatttggtaaggtttttttttttgcatcaaagtgaacatgcccataatactgtctagaacctcgagtgattcggttttgtgaattggaagactcgttatatttggtattttggtttagggataaatttcatactcgttgataaaggccctgttcgaatccactaaaaatagtggattaaattttggatcaaagtggcacgcttttcaaactgctaaatggtgcgtttcgtgtaaaaactttctataggaaagttgttctaaaatatcagattaatccatttttcaagtttataataattaaaacttaattattcaaacgttatttctacctcgtttaacgcttaatcttcatcttcagaagattcaaacaccatcaaagtaaggaacctaaagtgaacttatttctggatcgatcgatcaggacatggcccatgttgttttcttgtcctcaacgcaacgacgtcacaggcacagtctgggtctcaagacaaatatggtgttcgcctatgccggcgccggcgacaaggagggacacttcgcaacggcaaattttgagcctccccgagtccccgcgcgtgaagacgaagacgggatagaccgagagcgaaatccagtatcctgcaagaaatatgggcctaaacaatcaaagttgctaggaattgggccgaacgtacttgcggatcaagagctgggcaatgatagagaagtgattttgccctggcctactacgatcgataaaagctttaaataaagtctagtttgactctgtacgatcatcgttcgcctcaatcgtaaaaaaaattgggtataacgactctctcaacggttaaacccggtaaaaagactcacggaacagtactaaggttggtatttactcatgtggtacattaacctagtcttcatactatatggtgtttacacgaaagaacaatcactactactactaataataataataataataataataataataataataataataataataataataataataataataataataataataataataataataataataataaataggaccacttgtaaatgggataatagttttagacatttctgatggatgagagtttcacttgtatgaaccgagtttacgtgcatggattgtgaggtgtgattatcttatgagctctccattaattataaggcactgagatactgttctatttatgacagccttaaaggtcagattatgcagaaatacagctaaggccttacagttgacaccttttctgccaatatgtgataataaatcttcatgctaagcttcttttaaatttgactgaacttgcagagttgcaatgcatctcaacgttggggagttgagataccctgtatctttgataactgcactgtgcagattgtcctgttcattcatgctttttggatgccacgatggatatgttacagtccatgcttgacttggttcctgcttccctgaacagcgtagcctcacaaggcagagcagacttcatttacattttcgagttttatattattgaggttttacctggcattttgtctattctgaaggcaccatcgtcttaaaatgttgtaatataaaatgagatttaatccatactagaccaactaacctggatagaaattatgtacagatttgatgaactactgtacnacgagatnccacaagaaatcatcctc

SEQ ID NO: 3795 - DNA, 15550 bp, Oryza sativa
  unsure (1)..(15550): unsure at all n locations
caaggattgaatgactttatggtacagtagctcatcactggatagaaattatgtacagattcgacaacgaatctggataaaagtttatccagattcgttgtctaaatttcattctaggtaccaacattttgtagtggagaaaatatatttagctgtgggccgtacgaaggatgcaggaaatatttggcactacaggaaatatttggctctgtttcagagtagctgttgaacactgatttttttcatttttagatttattttttaatatttacaaaaatattatatcagcgaaaagctgacgtggcacacggtgcaggacggtcgttttggggggctacgacacgtggcccccttgccgccctctgtctgggcggcaaggagcctccgtgcaaaattcgcaagggcggcaaggagcccagatgcaaaaagaactagtcaattgtttttttagcatggaaaaaaattacatttagccccaagggtctaagctcaaaatgcgcacacggcacgtcacgacgccgtgtgccacgtcagcttgccgcctaaatggagggccgcagggtctatttttgtaaagatttctgccgaccagcctgcctagggagatgagtgagagagagagaggaagggagaggagggggaagagagagcctgatgacgtggcgtcctgacatgtgggacccacatgggtcccatgctgactcacccgccacgtcgaataaaaccgggtgaaaaccaccgaaggatgtaaaacgaacggttttgtaagttaagagatgtcatatatctggttttacggttgggggacgattttgtaattcgataacaagttgagggaccttcggtgtactttttcctatgccgtatcgctgtggctctggtcgtggcccacgattgacatcgaccagcccacgtaagcaggccaggcccataacaaagcctgtaagctcgctacaatgatggttcagctccaacaagtttctcatggacatatccgtacatcgtaccggcacataattacccgtttcaagtgcatgatttgaaatcttcggcacgaaatcgatgtccaaataaccatgcttaatttgagcagagggacaatagtacactaccaatccagggaacttgaaaaacaaaataacattgaaaagaaatactaatgcatatccccttgaattaatttcaggtccaacctgcacatcagtgcgctcgccatcgcgtgcgtgcatgtcttcacccgcacgtaccaacaaacaagtccataactaatctgattgatttggatcgccgagcacatgtgtgtaagctagccgacctgatcccggttgccgtcgccgccaaacgaaagcagagacgacgcacctaaaaagcctcacgaattcgtttgggcgtcgcggccacgggagatcatatcgcgaggcagcaggagccaaaaaaaaaaaaatccccagtatttttttagcagctggaggtcggggttggtgatgtgtgtagttcgttcgtacgtgtgcatggcatggcatggcttgagatgggtggggcaagttagttaaagctgtatcaaggaagcaacgttaaaagggaaggtgacggcttaattcttttttctgtacatgtgttggttaactatctttcccgagacggcgttggttagctcgcttgatcaatcggagtccgagagagggacggacccgtaaaagcaaagcaagcaagcgaagctttgtaatgatcccttgcatcaagaaccgcactagataggagtagcatattagcataccgttgttgtgtgtcgtgtgtctaacgtgcaagggatatattttgctagtagctcagctacctggattatttgtttgcagagtggaccctcgacgatttgtttgttatgaagcatcgagttaagaatatgttaggcatgctgcttgtttattttttttcaagttgagaattgaccatggaccttgtaataatgatatattgcattaacgtactgaaaatagttaggaataatggaaagcaccaacgatgctgaggtgaaatcttgggtacagaacttcacccactaggatatatccaaaatatagagtgaatcttactttgagtcatcttttattactggtgtttcatattagatcaccttttaaccaataatcgtaactttgtgacactttggaccactcttacatcctttatattatccatctattgatctacatctcatatgtcaagaaaataggttgggaattcattgacgggtaagagtaagtatagctgagattgttcatatataagaaagttagggtggtccaaaatacaacaaagataagattatccgatctaaaacaaaaatattggttaaagagtgattcagatagacataccgataataaaagtgactgaaagtaaaatttactcataaatataatacacaagccgatgggtgtgttttcaataggatattaacaagtactgttggccttcatctctatttgagcgtgtgttaagaggtgtattcgctggtgtgcgcgtacgcgtagcgggatgagaggggtgcaaaaacacccgcggtcacagcgcccaattcccaaatcccaaacaccgtcgtccgccacgcccacgcgcggcaagaaacagttcgccgcgcgcgatccatttctcgtacaacacagtacgtacttccatttcgcggagcgtgtgtactgcgtaccggccccaccgaatccaccgcacggaatggcggcctatatatgcgcaggtgcagagcacttgcattcttcagattgccagagagattcagaggcagagccgcgagccccaagacaccctcctcctcctctccctatccccttctcccccaaatcatccttctcaaaatcaaaggctccgggtggtgagcgctaatcgagaggtgtgctgcttgatccaatctacacttggggttaaccgcttggtgatttagttgcgcttgcgccactagttagttaatcagtggatagttgggggttgggcgtgctgttctgctccacttgggatgcgagtttgatcgattttgcttttttattttttaagcttgctgtttctcgtgctgcattggtgagaaactagtttttgttcgtggattcagcgttttcttcgcgatcaggcgtccggttccgttttttcttagcgtttttgtcccgttttttggtgtggaatcagtctggttctcgatttagaaactagttgattacttgttctcactgttacagtggatgagatcgcgtcttcgaatgcgatttttgattgcttccatgatacgattttcctgttctcagagctagattctgtggaaagcatctctactttttttttattttggttcgcttcgtgtggagaatttagtgtgatttttgttggaattttcattgacattttgatccgtttacttgcagggattagttgttcgcggagatcgccgctatgcaggaagctcttctacctccggctcatccaggccgcttctactcggactttggcccgaagccgttcggcagcggagatcaacggctctcctcgcccaacctgctgaccaacggtggagatctcttctacggctgctactcccccttcagccctacccgcgtgctctcgccgccgccgccgcggcgcgccgcctcgttctcccactgctcgtcctcctccgactccgtcgtcgacgacggagatggtgcgggggcagcggcagcgaccgagcaccgcctccacctcgcccacctcgcgctccagtaccaggagatggccaaccgcttcgagctctgcctctcccacctcgccgatgccgcggacgaggcggccgcgctccgtcaggagaacgccgagctccgcgtcgccaacaacgacctcgcatgccgcatcgccaagttcggcggaaggcagagctccgccatcgccctcgccggtgacctccgccgccttccgcttcccaaggagcagaccgtgccagctcttcctcctccgccgcagtctccgccggccgcactgatgaatcccgtcgccgtccccgagaagcaggctgttcttccgaagagcatctccatccgttcgaccggataccagaagctgaaccagggcggcaagcatcgcgtgtcgaagccggtgaacgtcggctcggtgagaccaaatcccccaattcctccattgtgttgtgtctggctcccactcttgcagcgcactgactcctgtgctgaatccaaaatcccaatcctaactagtacgatgttcttgatgcgacaatgcaagcagcagcgcgtgttcgtgggcattgacggcgcggagggaggcgagcacaaagttggtgtgaagaaggaggagccgcccatgggtgggctggagttcgaggtgtacaaccagggcatgttcaagacggagctgtgcaacaagtgggaggagaccggggcttgcccctacggcgaccagtgccagttcgcccacggcgtcgcggagctccgccccgtcatccgccaccctcgctacaagacccaggtctgccgcatggtgctcgccggcggcgtctgcccctacggccaccgctgccacttccgccactccatcacccccgccgaccgcttctccttcggccattgatcatacgtgtcagtccatcaccgatcgccactctctcactccctcctaatctcctctctctttgataatgacatgaaaagagggggaaaaaaagaagaggccgtaaataaggtatactatttagttgcacaaagcaaatgagaactgaattatacaattagcacacaggcgaaatgtgaatactagagagttatagctattaagttgtggtcagatatgtgagttattacattgggggttatttgtcctatggttcatattgttatataggttattatgatcttgtttccttgtttcgttttaagcaaaccgggtgacaaattgttggactcatgtaagtaaggctgttatttggatatctgaattatgtatggaacacttgtacgctatgaaagtgcctgaaggctgttatttgcaatttgattgatgtgttggaacacttgtatggtgagggttcactgttcaggcatcttcattcttcagttgtaatgttttatgagcagttgaagtaatgaattatactttttggtgaacttgaattgaagcattggtgccattttgtctatgctcattcatgtaatgaattatatacttttgatttgatgaacttgaattgaagcctgtcagtgtatgactgcattgcctggtgtgtgtgctgcctggtgatttgtctgtcgtctttaactaaggcagacaaggacttaagatcttgctgtctatgatggatagttaagtatgcactttgttgttatttgcatcctgcgtcttatgacatttgttcagatgtcttcactcttcagtgctacactactgaagatgatgtgaagcttcggtgcctgatgccattctgtttctactttctactttatgcctgtacctgtgtataaatgcattgcaatgggagtatttttcgttgctttctgcggacaaagcttgtgatactggcaatgcgtaaacttcggagatttggtgccttgtgaattttcgatgagtattgtgatgggtggaccctggacagttgttctgccgggcggcgaggcttaccgcgcgttgcttgctccaggagaagagcgtcaggccaagccggataactcgctccggcacggtcatggtcgcgccggtgaccgccttctggttctgggcaggcaggcgcgctgccaggcagggtttacctttttcgttttttaagtaaaaactgaaagtcggtaaaaactgacaactttcaatcaacgttgtacgaaaaccagttaataccgatcggctttacaaaccagttaaccctgctgtcaggtactacgactttttagataatgaaaatagattatatatctggctttatgtcataagacacacaagtacaagtttattgaaaaaaatgtaaagataaaaatatatcaaaatgagtaataaaaggggacaaaatcccaactcccctttatttcaggtactgcgacttggggttgtttttgtcagcagccagagctagttgatcgatctatacttctatatatgatgggcctcattggacatgccagccaggtgttggacgaaatagacaatgctgtggtcatgttcatcacaaggctgctgctatgctgcaagatggttggggaagcaaggtgtttgtttgacctgacgatgaagtacaagtatagccgaacaaagttcacatacagcacgccacggtaatgaactcttcccgaagtacaaaacgcagcacaaaaccgatatcctatttggcctgtgcaagatgtccagggttactttgtttgatagtgcaccttattggggatcaaccagctgcagattctgatgttgcctataggctataagccacagaaggccttgagtttatcctcgtggcgagctccttcttcagaaacgcagaagcgaatgaaatcgtcgttgtcatgcgtcttgaaacggggagggtggcactcgtcgacgagctcgttaggtacctggatcatgaaattgggggaggagaagagcatgcaggtgtacctcgtggcatgcccgctcaccattatccgatgaaatggcgcgtgcagacggtcgtttgtccatgcctgaagattgcgaaaattcgaaaattaagtgtgcgatttgcttctcttgaacaattaaggacaagcatcaattatcaggtgagtgttgaagtgtgtatatgaatactcgtacaaactatccctacatttcttgtctatcaaacatgaaatgcctgaaactcaaaaaggttgcagctagcagcagaagagtcacattctgtaatttgttaggaacgggccaattgacatctactacggtgttttacaatgtttttttttcagaatgtttgctctagtcattttgctgaatttcaggaattcaattagtccataattaatattgcttacacattcttcgccgggctaacaatgtgtaagcaacattaactacggactaagaatgttgcttacacattcgatatccacaacatcgtctcacttagctactatctgtgaccgccaatccaccaaatcctcgatccaaaatgatggggaaacaaactttttttttgtacagcattatcagtgtcacatggtagaatttacactgatgcttacccggagggcattgccgacgttgacgatgagcgacgtcggcgacggctcgacgaggacccactcgccgtccctggtctgcatctcgttcccattcacctcgttctggcacacgatgctgagccagttggtgtcctgatggggagaaaattgcatatgtaccattgcaaaagaatggattcgctagaataccatccttaaaacaggcttcggtaaaataccacgttcaacgaagatggcttcgcccgaatgccctactggactaatttgcccttgggcatcttcttccacccttcggcacctcttccatcttcctgtagctcaccggcggccatggcacccgcctattgcagcagcaggtacatatgctagtggagggagcaagttccgtgcccgcgtccgtccgccctcggtccaaaacctgcttggcaccggccgtgcgctgcgcgcgaggaggaggcgactccggctcggggcaaggtcggactcgggaagcggaggagacgaggccgtgcgcagtcgcgttgtgcatgcacgcccaccacgtgctctcgccagccgcgggcgcgatgacaacgaccaccgctgccatcaccgtcgaggcatgctaccagatctggtgctggcgggtgaggatgagcggcagctgatgaccacgacggaagggcagcgctgcaattgacgatggaggacaatgagacggcggcgagcggtagtagctggtgatgcggggacccagacttggagccactgtggaagacagcgaaaaattgccgtgatggacgacgaggcggcggagccgtcgatggcgtcgtggttgacctgtggctgtttgaggctgcttgttctgcttgtttgcttgctggttgagaaggacgaattggctctgcttgtcctcaatgaattggctgctgaccatcgtggtttaccgtcgtggctgcatctcctctccaatgctacagctagtgttggccatggcacatagtcgtcgccggtgagctcctccggctcatggaggaggaagaagtggagccaagggtaatatcatccaggatggcatttcggcgaagccgtcttcgttgaacgtggtattttactgaaactgttttaaggatagcattctagtgaagtcattcttttgcaatggtacatatgcaattccccccctgatgggcgatgtacccggtcaccttctcgtcggaattgggcgccctgtactcggacatccggaacaggtgccagaaggactcgccctgcgcctcgtggtgctccgccacgccgagcccttccaggatcatccgccgcaccatcccctccagatccgcgatgcgcttcgccgcgccattgacgatctcgctgtgtgtgtgtcgtcgcagagcaaatcgaccaaattaaatcaagatttgaggagaatgggatggggatatattggtttgattattaccagaagccgtcgtcgtcgttggcgccgcggggcaacacgaggtcggcgaaggcgcggacgctctcgggcttgaggccgtcaacgatggcgaggctctcgtaggagtcgaggcccgggaggccgccgaggtagccgtggaagggcttctcggggccgtggtagttgcggcgcttggcgtcgacggggagcgcgaagagcggccggacggcggcgtcgaacaggccggcgcggagctccggcgtgagctgcgggtagtgcgcgtcgaaccagccgtgggtggtgagcgcgcccatcacctcggcgcgcacctccgcccaccgcccggtccccggcgccgccgggtccacgccggagaagtcgatcctggccggtgtgagctgcgccgcctcgccgcccatcgtgttcactgtgacactgtcccagcaaggcagcttgagctcccagctttgatggggattgaccgatgagctcacttccttctttcttccacgttaatggtccccgataggcgatagcagccagtgttgactacttgacgtcgtagccttgtggggatttttttttcatttttaaatttttattttttaatatttacagaaatattgtaccggtaaaaatatttacagaagtagaccctgggagggcggcagggtgacttgagggacggacaagttgaaaaaaaatagaaaaatgcatttttggcagagcaaaaattgcatttacccccttcagccttgtagagtgcggcaagggacctaaatgcaaaatacgcacaccttgcctctctccacttgggcggcaggggctatttgtgtaaatattttagatggtataatatttatgtaaatattaaaaaattaaaatgaaaaatgaaaaaaattcgccttgtgggtaaattggacgggttggaattcagactcggctttgtttctcaattatcagggcccatgacagaagacaaatgggccgtagcaaatgtagccatgttcttctatgactagaccagacctccaaagctaaggatttgtgtcaaaatgctgccaaattcgttttttttatagaaaagtatttgttacctagcctttacatcaaagcggatatatgcagccatttaaattgagaatttagccccgcaaataactcaatctgaaattcgcatctgtgaaaatttaaacttataaccttagggtattattcagggcattgcaaccaaaatgctgcaaaatttatgtgccacccgtttaaaacgctgtgattttacactactccctccgtcccaaaatataagtatttttagcatagtgacaagtcaaacattttcaactttgactattaatagcaaaaaaaaaaaagatcaatcgtataaaattgatgttattagacttatcattaaacagattatcataatatgtaactctctttatttaaaacatcttacttttatatgtattattggtcaaagtaatatctcggagaccgtgtcagagtccacatatgcttatattttgggagggaggaagtaagattttagcagtaattccgtgagcaatagttggaggaacgacaaattagaggctgaccgtatggtgaaagcagattgcctcgcctgacaggacaaaagaatcaatctatgttgctctaggtagacctgacgtttcgattagcatcttcagctaatctattgaaaaacggatggaggcaaaccagcctaacgaactgcaccgatcaaataaacaaaggcctgacgaactgcgtgacgcatgatagaataattgtctagcctcagttgagtcaagtcttgattaaagcttctagatgaacaagcgagcggccatattttacttgtaacattagaacatgaggaatcccacgtgcatgcgttgacggtgaagaaactttagattaaaaaaaaaagatcatgagccaacaggtaagcatttgctccaaaattttccaatagcatgttttggtcacagagaattttcgtctgtaatttccacgtctcatttttttcaaaacacatgattttttgatgtgttgaagtttgaccgcagaggctgcagcgacgaaaccagtgatactggtagggtttacaatgacagtgacattatctctcttttttttccactatggtgatcaaccctctgagatggccgaggattgggtttaagtaacaagcacacaagatgcaagaagaacaagaacaaggtgcgcggaggcacgaactttgcttgatcgatttcttggttacgaaattaaacatactcgcggcggcatggtgatttgcaccaggtagaaattgaagtgtacatcatcatcttgtcctaactaatacttcttacaaattacaaggaagaaacagcagtagtaataatcatcaacatgagcagcgatcgagcaaacgaacttgcaggagctctcgcggttcagtttccatgtcgatggtggatacagacagcacgctaattgactagcagctggccactggacgccggcgccgccgtgttgtgctgctgcggcaggtgcgcggtggagtggtggagcatggtggtgagctccttggaggcgacgatggacttgtatatctcgacgacgagcctctgctcgaagtcggtgagctggcctggccgcgccgccgggagctgcttccggcgcggcacgcgcctgggccacagcccctcgggcgcgttcggcagcgacatgcccgacgccttcctcgacacggcgagcatgccgcccacgtacgcgtcgcggatccgcgccagcagccgcgccggggacgacagccacgccctcgccacgcgcacgcggacgcggagcagccgccgcagacgcagcccccaccccgcaccgtcgaggcgcgcgccggccagctgctgcgtcgccctcgtcttcccgccgccgttcgccgcctccagccgctggtacttgcgcctcccccagtgcgaccgtattcccctcgtgaaccgtatcgggaacgcctccacctccatcgacgacgacgacgaggtcgacgacctcgcggccgcgatgctttgcgttgggttggtgagtggcaggaggagcaggagaaagctgaggcgtcgcgcgtttggtttgggtttttgggtttggttggtgaaacggcgaggcgggcttggtttttatgcagcggagaggagtgggggcgtggttggtggggagtaggagcgcgcagtaacgagacgagcgcgacgaggtggggattcgttcgctcgtgtcgcgtcgcgtcgtggagaagggcacgtaagcgagttcgcgctgtggcgtggtggtcgttgtctcgcccacggcgccgtctactgcatcgctgcatggcccaagttaacgggaaagggatgtggtgtacgttgaacgtctagaagactagaacgcagtagcttgaattagtggtagtttgaacgatggaaagattctcttgcttgtttaatttcactttgtttgtgactaatggtcagctgaaactacttggaaaagtcttgtgttatcacatttgatattacctggatggttcgcgcgtgcattatcagaactggatgacatctagaattggtggtcaaagtattagtgacgttccgaattactaatgcattatgcacgtggtcagacaaataccaggagtcatcatcgccgaataatctgttcactgaaaagttgagagttgagtattcaggtttagggatcaggtcagcagcttgtgtttcaaatgctcaaattaaaactgacgacgcatgcatcactcaccttaaaaaattgtgcacgatttgccatagactcgagtacactgtacacgtttcacgtttgttaatctcagctagcaggtgcaaacatggtgacggaggaatggacttgaatggcgctgacgtgggtctaactggctgcgttggccgacgagagtacagaaaattaaaaggcttccgggtcatggcaatcagacgcaggttttgacgttttggggctccggtgtttggacggaaccacggccatcgcacggcgtccgtgatggaattttcgtcaggttatatcacctttttgtggcgtggcggtgcctcctgtttaaagaagcaaaatgcactaattaatacgcgtgcaagggttacatgcgttttgcattgtacgtgcgatcgcggttggacttgtggttcgttattgtaaacttgtcaggtacatatttgtactcgaacccccaggccaatcgggcagcgtaaaacgccgccaattcgccactgattctgtcgtacctaattcgaaggactggtttaattagttattaactttttcttcaaactttcaactttttcatcacatcaaaacttcctacacacacaaacttctaacttttccgtcacatcgttccaattttaatcaaacttttaattttaacgtgaactaaacacatttatactggtgctcgtgttcacaggagaatcacgtacactaataagttcacttttagctctaaccgtttaaccggttatcccaaaataaatttatctaagtaattattgtattgagatttataaaaatgaaaaataaatatattaaaaataaataaagaggaaactaattacattatttaagaaactaagagtattatgatctatttcttgtgagatgctggataaataatgaacttattttagagtggaggacatgtgtactactccctccgtcccaaaataagtgaagttttgcactattcatctccaacatttgaccgtttgtcttatttaaaaaaattatgattactatttttattgttattagatgataaaacatgaatagtactttatgtgtgactattttttaaaaaaaattcataaatttttcaaataagacggacgatcaaacgttggacacggatttctacggttgcacttatttttgggacggagatagtataatcttcacgcaagccgatagatgggccgtattccaagggatgtaagtggaccaacccgcgaacccacatataagtaaaattagttggtatcctacgggttattagtaatcacccgacaaatggatagatgctcctataaataagtttacgggttgacccacttgtatccctaaatgtggcaagccaaatcacgacatgaggactacgggttacccacttaggttgtgttcttatcacaattttcccaactcatctccctcgttttccacgcgcacgcctttcaaactactaaatgctgcgtttttttaaagtttctgtacgaaagttatttaaaaaaaatcatattaaatcatattgattaatttatttaaaaaacagctaatacttaattaatcacgtgctaatggactgttccgttttcgaggacccttatttaacacccaagtggattcgtgcatacctacatattccacattaatttagagcccgcttacagacccatagctggacattgttgagcgttttatgacccatagctggctaccacgggagtcttaaaaggatgcagcgtggtggactgaggaattagttttgctggtttctcaaggaaaaagtctagtaagactcccttgatctgatttttatctatcaatcagcgaaagtcaatagtgtagctagcagatatctccaaaattttgtcaactgaggtagagctaacttaagagccaactcatacaacaagctagctataagttggctataagctgccttggttaaagcacagaagcattaaatacgtgtaggaatataccagctgtagtgagttgcatgcgagcgttaaaagccttcgtgggctgcatgcgagcgatacggcgtcggatgaagcgctagcgcccggcgccaagttaagcgcctgctcgtttctctctcttcaattttgctagcttaatctaggattgggaaggtgagagaaaatttggagccagcttaatcacgttattgtacctgctctaatgggtgatcgatcgcccgacccatcgggtagcgatcagatcttctcccccctccccctctctctccctccaactggtttccttttttggcaccgcattacttttctatcttagcaaatttatgcacctaaagtttataaggtgtgtttggataatgggaaatggagggtgggattggaattgggaaatgaatgaagggttaggattaaatgaaagatggagaatgaatggttaggatttaaagatgtatttttgtgggtgggaaatcatttctatttcccattagccaaacattgccatacacctcaagtttacacatctaaagtttagagacccaaagtttattagtcaaaagtttatatatccgattcaaaaatttttttatatatagtatttctatacatctaaagtttatacacctaaagtatatagacccaaagtttataagtcaaaagtttacatacccgtttcaaatttgaatttgaattatatttgattcaaatttgaatttgaattcaaatattttctatatataatatttttatgcatctaaagtttatacacctaaagtttatagatctaaagtttataaggcaaaagtttacatacctgattcaaatttgaatttgaattttataagccaaaagttaaaataactgattcaaatttgaatttgaattcaaatttttttatatagtatttctatacataaatttttctaaccttttatttttaaaaaaaaattgtgtggtgcactgtagtaggaagagaagaagggaatcctaatgggcgatcgatcgccctgccaatggggtgatgaagtgcgncataaangtcatcaccctctggggnnnncggnnnngcacnnnnnataaaaggatanntttacatatctgaggaaaaataagagataagagggcaatattaaaaataatcatatctcgcatat

SEQ ID NO: 3796 - DNA, 6436 bp, Oryza sativa
  unsure (1)..(6436): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcccccttccctccctccacctggttcccttttttggcaccttataactttcctattttagtaatttatacgcctaaagtttatatacctcaagtttacacatctaaagtttagagaccaaaagtttataagtcaaaagtttatatatccgattcaaatttgaatttgaattcaaatattttttatatataatatttctatacatctaaagtttatagacctaatgtttatagacctaaagtttatatatctgattcaaatttgaatttgaattatatcttattcaaatttgaatttgaattcaaatatccgattcaaatttgaattcaaatatttttcatatatagtatttctatatatctaaagtttatacacctaaagtttatagacataaagtttatagacctaaagtttatatacccgattcaaatttgaatttgaattcaaatattttctatatatagtatttctatacatctaaagtttatacacctaaagtttatagacccaaagtttataagtcaaaagtttacatactcgattcaaatttgaatttgaattcaaattttttatacatagtatttctatacataaatttttctaactttttgttttttttattttttttgtggtttactatagtatgaagagaagggaggagaggagtagtatagaggagggagcgggcgagtgatcgctggccggacgggggagcgatcacccgcccattagcattcccgagagaagaaggggaggagaaagggggagaagagggagaaggtattgcctatagggggaggggggcggatctaatcgctgggcgatcgccctggcgatcgattgcccattagccccccccctcaatcagtcaagcctgatatattgattctccaactgttaaaacgaaagtcctaacgagcgattgatcgctggcagtgatcgttttttttttcatttttttcttttcctcttttattaagtttatacacctaaaatttacatatctaaagtttatccatctaaagtttgtagagcgaatgtttataagtcaaaagtttatatactcaattcaaatttgaatttgaattcaaatattttttatatatagtatttctatacatctaaagtttatacacctaaagtttatagactcaaagtttataagtcaaaaatttatgtacccgattcaaatttgaattcaaatattttttgtatatagtatttctatacatctaaagtttacacacttaaagtttatagacccaaagtttataagtcaaaagtttacatacccgtttcaaatttgaatttaaattcaaattttttttatatatataatatttttatacatagatttttccaactttattttttaatttttttaaaaatttatggtgtagcaagaaaaagaaggggagggaggaagcggggagaggagtgtacagggatggggatcgatcgttcagatcgatcgcccattagccgttcccctgttaaaatcgttcaaaactacctcattgtttagatggcggttttgatttacggagtacttggtatcctcgcggcagcctagtcatcacaaaagttttacaagaataggccccacgtgtcatcccctcctctcctatctctaccctgtctccctgtttcttcttcggtcttcacggcggttcgtgatgcgatggttcggtgttgttgccggcatggcggatgccctctgctcgactggaactggtgggcgcactgatctctgaatgcatcttcgactgttgcacggaactggttgcgccgttgcacgctgatctcagctcatttggtgaggcagaatttggtttgtggcgccgctcgccttcagtcccaactgaaaaaacatatcaaaaccgcttccaattcagattgtttggttaacttcttgcttgtttaatgctgtgccgtttgcttcttcacatcttttgctttgcgaaaacgataaaattttggacttttctagctaggtcacatctcacacgcaaagagtcgtcattgagcgtaacctcgagctgggaggaattgcgatcgaccattgcgagatcgaatcaggccaaatgacgaagatcaattcagcccggtgcgacgtcttatgatccaaactaaatacaacccgagtgacgtacgatccagagaagaagaagatcaaaataccaaattaaagtagcctacagaagaagtgaggaaatcgacaacacaaacacaccgaagaagaacgatcacatctaagctgcatgccacacaccgacacacatgtggcgcgcgcgggcggcttacgcgccgggcgcggcatccttggcccggctatgcaggtagccgccgtactcgcgcgcgtagtccttgacgtggctagccgtgtcggcgatccggctgcgcgcgtagtccacccggtcggcgccgacggggtgcctccccgtgaagtagcggtacatccacgtgccggcggcgacggcgacgacgacgaatgcgcaggcggagagcgcggccgcggcgagcacgaagagcgcgacggcgacgggcacccagatggggctggtgagcagcgcgatcggccccaggaagatgagcgccacgacggcgccggtgagcgtgagcccggtcaggagcaggaggacggcgccggagacggccagcgtgaggaagccgaccacctgggtggagttcggcgcgtgcgtctgcacccgccggagcagcgtcgtcgacggcgagtccgccgacgccgcgggcgcgtacccgaggcgctgcgccgccgtccggccctcgccgtgcgcgtgctgctgctgccgatctgccattctcgacgtcgatcgacctagctaggaggagaggatggcagcgctcgcgcgtgatggggaagtgggcggagagcgaaggagttaaggtgcggagagggaggtgcgcgcgccggcacgtgtcgcggcgacaaccatgcatgcgcgacatgtgtggggcgatgaccgaaacccaacaaacgaaacgaacagtggtggtactggtaatagcgtgcttttcaccatgctcttcggatcgatcggatccctttttttctacctagacaagcgcacacaagctgtctgctctttgtttatgtcatcaagagggcacgtgtacgtgccaagtatgggatcaccgagatgagatcgagcagagcaggttatacaatagtatactataaatcacttatatacatacatatataaaacataaaacgtaatgtgtatataacatgagaaattatatatcaatagtgtggtgtatatttgcatataactattatatgtattggctattaaattaattatagatgattttaagctaggagtggctctactaaacttgatcttagccaagccggcacaagtcaccagcgacaacgagtgagatcgagctagttccgggcaggaatccgacggcgcgtggagtaggcgcctaggcggtgtccaaagcggcaacccgcaacgattcatcagcgaaaccgtgcgggatgagttgtgctgggccttttagtttcaactagaagacggctgggctgcctttctccgccaacatgcggcccaagagatggtgacagctgaaacttgtgcggtcggtgtcaccaagttgcgaagggagccggcagggtgccatgttccctagggatttctctatgtatgaaaacaacgtcactactctgtcattagcaaactgctaatatattatcccatctggcacaactacaatgattgcaacagccaacagggacttgtcatgaacatcaggtagtagagaaaaaccggacttgccatgattaatgataaataagctatcagactgcaacaatcaggtactaatgtcatgactaatgatagtatgtcatcttttcatcccaaaatataatatgtcgttgagttttcgcataacgtttaaccatttattttatttctttaaaaaatataaatatctattatattattaaagaaatagaaaaaggagcctccacgttcgctctcatggcctagaaattctcacattaatcggagaaaaagaaaaggtagagtcatatagaaatacaatttagaaatagttgaaattcgaaattaaaaaataaggaatattagaagaggagactagagtccatatagaaatacaattaggaaataagtgaaattcggaattaaaaaataagggatactaaaagaggagactagagtccatatagaaatataattaggaaataactgaaattcggaattaaaaataaggaatattagaagtagaggatagagtccatatagaaatacaattaggaaataactaaaattcggaattaaaaaataagtaatattagaagaggagactagagtccatatagaaatacaattatgacataactggaattcggaattaaaaataaggaatattagaagtagaggatacagtccatatagaaatacaattaggaaataactgaaattcggaaataaaaataaggaatagagaaatacaattaggaaataatagaaattcggaaataaaaataaggaatattagaagtagagtatagagtccatatagaaatacaattaagaaaaaaatagaaattcggaattaaaaataaggaatattagaagtagagtatagagttcatataggaatttaaaactaactaaaatttggaataaacataataaaattaaaagtagagtttagagtccatataaaaatacaatttataaataacaaaaattcaaaattaagaaaaacatgggaagaagagtttaaggtcaatataggattacaaatataggaatacaatttagaagtaactgaaatttgaaattaaaaattaaagaatattgaaagatgagtttaaagtccacatagaaatacaattagaagtaataaaaattcagaaataaaaataaataatattggaagaaaagcatagagtctatatagaaatacaatttacagaaaattcgaaattaacaaaaatattaaaagacgagtctagagtccatataggaatatatataattgacaaataactaaaatttgatattaaaaataattaataactaacacgtatataaaatataatatgaaaattcagaaataaaaataaataatattagaagaagagcatataggctatatagaaatacaatttacaggaaattcggaattaaaaaaaaagaaatattaaaagacgagtctagagtccatataggaatatatataatttacaaataactaaaatttgatattaaaaataattaataactaacatgtatataaaatataatatgaatattacacattagtagttttgtaaagttattgcaaaatttaaaattatgttgttattttaatatatttgaataatataatgagaaaacatatatgctattatatgagaaaatataaagatgctagccgcgaaatttgcacgggccaccatgctagttatttattattgtttcctcaaaaaaattatttattttgttgtgacttgttttatcataaaaaagtataattttaattcatttacatatttatactaaattaaaataaattataaaaaaacaataacatcatattaagacttaaggagtattattcttgctgtttaaagaataatcgctatacgcatcatcatgcaacgctactacactactccatgcaggagggtttgaaaacagacggaaagggaaaaaaaaaagaagaaaaacaacggtttcccatgctaccgggcacaggttagttggcgtgccatacacacacagcaagaaacggcggcgacgtgctcgccagttaattcccgtgctcttgccacccccgcaccaccaccaccacccccattacaaaccgcaccggcgccgcgaagccaaaccgccagagcattttccccccgcgcgcgccgtgccacgccacgccacgccacgccgggccacggtggtctagtagtacgatcttcttctccccgcgcgcctcgctcgctgacgctgctgccctgccccgtggaggccgcgagacacgctcccgcggcgagcgggcgtccccaggctgcacaggcatnnnaatccntcttnccccggttcccaaccttgttcccccagaaatcctgggcctttaacagctttggtgaaatcccccgtttaaggagaatgggttggccccgatggcccaatgggctttatgccctttgccgtgtttttcccccccttgggggcctttaccatttgctgg

SEQ ID NO: 3797 - DNA, 2067 bp, Oryza sativa
  unsure (1)..(2067): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccccccccaaccgcgcgcgcggcgcgcgcggggtcccagatgctcgaccaccaccgcacgaggcccggtttatggccgcccgcgcccgctccatcatacgctggctcggtcaccaccgctcccgccgcgtctcctcctcttccttccatctgaccaccaccggtgacgacaccgtcaaggatctccacgacccgcggcgagagaacgcgaaggccgacgggtggaagnaggtccacgagggccccgagtccgaccccgaggagtacattgcgttggtgtcgaagaacgcgggcacgcacctgccggtgcgcacggagccgcgacgcatggatccgagcaagaaggtggggatggccttctcttctcttctcccctgaatgcttttcttggattcttgtggtttcttggattcctctgaactgttatttactagtagtaactgtttactgcatgaatgaatggtaaatgctctacatggagttgcgatctctgtttcatgagattgcgttgttgccggttagtgtggatctggttccatctctcatttgaacgatacgtttgcaatccatggcatgttcattcacatgcttacataagccaacgcgcggaatcattgctgatgtgatgctgatatagtacttacatgagtgctgtcaattcaggaatccaagataaccgagtatgtcaattcaggataactaagtatgaatccaagataaccaagtatgccaattcaggaaccctttattccagataaaggtagagctttacggaaactaaaggcataattctgcgggcagtagttcatattggaaaatggggcctactgcttttcttgcttctgtctcgtttgggaaaaaccaaaattcagtaacagctgcttttattttgacttttcacaatgtacagatttattttcgttctttcagaaaaaaaaagggggggggggggggggggaagggcgtacagataaggtttgtcactgtacttggaagaatcagattgcaaaatttattgatgctcggtcactatctaatttacatatctaatgcaatctaaatctgcatgtctttagtacattttacagtagtcctaatgcccttgaagttccttttcttatctgttgcacatcacattgtttgtacccgggtgttttcaaggcacaaggtttcgttcccaagaaatatgtcatcaacccgttcataccacctagcattcagtactgttactatagtgaactttaccttcttccattccaggaacctgacttcttcactgaatatggtgaagcaaaccggtataaagtcagtgaagtcattggcaaagggagttatggtgttgtggctgccgctgtcgacacccagaccggcgagcgagtggcgatcaagaagatcaatgatgttttcgatcatgtctctgatgccacccgcatccttagggagattaagttgctccggttgctgcgtcacccagacatagttgagatcaagcacataatgcttcctccttcaaggagggaattcagggacatttatgtaatctttgagctaatggagtcagatctccatcaggtaataaaagcaaatgatgatctcacaccagagcatcaccagtttttcttgtatcagctgctccggggaatgaagtacattcatgcaggtagtagattccatatagtaggaaatcggtaattcttttgcttatgtggttgacacgctcactttctggtttctctttgcagcaagtgttttccatcgggatcttaagcccaagaatattctatccaatgctgattgcaagcttaaggtttgcgatttccgccttgtcccggtgtcttttaataccacccccccaacaccatttttgtgggcgggtaggcattaattaatggaga

SEQ ID NO: 3798 - DNA, 6585 bp, Oryza sativa
gagcatctaatgaattttccatgcttcgttctaggattatgtggcaactagatggtatcgtgccccagagttgtgtggctcctttttttcaaaggtaaagggaatttccatttaacatggtgatggctatattattttttcttccaacattgttatattactatgatatgtttggatcaatgtagcaccagtgttttgagaatgttctcttagacattgtcgcattaggtgatatcttgatttatattttgtcattggcttttgcagtacacccctgcaattgatatttggagtgtaggatgtatatttgcagagctgcttacaggaaagccactctttccagggaaaaatgttgtgcatcaattggatctcatgactgatctacttggcactccttcagcagaatcccttgctaaggtatattcaatccttgcaagcttgtgccttcactcaagtgcaatgtattgactcctcactagtctgtgtgttcacttctttatgcagaattcttcgcaactatatttaatatttaagcttggcatcagcctctgtttcatatttctgtacaaatttcctccaaaatcactaacagtgaatcatatagttcatatagttattaatgtactgttttgagtggtatattttcctgagcgacttcatattgcattcatagtgcacaaggacagactctattttcttccatgtatttgttgtaaaaaaacgaggtgtaaattgtagaaataatgcatattgatgtgctttacattcatttattgaatgggttgcagatacggaatgagaaagctcgacgatacctgagcaacatgaggaaaaagcctcgggttccttttactaaaaaatttccaggtgtggatcctatggctctccatttgcttgaacgccttcttgcttttgatcccaaagatcgtccaagtgcagaagaggtaggagtgttcacagccaacttatgttgattgtaaagacattccagctttgaaatgttggatacattgctatcctgaatactgagatatggaattattattcaaggccctgacagacccctactttaatgggctagcaaactctgaacgcgaaccaatagcacagcctatctcaaagcttgagtttgagttcgagaagaggaaattggccaaagatgatgtccgggaattaatttaccgagaggtgccactgatgaattcttttgtgaatattacgacagagctgccacttgactctttactgtactaatatacttgttaaatctctttagattttagagtatcatccccatatgctgcaagaatatttgcgcgggggagaccagatgagtttcatgtatcctaggtaactccagtatttcttttacgaagttgatcacctgttggcatattttatggtaactaattcactgttctgtattgttgcatcccacaaacataaatcaatatgctgtattaaattagtgacttatgctaaataatcacacaaaaaaaattgctacacgttaggtcaaggacatattcaagtggtaattctgatgtctgtttatatatgatggatcttgacagtggggtggatcgccacaagcgtcaattcgctcatttggaggaaggagttttaaagggtgaaaaatccagtccacagcttcggcagaatgctttcttaccaaggtaatatacaatcacccctgaaatatgtctttgtatatgtagtgagccagatagcaactggagacggggactgctaatgcgcgggtgatcgctgggaccaatcacccgcacccccctcccctatacgtccctcttctcccccttcctcctcccttttttctcttccctactacagtacaccacaaaattgtttttaaaaaacaaaagttagaaaaatttatgtaaagaaatattatatataaaaaaatttgaattcaaattcaaatttgaatcaggtatgtaaacttttgacttataaactttggatctaaagtaggtgtataaactttagatgtatagaaatactatatatagaaaatatttgaattcaaatccaaatttaaatcagatataattcaattcaaatttgaaacgggtatataaacttttgacttataaactttaggtctataaactttagatctataaactttaggtctataaactttagatgtatagaaatactatatataaaaaatatttgaattcaaattcaaatttgaatcggatatataaacttttgacttataaacttttggtctctaaactttagatgtataaacttgaggtgtataaactttatgtgcataaatttactaaaataggaaagtaatgcggtgccaaaaaaggaaaccaggtggagggaggggggaactgatcgctaccagttggccctggcgattgatcgcgaatcagcctttccgactggagacttctgagctgaattgtttgtcttttaccaacatcttcttaaggaagttttttattccaacaaggcaggggcattgattgtttaggcatgtagcatatgactagatggcatggtattgagttcaatgttttctgtgcatctcaggagttcttttttcaggaatacatataggatttgtgtatctttttattaagccaggatagttaatatgttacatttacatgccttgaaaaggaaaaatgatgggaagaaggcaaacaagaactagaaaatgttaattccaagagtacaaaagagtgatgcgcatctcaggagtaatcagaagacctataagttgaaaatcactcttctgtgcccttggaattaacatttttctgcgtctttttccagggaaagagcaattggtaacaagcatggagatgacgagtaccacgcaaagctgaatgtaggcgagaagccatgccatgcatcagtgacagacggcattagcaaaccgctcatgagtgctcggagcttgttgaagagtgaaagcataagcgcttccaagtgtattggtgaaaacccaaagcaagacagagatgtaagtgtagtatctcattcctgcaccacacatgtcaggacggttcctgtttgtcgaggaaggaaacaatatatgttctagtctatctaattttttatttacgtaagatttaaaataaaattttgacataagatagtctatttctcagcaggaggattcccttacagagagcatggacgaaacagctgatgaggtctcagaaaaggttgctcaactgaaaacctgatgattcccgtcaaggtcacagaatcgatcggagttagtacaacagcatgtgtatagatgcccttccccagaagacgagaatcccagatcaggacggtcttaaccatgataaagagtctacaactaataataccacaagttgttttggtaacctctgttgtactgtaaatttttcccccttcagttttgtgttttgacagcaaacaactgtctaactgactgtagttcctcgtcttttcctcgatgggacaatcaccgatcctgtaaaatttcctttcttttgatgacagaatcatacactgtttctatgatatattctaaaattttgcagtcaatacaaagagataatacatcccagtttttacatgtatggccgtgtttagattcaaaattttttcttcaaactttcaacttttccgtcacatcaaatgtttggacacatgcatagagcagtaaatgtggaaggaaaaaaaaatcaattgcacagtttgcatgtaaatcgcgagacgaaccttttgagcctaattacgccatgatttgacaatgtgatggtacggtaaatatttgctaatgacggattaattaggcttaataaattcgtcttgcagtttacatgcggaacctgtaatttgttttgttattagtctacgtttaatacttcaaatgtgtgtctgtatacttcaaaaaaaaattagcacacgaactaaacaccgggaatgctacctagcgattgagtgctaggggcgatccgattcaattccctccctccacctagtttccttttttggcaccgcattactttcctattttagtaaatttatgcacttaaagtttgtacacctcaagtttacacatctaaagtttagagacccaaagtttataaatcaaaagtttatatatccgatttaaatttaaatttgaattcaaatatttttgatatatatagtatttctatacgtttaaaatttatacatctaaaatttatagacccaaagtttataaatcaaaagtttatatacccaattcaaatttgaatttgaaatatatacgattcaaatttgaatttgaattcaaatattttttatatatagtatttagatacatctaaagtttatacacctaaagtttatagacccagagtttataagtcaaaagtttacatacccgattcaaatttgaatttgaattatatccgattcaaatttaaatttgaattcaaatattttttatatatagtatttctatacatctaaagtttatacacctaaagtttgtagacccaaagtttataagtcaaaagtttacctacccgattcaaatttgaatttgaattcaaatattagtttattgacccaaagtttataagtcaaaagttcacatacccgtttcaattctgaatttaaatttaaatatttatggtgtagtaggaagagaaaaaggggaggaggaaggggggagaggagggagcgatcacccacccattaggtgtacccactaaacacagcctatcctatgttatgtttgctaagttgtcccaccgcattggagatttggagtttgagacgacggcaaatcgccaaccacaaaagtctcgttggtgagtgactcgtgggtcggcggcggaggagatgtcacgggatgcgtgtcgtcgcaaggattggctcagtggcaggtagtggtggaaacgagccgagccaagcctagctcggctcggcttgtagtggctcgcaacaaacttggcttggcttggctcggcttggttaggaaaacaagctaaaacttgagctcggctcggctcgtttcttggctcaagccagctcgagctggcttgcaagccttcctgttgaaatacctcttcatatatattttgtaattattaaaaaaaacaagaacaaattattaacatgtaaaattaaattaactttatatattcaagccttcaaaatcttaatggtaaatttgaagttgacaaataataacgccatataaaataaaataatcgatataaacacataatggcttaggctcgcgagccaaaacaagcggctcgcgagctagctcggcttggctcatttcagcaatgagctgaaaaggaggcttgggcttggctcgtttggcttacgagccgagccaagccaaccaagctcgagccaagcccgagctgagctcacgagcctgagctttttttccacccctagcggcaggtcgctaatcgcgatctatcacagcgtgaaagtgtgacataggtttggtgcggcccattaacctttgggttttccacgcgtggcccgggaaagccgtttaagagcttgttcgttttatcctctatttctaggcacaattagggcatgtttgtttcataaccattccgcctttccaatttgttggaaatggcaataattgaccattgaatttttttaaccaaaaattggctagatattcacttgccattttttacaaaagttggctagacatttacttgctttgctaccaaaaagttggctagatattcacttgctttgcatggccaaattctttgctacaaatcacacatgactatattttttttgcatttctaaaattttggcttggctaggtttgggtactaaccaaacaaattacatattaataagtcagtaattactaccattctactaaaaaataacccacacttttatttcactgaagaataatggcattcacataaacatacttgcatgtggttcacctttaggcattgattgttcaacttaaaattgtcattataaaacaagtaaataatattaatccaaaccaaccaaacgatatctatcacctcccagatttaggagaatttattgaagaaagaaaatattgaaccatttcactaacgggtcattccccccggaaataaagtgcatccatgtataactctcagcaccctcccataaagccaaccacttcagccaccttctccttcaccttagctcttcttccgacccatccctttccaccaggactttgttttccttgcaatcgattggtggagcctatgggaatcttgaagtgttgtttctatctatgatatgtaaaattttgcagtcaatacgagaggaggcggagatgtcatgggacgcacgtgtctggtgacagtatgcatgcaccgtcgcagggatttgctcgataagtggtgactagctagtcgaatccgtcacaatctatcaaaggaagtggatgtgaatactaacacatggaatagggtggtgcggcctattgaccttaagtttttgtgcactgtccttgattaaggtcacgccctgcttgcgggtgggatacttgtgcgagccaacttcaaacgagccatgatggagaag

SEQ ID NO: 3799 - DNA, 12489 bp, Oryza sativa
  unsure (1)..(12489): unsure at all n locations
gggaagatcaagcataaaaataaaatgaccaatggaataaatgggtaatcctccagagacattaagtgggagaagaaataaatcaaagccgaatagaaaattaaaatcctttgataaaggaaatgagaaacaaagaaaatttaggaataaaacggcacaaacaaataatagggcaactaatttcttttaaacaaaaaaaatgaaaatcttagaggtttgaaaaaaaatataataattaaaaaaatttcaaacaaccaaaatggggtggaaaattattttttaatattaatatattcacaataaaacctctcctaaaaataaattggtaaatagtgggtagaaaagtatgataaaccgaaacaaatattcaaagaaagattcaagcacatgaatacgatggacaagaaaactagtgataaagtccaacagagcttgatctaatggtttaaaaatccattcatcaaaaatagatctaattcctaatcgactatattacagatattaataaagtaataactaagaaggatgtggtaagttcaaatattgaaaaaagaaaaatgctaccgnaaaaanaggttgaaagannaaataanatnnannnagnccccccccccccctctctctcaatgggattttacactgagtaggtaaaacgagttactcgttgattggtatcatgtctaggcgtttttcccccatttcatttgaaggcaagtaggcaacttctagacacaccacgcccatagaaaaaaatttctaggcgcgtcttgaaactttattttagttttatgaataggttgagcaaaattaatgcatccaaaaaagaagcatagccaatatagctacccataaaaaaggatagaattgaaaagatatgcatagccattatagctacccctaaaaaaggataggaacgaaaatatagatatgctcagatgcatcaaattaatcactacatcatctcattgaaggatctttttaagcaaattaagtttatgatatatagatccatgtgtgtataagttaaataatctctattgatttcttaaaagccatcttacttttattccatgagaacaaatgaaatttctctctagattaatatatatatactctgtccgtaaaaaaaatgcaactctatcattcaaattttgggggaaaaattcaaattatatagtactacttttcctctaactactcttatcaaatttctctccacctttaccccaatggcccaatcacccattattttacgagggacatccaagtcatttttcctacactactattttactcccctccggttccataatttgatgttttaaccaaggttgaggttaaattttataactttgactaacaataactttatatatatatatatatatatatatgtcttacaaataactataataaaagtgaaaatgtatttatttattatatatattataataaaaatatagtcaaagatatattttagataccgtattattgtctaaaacgttaagaattatagaactagagggaatgtaaaaaaaaatgctgcaattgcattgtttttctactccttttgggacaaaaggagaagatgcaaatcatttttggtcacacttcttcttcttttttttcggcaatggcaagaattggccattgccaattttttgtaccaaaaagttggctagacatttgcttaccttttttttttaccaaagttggctagacattttcatttgctttgctaccaaaagttggctgacattcacttgctttgcaataccattttttttctacaaatcaaacacatgactattttttttgtcattgccaaaaattggcaattaaatatttataaaattcaaaacaatattaataagtcaatgattacagctccacttaaaaattttcacacttttatttcaccagagaataattgcattcacatagacatacttgtatgttgttcacctttaggcactgattgttttacttaaaaacttcattataaaatgagtaaataatattaatccaagccaaacaagatatatctatcacctcccaagtttaggagaattaattgaagaatgaaaatagtgaaccataacgtcaacggataatttcttacctagaaataaagtgcatccacgtataactctcagcaccctcccataaaaccaacccctccagccaccttctccttcaccaatgcgcctagccgtcttccttagctcctctttggactcatccgtttccaccagatccccacgttccttgcaatcgattgatggagcctatgggaatcctgaagtgcccttccagcttgaagctctccgttgctgttcctggtcatgccctcaaccccttctctggtaagttcataatgcaaccaaacacgcgcaaaacattaatttcattttatcgccatgccaccaaaattgttgtatgggtgaatttttgcatgtgtatatgcagatggcggtagtggtagtggtagtggtagtggtagtgggtgcaacaacaataacacaagagaactgggtatccacttggacttggaccgcccgtatgcaagagaagagctaccgcagcaaggtggcagcatggaggtgcagaaaggggaggagagaggcggtgttaggcacaatagctccaaccataggcggctttctagggtgcaatccaagcaacttgatgaattttatcgtgtaaatcacacagttgattccgtaagcatgtttcttttttcaatatttaaaatcaccacagcctttcgagttattagttcattaatatttgaaatatagtagattaggaattagatctatatgtgaagaatggatttagaaaccattagatcaagcaagttaaactttatcactagtattttgtacaaccatatgcatgtgcttgaatttttcatcgaatatttgttttgatagatcacacgttactacacactagtcaccaatatatgtaaagcagaggttattattgtgaatattataaatattaaaaaataataatacaccaaatattggttatttgaattttgttaatatatatattttttttcaaagttctaagtattttttatttatagttcaaaagaaattagttgcaatatgatatataaggtccatcctaaataagaaatcttatgttattttccattttcttaagttgagaattttaagtttctattcagtattgtattaatctttactcgtataaaaggactccaatggatagccatatataaccattgtaacttttagatattaagctatgaactttctaatattagataacaactaatcggatagccatatataaaattaaatcaagatgagtcttctctatatgaaaatgtgaataacataagtcttctctacacgaaaatgtgaataacataagtcctatctatatgagaatgtgaataacatatttcatgaaaaatatgcttttatttattttagaaaataatatggtattttttttccttttacctatagcaaagcatgggtatttagctagtttaacagagattcagaattgataagcatcaaactgcatatgttaagagatttcaattgtagatttttcacgatttaaaataattcaagactttataaataacttatatcaacttatactttgttttgagtctctatatatcatttttatgattagaattatgaaattagaaattgataaggaagatgtttatcaatttatagccccaattatatcttttcagtaatctaataagaaattagaattaagcaatattgaatcgtacatggtttgggagcctcgattataacttatacatgattctactcagtttttgagagttatagctttttcatgatttaataattttaaaagttcacagttaattaatatcgagttgtgttcgctttggagtcttaattatagcgtgcttttccataagtttgattgactgccatgataattcaatccaccccacccaatcaccatttttttcctagttaagatcaaagctctctcaaagtctccaattaaaacaagtatagacagatttagttaacttcttattttgcaatacaaggatacaactggtgtttgtctttgtattgctacaatgctatactagagttcatgatgcttgcttgtactgaactaaacacaggtcgagcagttcgtacttgccttgaccgttttttttttttcaaataattagtagctcgattgttcattgtcaatggagaccagtcacttacgctctaggaaattaatggaacattttcagaaacaaaagaaggagttggcagatcgactgaatcttcggataagtcaggtggatgcttggttccgcaaccgcaggttaaggtaattagaagttttttcaatgctctcactaattagaatgttcagtcatactcattctttcttacatatatgcgtaattctagttctggttttctcttgttctgaaggttaagcttatatcacctttaacaaaaagagagataaatctctttgtttttctttaacgtgataaatctagattgagccgtgcaatggtctagacttccattctaaactctgaaccttttattttaaaaactcatgtctgaaccattgcacagctctacgccgtgtaatccttagatcctctaccataatgttactatctttacagtcattattatgtgggtctcacctttctattaccccacatgtcggtgtctgtagaggatgtgaacccaatgattccagtaagaaagcccttactagttttcacaaacagcagtacaaatcagttagcagtgtagaacaagttcagagttcatcatccgccccagtgactgttatgctattactagtaatacctttcagattaatcttcacaaacctacagtaagtgtgatgttgctactacctgctcaggtcgaagcagaaatccacggagatggagtgcgcctatctgaaggaatgcttcaacaaactgaaagaggagaaccaccgcctccagctccaggttgagcagctcaggtcaacgagcttgcagctgcagctgcagctgcaactccacagcgagcgagtcgccacagctcccactggacagcaagccggcacttctgcggctgctcgcatcttcactttgcctttgtccggatacaacccttccagggggacttggttctcgccaaatgcacactgatcatgtgctcatgccaagaacacaagagggatgctacaagattcgtcgctgtcatgatcaactgataaaaaaaacctgataagtcacagccatcttgtaggacattgatgaagaatgagcttgggaagattagcgtcgatgggaattggatactgtttacctttttttttttcaccgggccggcgtggccaagaatttagtgctttatttcttttgaaacctgtcgttcttcgtcgttgatcatgagggctgactattgctagatcagcttcagtttagcctgtcattgtttttgctttgaacaatcattagccagtcatgtttttgttttatctctctcttgaccgacagattttgtggttctgcttgcctcggaaaagaacaaacatttttggttaatctctgaacaactgaacgttcagtactacgagtcaacttttatatactctgctggagtatctatactttctataaagttataacccactatctctaaagcttaacatgcaaccatgccacatcatcacccactaacaataattacatattcaacctcatgcaagcatgaaagagcatctgcaatctatttaattctacaaattaacatgcaaagcatattcaatcaccacctctcacatcatttccccaatagttttacaaatctctttatcatttttatattatttaatatatacttatcaacatgttctacattaaagtgcgaatatcatttgtttcatggtaaatattgataagccctaagatttgattatttttttttctttttactcctagctgaattgtaacgaaaaaataatattgaaaattacttagtaattcccgaagcaaagcgcggggaatccctagttacaaaaatcctctgttgagagtcgagactacaaatggccaaaaaaaaaaaaaggtctgcaaggatcgaatcagaagaacacggaaagagatatgtgcagtgaacaactaaaacattgattcagctcagtcaaaaaaaaaacattgattcagctgttgttttcgcttaagttattccattggtccagcagtcggcaacaatcagatggtaagctcttcaaatctaccgctctcagccaaggagttccattgagcaatgctaagttagcagctgcaactgcacgaacagttcacacatgatcagaaatgatttacagtcatctaagaaaaaagtgaattacaatttgtttagactaatcaagcgtaagcgtaggtacatacgttagaacatgtgtcgtccatccacggttctgcaccatccggatctttgccatgtgtaagattttgtactaccgttcctgatcagttcatagtagcccaagaataatatagtagaccaaggtgatggggagagctattagcatgccaaatatgaccctgaaagcgatgaaaatgttgatacattcagaatcttgaaggcttgaacagtttgcagtcatgtaatacttgcaattttcagggtaactctgctgacttacaaagtgcaaaggatggtagcgtggaggttgtattccttagcgaacacaaatggcacaattccttgtggcagggcggcctaacaaacattcagtgcattcgtaatcagcgtcttgatttggctcaccgtttaaacccaaccaaaaatacaaggcagtttcagagatcatcgagacatcgactcacctgaacaatggcgatacgcaagagcgtgcctcggatgccgacggcggcggacgcggcggccatgatggcggggccgaagaagaagcggacgcccatgctggccgccgcgacggagtagccgcaggcgatgatcttcggctgcgtggccatgaacaatcctgaacggaaggttcagtttagagatctgcacttctctgaaccaaatacagtactagaacagatggtgatggaactgaactcacctaagctaaacatggccatgcctaaccctgcatcggagagaatggagattgatttggctactatgattggcatcgtgatgtggaacctgcaccaatgcgaaattgcccattacagcatcaacgctgaactgacaaacaatcagaaattctgaatccaatttccagcgaactgatcgaccaggtgagcttgctttaccggaacgcgatgagcgaccaggtgaggccgatgaggctggcgtacgtgttggggttccggatcagccggcgccaaaccgtagtgaggatgagccgcagcatcacgccggccggcgcgttctgctgccctctcgcccgctccgcgcccgctgcgccgccgcccttcgtcgtcgtagtcaccgccgtcgtctgctgctccgtcttggcgccggcctccagcttcgctagctcgtcctgcccgcccacggccttgttgaagctcgccgcgcgctccccgcccgtcgctcccggcggcggtcggataactgaggaacataatgtaaggtgtttgttggattgatcaagaggaggttggagactgacctctcgacgaggcaatggatggcgcgtcggaggggacaagccggcgcgtctcccggccgctgcggaacaccggcaggccggtgacctccgacgcggcggaagcgccggagctccactcgatcatgtgcgtgtccttgaggtcattggtgggagccacggtcgcggatgctctggcccgcgccgccgcgtgctcgtcgaagctggacggcctcggggtgtgctgcctcgacgaagagtgcagcgagaagaggtccgcggcgccgaagctgaacgcgcgcagcgcgctgttgggcggctggtgaccagggatgtcggcgagggtgaaggtggagcccctcggggtggcgttccgcgacgagctgatcgagtagatctccacgccggtcaggttcgacgcgcgcggcgtggcggcggcggcggcggaccgcctcgacaccgacgagcggcacacgaccatgcgcagcctcccgtcgggcgccacctcggcgtgcgcctccgcctggctgccctcgagcgacaccacgtccgggtcgacgtgcacggcggcgatggacgccgcggtgtccgggaactgcgccgcgatgagcacccgcgcggcgcggaactcgaagaggaagagcaggagcgtgtaccagacgatggactggagcacgacgatctggaccatgaggtcgccggagtaagggccgtacatggagacgaggagcgggatccccatgacgagcgtgttggggagggtggagacggagaagagcgtgatggagcagtcgagcggcggccacgccggggggacgaagcgcgcggggaagcgcgaccacgcggcgagcgcggcgaggacgagcaccttctgcagggtgtcggcggcgacgaagcggaggttcatggcgtaggggtcgctggaggagatgaagtggaaggagaggagcgggacggcgatgacggcgacgaagcggttgatgccggagcactgctccggcgtgaggacgccccaccaccgcacggagccgtacgccaccatcatcgccacgtacagcggcaccaccgccgacagcaccatgtacagctcgtgccacgatatcatggcggcggcggccgatcgccggtctgggagcagctgatcgatctgtttcctgcgatgcgatcgagaggagcagcgtgcgattagtgtgttgctgttacatgcagagagtgagtattgcggcgcgcgatgccgcgatgggatataaaagtacgctgtcccgggctcccggcctcctgcgcgctttgactggttctcttcgaggtatgtccgtatgtgacacaaattttgctctggtggagaactccacggagcaactgaacctcgtggcactgcttcaaaaaaaaaaaaaaactcgtggcacagatatggctacgtagccaaatctagtaatctcgaaataagtttatttttttattcttttttgtctttaaataatttgtttttagcaattattatatcgaagtttataaaagtatgacataattaattgtattgtatgtagatgaagaaattaataattatattgaaatttgataaattagatgtattataggtttttattagtacgtgcgagatagatgaaaatgaaatttattttaaggctgtgtttagtttacacttaagtttggaagttaagttaaaattggtacgatgtgatagaaaagttacgtgtgtataaaaaatttgatgtgatgaaaagttgaaagtttgaaaaaaaaaactttgaaactaaacagggccttagacggagggattggcagtagacacggctagtgtacacattttgcaatgaatttttccgaagaaaaaccactgtagatgtgtcagtccagtcgtctgtagatggtctagtggccgttatgtgtgctgtcacgtcaggccggcggggtgcacctcgaaatgccgtgcaattttggatggactcatggcatgcgaggcattgtcagtgtggctggtacagcccgtgcagatgcagctgatccgatggcctcgcaggctggcaggctcttttcaggcagcagtgcagcaccggcctagtatgcagtctccaaatcccacgaggccgcaagaaggcagcccgcaaactcggcccatacaaatgctgaactagttatcggcccaagagcagtaaaacgcttctttcagcgcttccggcccaggagcctcaaatcacacctcagactcgaacatgaattgggtcgcgctaccaactgcgctttgctctacacttactcctatcaaagcaagaccctcactttggcatcgcagatttgcggcgtcacatggctgccgcggcttggcttctctccgttgtgtcgcacacgaagagtgccgctccgtactttctacttgcagtagaaatcaatctgatccgtagatctagttatatccaaaggctcagatctttttatactccacctcaatttatagtactagaagtgtggagggtcattattgtccaaagaaaaataagcgctcatgggtaaaatagtactttcatccttttcttttaaccctacccccctctacgttgccggccgctcgccctcccctcgatcaaccggcgtcgcgccgccgcctcgcttccgccgccaccgccactgcctctgccgcttcacttctcgtctggacgacgccggcctcctcccccaatcgcagccgccgccgctcgcttctcctctggagtctggacaaactcctcgttcccacgtgtccccatcgttccccgtccctgctgcctcctctcgtccccgatcccagtccccagaggcgtcaatcggaaggagctcgagggcggcgccgactccgcgtgcaagacctgcacgatccaccagcgcccaagcttcgtcctctcagtctcctgcgccgttcgtccttccgtccccgccatcgctgcctcaggtcatccctgccgtggccgagcggcggtggttgggcaaaatggtggcagatccgcgactagatgccggtgaggaggttgcggatcagccttctttcatcccatcacacaggaggtaacgacgtaacgtcctgttctttcatttactctcatgcagatcagtttttgccccattccgtgttgaatggtgtggttgaatgttttgttctcaattatcagaaattagaggcaaaccagatgcaaagcgaggtccaaggagtgcaaagcaaggtccaaaggagtgctgtcccatattacctttgtgcgttctttgatgttggcttgaaatctgggataaagttgtaatctttgtacataagttgggaccttgaattatattgtgcaattttagaagtcatgattttatctgacttcaaccgtgctttacatgcttgctcatgccttctttgatgtttggctcgaaattgggataaaattgtactttataagtcaaggggcatccggctgggcagagacagataaccatggagcgggaatcaaacaaacacaattttccatactgaagatttttcacataaattgcaaattatactttaatttagttataccataacaattgataagtcaaggggcaccagcagcatcgacagttcacgatgaacagcaacatagctgaagccatcatcaataataaagaccaccgccaataaatctgacaccctattattttactgaggactcagagagagacgttaattagtgccagtcaggggctctgggctaccggcggaactacaagggcatatgaatcggagaaaaagaaatcgcgtcaaaacatgatatatagatcgaaaaaggattaatagatggaaaaaaaaactacagtggaacgcgttgaaaaaaagaaatctcgtgaaaacatgataatatatggaaacgggataatagatcggcctaagatgtggtggccgcgtcgtgcctgatgcaatcaagccaaaattacccctaatcagtccctgccaaaattatccttaatatgtattagaagattactaatctacccttcaaaataaacggtcaagattaattctagttgtagtataatactacaagtaaattgcaccggagcattggtcgcacacgaaaggaaatctcgcaaagcaatttaacgggacgagtagacgagcgaggcgagaccgcgagagcaacgggacgagacggagagagacctcctcatcagacactcgcatcgcggcccaggcagcggctgtgcacggctgctctttatcgaggaccgtgaaaagggggcgaaagctgtatgtatctaggagtagcgtagtggaggcgattggcgatgataatacaatgatggggttcatcccaaagtatacaatctacgactagtacaccgtagtctacgtactggagtactagtatactactacaactaccaggagcaaaaacagcagaaaatttctgagggggtgtttagatggggctaaaactttttagcccatgtcacatcggatgtttggacgctaatttagagtattaaatatggactaataaaaaaactaatttcataaatgagagctaatccgcaagacggattttttaagcctaattaatccataattatcaaaagtttactgtagcatcacattgtcaaaatcatagcgtaattagactcaaaagattcgtcacgcgaattagtctaagcttatagaatatgttttatattagtgtatatttaatactctaaattagtgtccaaacatccgatgtgacagggacttaagaataagtccctggaacccaaacagcctgatgaactacttgcagtcatacgccngtccatgcaatccaaggccct

SEQ ID NO: 3800 - DNA, 13837 bp, Oryza sativa
  unsure (1)..(13837): unsure at all n locations
ccagagctttgattcgacttcgtctgcaagtagttcatcacattgatttgcagctgccgccgctgcttctgcggatctactggcaccggtgcagatggctggagtagcctgtactagggtgttggggatagctgtagagaaatgcatgggaggcaaggctctgcaatctgtgccatcggttgcctcgggatgacaaataaaatgcgactagccattgcgtgcctagcctacctcctcccctctcgtcttccccacaagcccacaagagagggaccgcatctcatctcatgtccttgctcgtttttcagactttcaatcactgcatactccaacctcaatctactccttcactagtgtcattcactcactgattactgctttgcaaaaacactttgattagtagcagtactgctagtactagtgttgtacacttgtactgtgctcctttgcctttgcattccggagtgaaatgttaaagtgttcaccaaggtttctcgtgaattttttccaccgttttcttgcattcgtttcagttttgactacgcacatctgctagtaggagtagtagtacggaagtaactagccctacactgactaatgtgtcggtgacttcatgatccacaatccacatcatatcatttgatggaactgaaattaatctaagtactctcgagagagacagcatcaaagattcaagaacatgacaccacgccagtgtggtctggatcctcgatgcctctggtcgggtgctaattaatcactgcggaaataaaaacctgaagcatgtctgttccatccctttttcatcaccgtctttgggcgtggtttagttctcaaatttttcttcaaactttcaatttttccatcacattaaaaattctgtacacacgtaaactttcaacttttccgtcacattgttacaatttcaattaaacttttaattttgacgtgaactaaacacacccttgatagagtgacaaatagtaaattctcccattgcattacacagctgaatggagtatgccagcatctcgtttgcagtttgcttcggtctcgtttagttccaaacttccttcaaacttttaacttttccatcacatcaaaacttttctacacacataaacttctaattttttcgttacatcgttcaaatttcaaccaaacttctaattcattgtttttctcaacatcctagtgaccttaattcaggcctttggcacgatgactgtgcaccggtattgctgaatagatgtacttccgtccgattgtatattccgtattgctatattttggatggagtatcgtaccaaaagaaaactctagtacagggcccacagtaaagcatttgcgagtcttttgagagaggggaaaaaaaactagaaaactgtcattctgctgtgtttagaattcgtcattggttccataccatttgtttagtttttttctccaaatttgtagttacatacaaatgttagccttttgattaaaaaaaagagaaagaaatgagagtcgtgtaaattttggtgttgttggtagaaaagaacggtaaaccaacacttagcctatgctcagttaaacaacgatggataagctgaagccagatgaactaagtaatcaagaataatttacgaataaaacgtttatatcttaaaatccaaaggcaagaaaatagcgcgccaattaactaacacacacgtatttgatcacccccacaccattttataatacggatcataccagaataattttattttattttttatttgatgtggcataatttaggtcttcttttttttttctcgcacattagatgccacacatgattcttcctgcactctaaacgtcatggcaaaggacaaaaactattgggaaagaaaattaaagagtttctttattgattattacaataaacgcagtaatgtaccactattctaccacttgcatttagaaaccacaccagagagtacttgatttgccagagcactatcctttcatctatagagtcattacagtctgacagcagcatgactctcttatcaccacgagtccatgacctaacactatgcataatcaacactaaaccaccatgaacattcatctaaagtctaaacagcaacttcctaatccatttccagtgatgatgagatgacatgggcaaagaccaaggaccagagagagaaaaaaaaatcagacatggctccgttaaacccggaggaggtagacactgagctcaggaccgccactgttgctgttgctgctggtgcttgtgctgtccgggttcatcatgtagaatgcctccgagtcgcgcgagccaccacccgctcgaaccgcgcgcgcatgtacatgacgtcgccctcgccgccgccgcagctggcggcgggtatgacgccggcgcccatggacaccggctccagcgcgcgcagcacgcgccagtcggcggcgccgcactcgcggcgcaccgcgtagccgcagctcttgccgttgcagtacgcgcgccacaccgtctcctcgagcagcctcttcccgccgcccgtcgcggtgggcagggcgggggcggggcccgcccttggcgcgctcgcactcgagcgcgatgcgcacaaggcccgaggccatctcgcgcaccagcgcggcggtgggcgcggcgagctccagcagcagcgccgggcacgcgcgcgggtcgagctggaacgcgaggtgcacgtggccgcgcccgtggccgtagagcgtgccggtgagccgcgcgccgaggccgacctgccggtgcggcccgtcacgggcgccgcaagcgccgagcgcaggcgcgacacggccgtgcgaccttcctacgtgcggcggatgctgctgctgagaatgctgctgccgcggcggcttcttgggagaagaaacgaggtcctcagaatggaaactcggacagacagaggagaacgccattgtcgcctcatcctcctcctcttcagcttccgagctcttcatgtaatcctcctcccctctcgtggcgccatggctgtagctcttgccaagaaccggcacttgaaatgcctcctagagaaggagagggaatcatgggggtttcttgctgtgatggttctcatagcttgagttagccaagcctagcttcttagcagcaagcaaagcaaagcaaagaggcaaagagcacactgctccttcactgagctagcgttgtgcttgtgcagctgggttgtgtgagaagaggttgtattcagaaaatgtgtgtgcagctgaactgtgcttgtatatgtgtgtagtatgctttacttctagtgttatctgtccctgcagaagcaggcttttgtagtgaaggagtggctggtgagcagaacacaccaaaaccgagcgaacaaaaagaagagagagagctagcgatggagagtgtgctgctggggttgggttcttgtgaactttctctttgtttttttctaatgaggaaatggtaggcaggaatgcaggctgcggcggtgggacaaggctagagagatttatggcagataagataattgagaactgagaagagagtgacaggagagaaggcgtacctggttttgatggtttggcttttatcagtggtggggaactggggattaattagtgtgctagtgattatctgagtggatgatgatgcactgatgaggttgcagtgaagtgtagtaattatatttcgatgttatggttaacagacgaattgggtatgatctctgaaaaacagagaacaggttagaaaaagctacctaacaatcatgattcttaatgtatatgatactttggaaatggccattagttcccaacaaacttagacgacatgagtgcagcaccgcaccacatttgcattccctgtgatgtcaacggcttctgcaattggattgggctccgttcctaatcagcaatctttcaatactcgtcatgaatgacatatagctcaaaactataattaggaatctttcatcttttctttgcacaagctgaaatgatacaacccacaagtaagattcttccttaaaatacacaaaacacatggacatgcagctttgtctaaccgtactgcctcaagcaacgaacacgatcacaaagctacaagtaaactcgaatgccgaatggtagtatagtacattgatattcatcacagaatgttaaatgtgccaaccatttcagagtttcagagttctttttcttaagccctgtttagatcctccaaaatggcaaaagttttgccattttgaagtactttttgccattttggatctaaacactagtaacaaaacttggcaatttggcaattggcatttgctagtccatagtagcaaattgtgccaaaaagtgctttgggaccgctccctctttctttctctctctcactttagtgctagaatggaaaaagtttaggatgcatctaaataccaactagtacttttgcaataccaaaacttttgccatttgccatttgttatttcaaatggatctaaacagggccttaatcttcagagaatgcacattttacctctctcacaaaccggttcattccgatcatgcaacacattgcttttctgtgtttggttctttctttcaaatcgatcgctgcacagatccaaactaaagcgcgaaggctgcagggttcagaggagaaagacgagaggaggcaaagaaaagaggagaggagaggctggctgctgaaccagcacagtttttgctttcctcgggatcggtggcaatgcaaagcggggcccaaaggggggtaaaatccaaagcgaaagctgcagctttgaccgcggagggggccgaccgaccggtgccgacggcgacggtgcgtggcgacggaagcagcgccctgcagcgccggagtggccgggtccaggtgacgacgcgacacaccgtactagcgacctcatcgtcgtcgtcgtcgtccccggctagtgccagtgctacaacatgctaccgctaggagagagagagagacacacacacaggccacagctactctacatctgtctcctctcgagcttagtactgttgctggtctggtcttatggcctctgcctctcttgagaagatcaaatcacgcttaaattcacctcttctccttcgttcctagctgtagcatgttgctgttcctgtggtctccacagcagggtttctcaaatcgccggggctagggttaccgcaccccagcggtaagcacggttaccgcgcgataaccgtaaaaaccatgcaaaattcatcaaaaattcaaattattttttaagtttatttgaatttaagaaggttatcgtggtttttctactaccgtatcctgggataagaccggtaaccgtgctggtaatgtaaaccctgctccacagctcgcaggcgcagctcagggctcaggagagacgagggagggggaaaggaattttcaacgtgttccaaaggcatgttcattgttcaaacctagtttgtccggttcagcattaacaaatcttctgaagcgcagcttaattgtgcatgcacatttagcaacaggtcaatgtggcctggaacctatccgtatgcagccctatcacaagtagatactatcacattaggatgcaagatcaataataagatgcccgtgagcaccaaagctaaacgaagaaatttatttgactgcacggcagatcaaatacgttaaacaacttctgtgaaaaaaaggtaaacaactgatacctcttcagaagggactaattcggtgtgccagctttatttgccactcagaaaccagccggcctgggataggtgccaatgcatccttctcacgtgcatctgcatcatcagcatggataacagaaataacgtcttcaaccagtttgtccctgccaccccttagtggatcctacaacggaacgatatgttagggttccccagcaaatttgtgcacagagggccatcctgaatcctggtgtaactattccagccttcatattcaaaatgactaacctgtaaaaatacatcagtatgtgttttcccttcatagagtagtaacttggctttagcaccagcttgtttaaggacacccgcaaaagtttcactgcatatgtgatatacggagttaaagagttcttagcagcttgaacatacaacatgaatggattaacttgtatagaaagatggatcaaataacggtgtaacacctaggtagtgtttggttgcaaggatgggatggggcaaacccacttttaggggtgtttggtttagtggtgagtgaggggtaggtccatggagaggaatattcctcttagatccgggaccaagccatccagcaaaatcggtcggacgagcttgtcccacctgggacgagcgcacagcgtgagttgcgccacttcaccgcgcgtcgtgtgcatcgccgtcgggagcagctatagctggcggcgatggcgggctgtcaccacgcgccctgacctcctcctctgtctggaggccggtccaagccacgcaccccccccccccgacctcctcgccgcatccgcgctgccgaatcaggttgcctagaggtcgggggccaccggatctggcctccttgaggtcggggcttgccggaaccagccgcgcctccgacctcgtcgccgtggaccgatgcctctagctccggccaccacgtccacatcgtcattgtctccgatgtcgcgccgctcctccttccgcccgcgccgccgatcaccgctccttcctctgcaagctgcgagctgcgagaccttttctcgctgggagtaacgtggtgcaaacgctgttcatcacatccctaccccatcccttctaccaaacaaaaaattgggatcattccatcctataaaccaaacaagcaagtaggatcactccatccctaaaatcagggattgtgtcatcccatcccacatagtcccaaaaccaaacacgcgcctacagaatgtagaagcatataaaaatagaagtgagaaattaataagtaataggcagtgtttgcctacaataatatgtccagaaagacagcttgtatggaacttgacgttttaatttgacgcatatatcttgtaaaagagaggaaccccaaaccaacataacagaaaagataatcaaacctagtagagaattattaattcccctggaaataaaatataattatacctagcagaaaatggtatagaataatcatccgttccatgcaaaagcacaatctgaggaagaagagctattgtttcaggacataatttcttggcaacagtttctggagagaaatgtggcaatgatttctttccctccattatgctgaaaaggcatttcataagttcctgagttttgtatagttctaattaagaattaaggaaagtagaagcaacacttccatatcaaaagtacagttacactgttacctgagaaatattgaacggtaaagaccacgttcatggaaatgatcaaccaaattttcaatgttgtatctgcaaacagcaatttgagcaatgagaatatatgtcatgtaaacatagaatcactagctctgattatttagtatctcattacacattctgttgcatccaaatgccaaagtgagactgcagaagttggttcaaaattctaaaaggcaccatatgttttctcagctactaaaacacttcatgaggtacaaatctaaaacaagcactcaaaacaccaaatggtagatatctattgctttttagcaggactagccccagtttcacaacatcggagtttataagtcaatcatcatgtaaactaaacaattgccaaaatccgactttcttcacaatcaaaatcagactaacacaggagtagaatcaatagaagatcacttaaatgaacacataaagaaatcatgcgatgttgccatgatagcaggtttagtgttttatattagaccaaaacgtgcatggtatagaaaactaatcaagactcaggagaagcaattctttaataatgatgataaccatacagacatataatcaatcaaaattagatgataaagctatcccaccctccagacaaaccaaagtatgcttttatttgagtaacactccatgaaatctgctctcccctagattctttagccgcttgttccaaaagagcgcatgctgcgatatgtgctcctgctgattgacccattaagtatatcctgcaggatttaacacgatgaatggtaagtctttcactaaaatcatcagtaaaaaaatacaaagcaagaataatggaaaactacgaaattattaggatgcatgggaataatacagtcatcagttccagaaatgaatgtggttaagtctagatgcaagtataacatatactgtgcattttagctttccattcaataagacacatatttctatatcttacacaatttatgtcggaacagaagcatgcccagaaaaccttttaaaaaaacttctatgtgcttgtcctcattcaataaccaccagcatggacttcaaatataatcattcaaatcatgtacattgttcattcaagaaaaccgtttagaaaaacttcatgtatacatgaaactttttttcagtagtaactttattagggtgttgtgatttgataaagtatcacttactgattaggatctcctccataggcaccaacagtctcacaaacaaatgaaatcccatcagaagcatcgctaaccatgtcacttattgttccttgaggaaaattcctgcaaaacatatgcttttatatatcatcaagcaagcaaaaagaaatcgatcaatcagtaaattcttatcagtaaaaaaaaatctaccaaaaaagaattataagaatcatatatgaggaatccatgcaaagtatgagcacctgtaatcaatgcatgcaactataattcctcgctctgctaacctccttccaagaagagcaccccacgccttgtaactagatataactgaggtcatcaaaagggcaaatcatggcagaagacccttataatacatcatcagaagaattttactcacccaatgatccatgcaccaccagtaacaaatgcaacaactggactgggttttttggggtctcttggtatgtaaagatccaacctgtatagtgtgaaattgagtctctagcaaagtccaaaatcagattcttccgtttatatagcagatagtttctatacctatttcttggttgatccccatagatcacgctcctcaaaacttgtcttgaaaagaaataataatacccaactggcaatcaataaataataaattagttggtagatgtacaatcatggccatgctttcaattccgtaaaaagggaaccaagaagagctaatttgccagaacacttattggtacaatcataacattgactaaccatcatgttcaacatagaaatctgtaataaaaggtaaggtcaacgaggccaaaggtaaacatgattttcttttttttatctacctcttatgaaaccgggcataagtaaaattgcatatattatgagggcagcgagctgagaaatccaccggtagcctaccctggaaaaatagaaagaacatcagggacatctatacagcaaagatgaaaatatattgtatatgcatttggattttttttttttggagattttggtgggaagataacgcaatgtatattaggcgttttgaagcatgacttcacaagataataaaattcagttcatcagtgctagagttagcttgccatccaagtgaattagttgaaaatgcaaggtgctttgatgcaacaatctgttttaacaatggggatttcctaatttcttataggtcattattggtatgtccgtgaggaggagtgagaccaaagacgacgagggcgtgttgccgaatggcgatcggtacagtatcagattacgttacccgaggtatcggaggaggatgaaggcgaggcgcgtgacgaggtacgtctcggcggcggcatggctgacgtcctcccggaacgtggacctcctctcgccgcccccgcggctgccgggggcgagcggagagtcgggggagaagggcacggaacgccggcgcacgaggacctggggggcaccgcgtggaggtaccgcctccgccacggggcccgcgtcaccggagaccggactcgcgggctgcattgcggggcggacgacgacgacgatgctagctcctggtggcgagggatttggggttgccgcattggtggggtgggtgaagatggagggggcgtgtaggccattgaaggggaggggagcggagacgccggagaggtcgcccaaattagaagaagccggagcgcgcgcggcgcgacggcgaacggagaaggtggaattggagaaggccatggggacgcgtgcgtggccggcgaactcgtcaattcaagcgggctgttgttgggctgagaggccacggcccatcacgagatggcctgacgaggccactgtaagtagtgggccgggcaacgcgcaatggctcgacaatgtttcagcttcgcaagtggtacagtgagccgaacgatagataagttaatatattttttttaagaaacactacaactacacgcgcgcgtaacatgggtactctcgtctcgttcctataaactataagcatcttaaaaaaactagatcgatatatcttaaaattaatagagtcatcatagacgtctcgctgtcgatgtgtacgtatggatacttagtcataaacataagcagctgtatcaagtttagaacttaaaattggttgggttatttccaccataagtaacataaccagttgagatacacaacttcacaaattaatcaaaaattgtattatctccgttctaaaatataacaatttttatatatgtatatggacatatgcttgtcttttttaagggaaaaccagcatgagagtgtgccttttaattaaatatagcgggagaaaaatacacccctaagagcaaagaaaaggcaagtgcccaaaaaaacaggggggctgctatataacggaatcccattttcgaacgggatgatcccgagtaggtatcaggtgtgatacctatcaggtatcagacgattctacacaacaggatgatcccgagtaggtatcaggtgtgatacctatcaggtatcaaacaattctacacacgtttcaggtgatacctacaagtatcatgtgatacttatcaggtatcatgcgattttctaccacgtatcgcgtgatactcgcaaggtatcatgtgaaacctgtcaggtatcaaatgatttcaaccacgtatcgtgtgatacttacgaggtatcatgcgatgtctgtcatgtatcagacgatttctaccacgtatcgtgtgatactcgcgaggtatcaaacgatttctaccatgtatcacgtgatacttgtgaggtatcggatgatacctaccaggtattaggtgattccctactagatatagctgggcatcccgtttggggaggagcaacccgacacgcgcggtcgccccctgcagccatcccttgtagacgaggacggcgacggcggcggcagaggacgggcgcggtgacagcggcggtagcgggggacgggcgcggcggcggtgggggatgggcgcggcggcnacgtgtcacgccccgaactagtcctgagcggaactagcccgtgacgctccaaattaacctgttaaccgataccagtcccaggaaacagtgctagtatcacaggaagacagaatatcacagcaacagaggtctctttattatagagtaggagtacagtcatgttgggctgcggacagatctcgagctcacaactgcattacaaaagggaacggaagccagacttggaccaaacatcacaagcgcgacttgggaactaggccgaaaccctaaaactcatcgtagccggcttgctcctggaagaactcctcgtcagcgggatccgcttcatctttttcagcaactgggggggattatttatatagagcaagggtgagtactttcgtactcagcaagccagggaaacttaggtggttaatgcaggcttcaagggaaggctgttgtttttgcaattgattttatttgagctcttttctgaaacaactaagggagtgcttctcaaacgacacgggtgagacagtgcgtctcgtccggtcggagtatgtgcaatgtatcagtcttttgaattgattaagattggctcccggccaacagcttttaaacggcctcccggacctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacccacacgacattactaacccggatcatccagttcgtgcagaatggccacgactagagaccttaaggctttcatgacaaggcatttcgaaagccgacacaggttcgccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggcgaccatcgatacccgtgcagagtgcacgattaccgaggcgcgactaggtgggtacaagggagcatggtataacaattacaatgggagggtcaaatacaacaaattaggtaggtctgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccaaaactacacgcgaaacggaacaactcagcaaacggtgaaaataaagccctattattgacctctaagcgtgccattagatagatctcgagatttgaggaattttggaagttgaacggagtcaaacggacttacggttgggaagatattgaatttctaagattattggattttggtctaaaggaaaagggtttatttaaatcctttttgaaaaagaaaagaaaagaaaataaggagggagggaaattagactttcctcgggcggctagggcacggcccgagagaaaggggcggctcggccgagcttaatgggccggccggcccaagaaggtggcccaaagcgcgcgcgcgggcggggaggggagagagagggccggtgggccgtgtccatcccgcgtggtcccgagtgggacccgcttgtcggcgactcggctcaccgtgagcgaggtgcacgcggggcgtgctagggtttggggagggaggcgcggcgcatgcgcgcggttcgcggaggacgcggtgcggtgggcccacgcgcagcctcacggctcccggtggaccgcgcgcgcgagggggcagagggaagcggcggaccggggtctgcttgacccggtcgcggccaaggtggcgccgacgtggcgcctacgtggcttgcacgccgggtcggcngggaggtagaacaacaacccccgnccggaactgaccggtgaacaacaagcggcaagcgc

SEQ ID NO: 3801 - DNA, 5548 bp, Oryza sativa
  unsure (1)..(5548): unsure at all n locations
ngtgnccgagtcncccttccgcgtccacgaatgcaccggctctcccggtgcttggcgatgaacggcgaaggcgagacagaggggcggcaatggcgcggtgtcggcaagcgaaacgggaggaggaatcgatgggagggcgccttggtttataggacgacgatgtcggtttggaaaccgaccttggccggtcaaggcgcgagctggcgctcggagctcgcggccaaaacggcgacagaggcggaggatgacgccggcgggaggaaaaagggaaaaagagggagagaaaaggggggcttgcccccttgccactttggggaaaaggaggagggagagagggcgatgcggcagagggggggaagctctgcctccatcccttggaagcacgcgcgaggaggggcggggccaaggcgatgacgacgacgatgccggccgggcgatttggagcggggcgacgacacgggcggcaggcgcggcaggcgctgacggcgtcggcgactggccggtcggccaccatggcgcgcgcgcgcggaaagcaacgggcggcccggcggttctggcgacgtcggcgggaaacgacagcgaggtcggagggcgctcggctcggcgcggctcacgcgcacgcgtgcgcagcgcacgggcagagcgagagagagagagagagccggggagggaggggaagatgggccgagagggattcggcccatcgaacccgagggaggcgaaatagacttttgcggagggatttgatttgggaaggatttggattcgggattgaactcaacgatagatcggggatttgagatctgagatggcacagacactagacaacaagcaaataaacggatttcgcaaatagggtttttaagagatagttttcccgctaggcgccacgacggaacgggcgctacatgacggcggcggcgtcgacgggggatgggcgcgacggcggcggcggcggaggcgacgggggacgggcgccgcagcggcgggggacggtggcggcggcgagtgagtgtttggataagaatcgcgttgcgaagaggagctatcccgttgggggacggtatcccgttgggggacggtatcccgtcccctagcattcccgaaaaaacaatacactatacaaggtgtggtataagctcacgcaggcctgccaaagcccacacactgccttcttcctttattttcacgagaagatacgacgttatggtctccttgtgctaaaaatatccatcggtttcactcctaccatattttccaaatgataaggaggatcaacgtatgcaattccttcttagggttgccagtcgttgtggctagtttcttccaccggttttaaacaactaaacggtctcttggtgtcgaggctcaagctactggtaacccacccaagcagttataaggctctaaattcttttagcgtactgcacttggtgataccgataaggtgtaaggccgcttcatcccctctctagtgaagagggtatcatctattgttctggcagttcctggtcgtaagtctatcagagatccatatcatacagtaagaaattattatattttgagaaagagcgagtacacatttaggtgtatggtcgtagctcgccacgctagaacaacatttatcctaaaaatgggagaagaatcatcagctagctaggtgacgcgaagtgtttatatttggtcgcggcaaggcaacggcatccgccgccgtgggcgggctggcttaatttgcgccgttgcgcgtgcgcgtacgtgtaatccgtcgtgagtgcgcccatctcgaacggttgacacctagcctggcgagtgcccccgcgcacggcacggcgcgacaaaaaccgaggtgatatgcatggcgacgaaggctgtcacgggctggaaattgcgatgcgcgcgcggcgcgtcggcgaggccggtgcgcgcatcgaccgagttgctagcatcagcagcacaaaaggcggatcgcgacttcgcgatcgagctagcatgcgtgtaccctatccatttctcgatgagatcgacaaaacataatgcaattaacctgcgcacgtacacgcaacaccagctgatcaaaatttgtttcagatttacaaatggtgaaacgtacgaacaagatggtgaagaaattaattcatcaaaatttgtacacatttaggcgttacacatggtcatagctacgctagaaaaacttagtcgttgtgtcctaaaaatggaagaagaatcaacagctaagctagagacgcgggcaaggttggttgcgtggttaggtcggtcaggcgacgccgaggaagtcaagcgcggacttggccatgacggcggcgaactccttgaagctgatgaccccgtcgccgtcggtgtcggcgtcgcgcatcatccgcgtgagctcctcgaaggtgagcggctggccgaggcgcgccatggagcgggcgagctcggcggcggagatgaagccgttgccgtcgcggtcgaacgcccggaacacctcgagcagctgcgcctggtccaccaggtgcgtctgcgtggtgagcaccggcgcgatcgccgccgccagctcgtcgaactccaccgacccgttgccgttggcgtccatcccggcgagcagcgcgtgcacctcgtcgcccgtggggcgcagccccagcgaccgcagcagcgccgccagctccagctgcgtcaggctgccgtcgccgttcatgtcgaaccgccggaacagctcccggagctgcttcagctggctcccccgcagctgctgcggagccggtgctgcttctgacctcctcgccgccattgttgtcatatctcgatgtacgtgtgttttcttttctcttgtggatctgtgacctctcacggtggtggttgtggtgaagaagacgaaagggaggcgactttttatttatcgagggaaagacgcgttgaagagttgggactgactgggtcggtgcgtgcatgcatggaagaagccaaatgccggggtgggtgcgcataaaaaacgcaggatttgtgggttttttccctttgtgttttcggttgcacctgtgaggttagctgcagccggtactgcgaggatttttaccgtacgtgttcagttacaagtgagatctatgcgcgttaaattggttacgtcttcacccgccctgcacactgtagaatctagtaatagttttgcatcaacacaccacatgtaccggtgttctcgttgtaaaaatcatccatgcatacagtacgcacctttgataaaatgttgcgtgatctgtatatgtggcattgaatttggactgaacccaatgcattgtttgtgttatggaatattatcttctggaatataagatctattttgttttttaccaatccaaatcgtaatagagacaaatctcctcctatgacccatatttatagaggcagggtaaaacatataagattgacctgtactgacatatcagatctatgataaagagagagtttgtaatgtccttgagatcaaagagaatgacgcatgtgttttatatctctcatgtcttaatactgcgggagggatagggaatggtgatctgctaatagacatgttagtttataacagtttgtacccatcatatcctgatatccatataccgcgtccgcgtgacaagttgacagccctgaacttgaagacttgtaacgccattcgtcttttgactacctttgtagtaggaaggatgatccacactccacaggaagtcaaagatttccggtcagttgttacactgtctaactatctgcaccagctccagctacaactaggctacattagctaggaagatgcgaggaatctatcactcccatgcccaaaggttgcttgtatgattgtgtccaaaatgataaagttagcagcagagcaagatgtactcatacagaatcttacagctgccctgtaacataaacaattgtgggtaatcactaatcagctatcacacaccgtaccaggagggtttggtgatgtataatgttggcagtatttcacaaaatgattgcatcaggctgtgatggcttgatgttcacaagcccctttctctcttttttttttttgattctgtcaggtcaacttactggtgggtgggttgcattctgtcaatggcaagacagtttcatgtacagtactgttttgaatactcttcacttcctacatgtcatagcaactatcatggggagcatatcagataccgaaaatagtttttttttctaaatgtagtttacttaaatcttttaagcctgcaggtggaaaaaaagccatagaaatacatgacaaacaaagaagaaaaaagagcgaagcaagccaaaacaggtcaatcatcatatctttttgggggtctcttcattgctactactcgtcgatactggtgaaatatttacatcagggaacatcaaacatggatgaacgagccgagctggttcttcattgataaacagaagggatgaacagggaatttacatcagagggctacacaaaccaaaggtcttaagcatgctagctccataaccagtttgcttacgtaccttaaaacaaatgtaatcgaattacacgagatgtagccgtcaatctgcagatacaactccagcgtgctccatccgtcacggacccctgtactgcctgaagcatgaaaggcatccttgtcgctgatctacagggatcatgcctccacccttcgaagtatcgatcgcctccaacatagacaccacctcggccatctcaggtcgcttgtcagggttcgcatcccagcagcgtttcatcacgtttgccagagaacttggacagcagcgtggcatctcaggccttaaattctaatcaaacaaggattgtagcacacattaaatcaaatcagcagctagacagaaagcagaaaataagccagctagaaaagagggttttacctgacgaacaacagcagacgtgacctctgagaagctcaaatctggatatggcatatcacagcagtatatctcccataaacaaatcccaaagctataaacatcgcatttcctgttgtatggactgccgttgagaacctgcatatcacatgccaatataaggcatataacatgcaaggtagtaacttacatacacaataaatatcaaatacccttcctaggcccgaggtacacacaactgtttgatgcaaaaaaaattgacattttttcttaattaaatatgtgctgcaattagacaagtagtggcaaagaggaaatgaagaaactgaggaaaaaacaatgagcagtccatgtcaaagatcggatacctcaggagccatgtaaccaagggtgcctgtttcccctgtcatatcactgggatttgaagcctcaagccgagcaacaccaaaatcagcaattttcacagttcttgtcttgtcaagaagcatattttcagtctttacatcacggtgcacgatcttctttgagtgaagataacttaacctattgaatagttgaatggtcaaactattccaatcaattagagcttttttttttgagggacaatcaattagagttttgaaggataaagagtgagtgaaatagt

SEQ ID NO: 3802 - DNA, 7893 bp, Oryza sativa
  unsure (1)..(7893): unsure at all n locations
cgcgnccctttgatagactcgctttctactgcacgnagctcatcaagatgcttaccccctggcaaggtcaagagctatctgaaccacaactttaaaagctaacttctttctcctattctttatcagaaatccttttagtgaacccccagcagggtactccacaacaacacagcagatattacttggcatggcaagatgtccgctttctgtttgaatatctagatccctggcgcccattatagcccctataaactgtatatagaatttcaacctgttgttagggtacatgacaaatggatagacaacagaagaaatatgaaaagacatatactttgacattataagctatgcttcaagcactgcgaatgctaggtcatttgattttggtgcaacaaatccaaacctcgatacatgtaaggacttcgtttttttgctgaacaatttaacagctgctatgaattatataccacaggtagcagagtagataagacgataaggctgttatccagttggtaatgccactacacagacatcactttcaatatttagttaaggacgctagtgttactcacattgacacatagacactgatcaaatatatgattctaatgcacttgatatggcatttaagcatttaggcatttagaaatttagtcagatataagtatgccagttatgtataaatctgttctgatttcatgcattttatggtcgagggaactgtaattaacccaaaataattgaaagaagcatgacttgttgaaataaatagtacctttgtaacatttggatggtccagcttatgccagacagagacctcttgtgaaaaagctgctcttagtgctgcgatgtcttgttcggacctatgcccatcctctccccagtcaagtaatttcactggagaataatatgaatcaatgaattattttgaaaagaggtgtttgtaatgagaacatacaatttcccattggaaactgtcaaataaaaacaagatttgagaattgatctaagcaaaggtgccaaggttgggagaggagcagggggtaccaccattacaccatcaaattgtcccttctcttttggtaagggcacacaaagacaatttcggtcttaggaagatccactttttgtaggggaattaaattgatgggcttttccaaaaaaaaaaatgcaaaatgatggaatccatgctgatatgggggaatggacgaaagatagctaacaatccctggggaatatgtttctcaaaaatagaatgtgaacatcctataaactatgcatgtacaacaactaatcatcaaccaattgcttatagacatgctcaggtccgatagatgaatcatcaaaagggattctttttgtgctgttgccgtgtcatgagtttgcatcgatggataatctcaatctggtgaaaaagtacacaaacttataggttgcacatccctccatactaaaaggtcgacattttcggctttctttggaaccgcaaagcaactttaccatgaaattcctagccagggatcacaagaaccatggccaagtgaactgctgatgagcgagggcacgtcaaaagccgcccaatccaaccgatgtcacggggaacaccatgaaaagccaaaaggggcagcggcatcaactcccgcaatttactaaaaggggtaaagaaaaggagcacccaagaggccaagacagtgaccggcggttccactcgccgtcagcgccgcattggcagcgcgatttcgtcgaacaccgtacgggcgcaagcgagtgcatggatatcgcggtggttggtatcaagtaaaaaaactgggagaaatggcgcgcgcgggcgggcgcacctgcgacgtcgtggccgtcgtagacgccgcggtggacggtgccgaaggtgccgcgggcgatgacccccctgacgacgagcttggcggggtcgatctcccactcctccctccgctgcctgcggttctgcgagtagtgcgcggcggcgagcgcgggcggcttgctgccacgctggtcggcggccgcctcctccttgcgcttctccatggtccacgcgcggctcaggtggcgctccagctgctcgtccaggctcttgaggtcgatctggtctgcccgcacgaaccctccatcgccgccgccctccttcatcccgccgtgtggtggtggtggtggtggtgagcaacagagcaagtgagcaagcgagcgagcagtggctaggctaggctaggagaggaggaggggggaagagagtggcgaggcggagtggcatgtgagcacatgggctgccgaggcaggcagcggccggggagggggagggggagggagacggaaggaagacggggtgggctcgtgccgtcgtgtcgtgtcgtgtcgtgtcgcgtcgcgcgcgaggggcccagcccagcgcgcgcccagcggcgcgtggttttccgcggtttttccccctcgtcttcttcttcttcgacgttcgtttctcgctgctgctgcgtcgtgtggtggccggtgttgtttgggcgggggatcgatcgccgtctcggctcgcggtggtgtatttataccggcgtgagggcgggattgaggcgtatggatttcatttcgagggcagctctacttgcggttttaaatactttttgatccttaaaaaatactatataaattatggattgaggcgtatggaattgatttctgcacttaaaaaattaaaaccaattattatataaattatggtaaaatgtatacgaattataaaattgcggcttgattaaaagcaataaaactgcttagagtaccagcctgagggctaaggcaatttccaacataggacagctagagcacgggatactgtgatatgaatccagctaattaaatttctcccagtaaaataggtctttcccaccgtgcactaggctccctgtctgatacaagattcctccttggtatcgtgtatcccgcatcctagccgaagcaattgtggtagcttccacgcatatgtgacacgcagttgtgctcactgactcctctcgtggatcacatcaacagtaggaaaaggaggaagtgtgtcgaggggaggaacgggggacaagagaggagccagaggtaaatggctcacccaccggccaggcgggtgacaacctacgctctctcctcatggtatgacacctgatatatatgggtatcggatggtacctgggtaccaagcctgataccacgagatatcatggacgctctctcctcatggcatgacacctgatacatatgggtatcggatggtacctgggtaccaagcctgataccacgagatatcatggatgatacccgaggtattaggcttgatacttggtatcagttgcagatgtgtacctgcagacaacacagacgagcagtgaagagctagctaggagcacgacgcgacaacctcgagaccttgtcgctggtgccctgggcctcgtcccctcatctttgcatcttcccttttctccctccccagcgatcacaatgccgaccttgttgtcgtagttgccttcgtctttgctgacctcaccgattccgacggtctcatgatctcaccggtctccacactctcactgatgccctccaatctagtttaggaagggcgacaacgccgattagttctctggcaactggagatgggatcgcaggacgggagggaggacgacgacgacgactatggggcagaggagtcgaggaagggagggaggaggaggactgtgactggctcagagaaagtgggggagggggggagaaaatggatcttgaaaacaattgggttgtatatttggcccgtagcctgcaagagacattggttcggagtttttcactttccaatactagtatattggtttctttgaagatgggtatcgatatgggttacaaggtcatgttctttatacacgactacagtttttgtccctagatttgctcgaggatctgaaccgtctattctaacctgacggatcctatggctccgaaagaacagccatgttgggtcacctggacggctagatcttgagattgaccggacctcaatagcctgacttgaaacacaattacccagagataagggaagtttctaaaaatattgatgaggtggcaagctaatctttcaccgatcctacggtgtttagggagatctatattataggcatttatatggatggtttaaacattagatagtataattatccacgatagtttagaataagatatccaagcaatatcgatgtaaaaagtttttaaagaagttatagttgaagaaccgtggtatacataattcataacttcgtaaactaaaaaaaaaagacatgatctaaatggtttttgactcttaaatacgggatatgcacgaacttgatacaagtactacgtactactatattagctttaatccgctgaagaattatgtttatataagggacctatatgtacatgtatgaggaccaagataattacatgtttgctcgaaggatgtttctcgtaaatgatcacgactgatgcaaagttcaacaaagaaaaagaaaagaaaaggagtattgaaaccaccaatcactagtgaggaggcaagtcaaagataagcactactgagcaattagaaacagctaggagtatgttggaaaacatgagccacattattatcatccttgacgacaaaaatgaacaaaaacaaaaaaaaaagagattaaataccactctccccgtccagcttgcttttgcctgatgggcagggagatcgtcgattttccagtagctcccatccatcctgctcacgggttggatttggctactgctgtggataacgtttcttgtgatccttagctttgctttgtcgtttgacatctacatcacttttcattaatatggtttattatatgctagtagtagctttcttgcctacgtaattgacgctctctctcggtccacggcacggtgcgtacgtgttttgtcgccattgagaaatcggcgacgtttgggccgtgcgcccgtggcgttttcaagcctaataatcagtgaggtgttgaagtttcgttcaaaaaaataagtgaagtgttgaagaaactggcaatggcaactctccgtatctcgtgcggctactacttgaccagtgctattttggctgtatgagatatcctggtactatgataccgtatgaatctaccaaacagtgagatctatcgagataaatctcttatattttaagatggataaagtatataccactggatctttcaaaaatcatatgctactgatataccctctccatctcaaaatacaacaaactttagaaaatagtatatactaagaagaaaggtaaaaggacatagtaaaaaagaaaacatttttaccttctcaaagatgagtaaggtgtatgccagtagtttattggcaaatattacctcccacgttattatatttaaaataaaatttaaactctataacttgctatattttttatatgttgagatgaaagtagtatgcatgtatgatctactccctccgttccaaaatataatattttttttggtatctaagtaaaatttgctatattttaggatgaagggtgtatactgtatcgttatcatcccaagactgcctcgcttacacgatgggctacgcttttgtctctttcgtcgtgcttctactaataaaagataaacaatttaagaagataaaagatcatgctactttcaaagatgtgacacgtgattggtttgtgattttgtacacgctcagcaattaaactgtttgtgcattgataaatctattttatttaaattaccttgttccggatggaggtactataggcttcctaggtgccatgctatggatctatggtcaccaactcacaaaggacttctcttttgccccctactgactgctgcataagattttttttcccaactgaaatgaaagtgacatcagacaacaaaatcatcaactggatggagaaactatcaatcccggcaaagtaacagttggagaccgatagtaagtaaacttttcaccgcaaaacatgtaataaaacaggcaacatgttgcagacaccattgtccaaaaaatgaaatgcaaattgattacgtacctcaaatagacttggatagttctggtccgtgtttgtgaagtgcagaagagtagaccgaaccatatggtctattaattaattcaacacgctcaataataacttcaacttgattgcccacattcttctataatctacggagttgatggctacacttccaaggtgagatatcactaagtttcaacctagacattcttcacgacaaaacttgtacatcataatggaccaactgtcttgcaaagttgaaacagacctacgtttgatgatgcctttcagatgtaccgggtgaagttcttttgagcaaaggattgaccaaaaacggccactgctagaatatcttgctgataggcttcaactctgtaggtaaatgatcatagttgcccgaatcaacctctgcctggaacatgggccgcttcccgtactctcgcaaaacacctggtgccaagtgctccttgcttggtgttagcattacatagtttggatcagccctttggtaactgcattttgttaagaacaacgaacaaagtgtactcgattaatagccaatgcaccgtttctaataactagaatagatgaacataaatctcgaacagacataatacaaatacaagaaacaaataatagacccttggctgtctaagatcctcaacacgaattccaaatccatatgatcttgtccccttcaaatgatcgttcacagctgcaagcgcaaattgatgtcaatgcagtcagtgaacaactaaggctgagttatttccccaaggttccccaactcccctctctcgttttccacgcgcacgcttttcaaactgttaaacagtgcattttttgcaaaaagtttatatatgaaagttgctttaaaaaaatcaaattaatccatttttgaaaaaaaaaatgctaatactcaattaatcacgcgttaatggaccgccgttttccgtgcgtgagagaagtgttcccaaccggaactagcgaacacaccctaaatgtccttttaaaacaaattattgatagtttggagcaatctcactagtaactttctccatgttctatgggttcaattattctacttcaccagaatacaaatttaacaatggaccaagcactgcagaatcagttggtctcaataatcaatatttgacttttttttccatagggaaaaagtggatacatcctttttccagatataatagctggcctagttttgttatttgtatgcagaagtatttgcaaggtacacacctgtgacactaaatgtgaaggatggtctccaccatgacttgaatgccaaagctacagaagacttggaaggacctagctttccctattaagaagaagagagcaatcaatattaaaaacaagtaaagtaatgttgtatcctaaactctaaagatacgggcactgcatatgctcaatgtgttcccatcttttcttgcatcatattcatattcacaatgattgcttctacaaggcgcaaaataatccaacataaaatggcaaaattccatccatggagcaacgtacagaaaagggcaaaactattctgtaggttgggttgaattcttgcactaggtagaacccctcatggcctcatcgtcctatttaatacatctccatagtttcttaaatcattaagatgggatatgcaaattgtatggtacaaggtgtgcatgctatggttgtacatcctctctaaaagactagagacctaattgatgaaaatgaatggatctacttaactttgaataggaagttctgatgaactacttgcagtcgaactagaggcaaattcaatggccgtg

SEQ ID NO: 3803 - DNA, 791 bp, Oryza sativa
  unsure (1)..(791): unsure at all n locations
agcgttcattggattaccagctggtacaggtggttcatcaggccgcctctacctaccctctatgggggggaaccccactccacttttttgggcttcaaactgtgtcttctcccggaagctaagcaatagccgtttcttgagcagaattcggcgtcgtcccccgtctgacacgggggacagccctgtcattccctcataaatgaacggtgacatgcaacagcccttcctcaagtgacgcccggatgtgacgggtcatacccacccccactccgccggggacaagggcgacgtgaggacacgactgccctatccatcggatgtgacggagacgggccgatcacagaccggtcacatccgatggacaggggttagctaggcgcgccgcacgtctgccctgaccgcattaaatgcggtgagggacagttggggcgttgcacatttatggctgttcagcctgcactccccttttgctctctccctctgccgcgtggcggccgggtgagggcctcggggcgaagccgtgagagagcccgagggggtgacgtcatgccctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3804 - DNA, 10289 bp, Oryza sativa
  unsure (1)..(10289): unsure at all n locations
ncgatgtcatgagttcgnacttcatcatacccatcgatttttatttaattaggtgtaccattattttagatcaataaatctatttaaaaacaaaactaccttgatctatatatattaaaaaaaacaaaaactcccactgtcccagctgcctaaatgcggcgtacacatgtatgtatgctccctccgttactatatcgctctcctctttctgtcctcgtaataattgaaattaaaattactttcacggggaaaaaaacccacatgtagacctcgacctagctaataagtccagccagctttccctctatccctttatccattaatatttatagtctattaaacaacatacaaatatttctaaaccactacgtggaactacggaattaaaaaaaaaatttgaccatcggtttctaattgatttgataggcacattattttaggtcgttagatctatcatttttcttaaaaaaagcatcccaaacctccatccccagtaaacatcctataagcatttctaaatagatacgtgtactctaaaattagataaaatcttaatattcaaacattttaccaggacaaataaaattgaaatatctaaagttttatatagaatctatcaaaaaattggactttttggtaaatttttttggtacgatatccttctggggagacgaaatacccaaaattttctcattagaatcacatatattattttaacacagtattttctcataaattgaaaattgcacggtttcaaataattttagtatagaatttatatgctgcaatggtaataattagaaaaaaaaatcataaccaacgttcaaaacacatcaaataagtttaattttagtttaggatatagtaaaagaatatttaaattaacagtcactctaacatgaacattcataataaaacttcacgcacattaaataagatgcccacgtatatatgcgggctaccttcgtactttatagaaaaaatttacaatacctaaaatgccaaattagtttatgtaatatagaattcaatatattttgttaatttgtttgttttctattggaaatgctactatattttttttataaaattagtttagacttaaataagtttgataaaagaaatcaaaacgacatgtaatatgaataaggagtgcaaatctatcatgattttagaccttgtacgaccttgggatgcgacggttgttcttcgtggggatagcaccgctgggatgttgcccgttgatacgggagctgaaccccaccaaggaatgtgatgctcaggccaactacatggcaactcggttaaacgatgcggcggtcgtgctcctccgcgacatgagcgagacgcatccggacttcacctactccttcttcgacacatacaccgcggtgctccagtccattcgttacccagaggcacatggtacgtatgtactccttccattttaaaagtatagcaaacctactatactccctcttccactttttaatatataacatcattgttttttaacgtgatatttgatcattcgtcttatttaaaaaatataaatattatttattttgttttgacttattttatcataaaagaaattataattcgaacttatcctttcacatatttatactaaaattttaaataggttgaatgatcaaatgttacgtgaaaaagtgaattgtgtcatatattaaagaaaaaggaggtagtacatatattagacggcaccggggtagtactataaatctatacaggaattagattactatatatattaaggtgaagagaatatggtttattaggattaagattctccacatttgtcactttattcagtgattttgtttttttaataggctataaggaggttaaagcagcgtgctgtggcctaggagataacaacgccatgttcctatgctcgccggcgagcgtgtactgcgacaaccggacgagctacatgttctgggacgtcgtccatcccacgcaggccgcggttgagaagcttatgaagattgcgtttgatggatctgcgccgttggtttccccgaaaaatatcaagcagctcactgagagttaggcattatataaagccaagagtacgtgtctactggtactactatactatactactattatcaccactggagaaattttgaatcattaatttaggagttatatttagtgccagtaactaacgtggtaaagtaaacaagggatttgctagatttgaggtgactgatattaatttgtaaatttacagtctcctaaaattacacattttgcaaagtttaaaattgcatagctatacaatgtgaaactttacttattttaactatgatttttgttgttatatatatccatggtttcactttatttttctccatgtttgatttttttcatttaattatgtattgtgtataagctataagtttatttcattcaattttgtaggttagaataatttattgtacaaccttttgcctaaagaaagaacgtcattgtaataaaaaaacaataggatgatcacaatcattagattatcgtacgatggaggagaaaagtcaccaaaccttttaaaaatttgaggtaccggaaatccacaaacttttaaatatgtggtctagatcagagtacttgataagaccattggaaaagagtagagtacatcactagtttctaaggcttcgttcgtatgtgcgagtcctgatccggttcatgttccgtgcactggaagcgtggtcccgcacacagtaccaaaacgacggcttgtgaggcgacgttaacggcgttaacggatgtgagaagttgcctttgcgcctcggcttttccgtcggagttagggcatccaatgctctcgatccctctttcttcctcctctcgctgttgctctcttgcttccgcggtcgtcgatgcgacgcaggcctggaggagaatcgattcccctccgctgtaggctcccgtcctccccgattctcgccagccaccctcctcccctttcgactgtggcttgcaggcccgtgcccccccccaatcgattctcgtccgcgcgtcgtcttgcggcagcggtcggttcaaggtgctcaaaatcggggggaagtggaagagccccacgcctgtcgagctgtctgcgtcgtcctcgaggggagaaaaagctggccggcgtgctcgctgtgaagcagcaagcatcggcgcccatcaggccgcccatctttggcagtctggctgcctgtgtgctcgtcctctcggcctctcaggtcagacagtgctggcttgaagagtctcatcaaggcatccaagctggcggagttgaggagccagctctatttcaggacgagcgtgtgcgtggtccgatggagacgagagtgaagaagcggaagcaagagcgggatctattgtcgatccaagaggaggggacgattgttcaatcccctcaaacaggggagatctctgtccgcggcgccgatctagagtccggcgaggactcctccgactctgtcacctccgacgctggcagcgccaaggctgctcccgacgacgtgcttcatatcgcgcatgccctctacaaggtttgcgccaagtctcctagagccgtcatcgactttgttcgaagagtgagccctgccaccgtcggccgttcgattgattgggacgtcgtccgtgaggaagagtcatcgaaggtattggtttgtattaatttgttcatttccgattcaattttgtttgacttgcacgtagtagatgggcgatggccgtagccggtggaccgatatggaggttcgtgtgtttcttgagagctgcttggaggagatggcagcgttcaccatcacctccaactcccccaagccgcaggcatggcagaacctaatacacaagatgtacaccaagtgtaagaagaaggtgaacaaggctcaattggagtacatttgggggcagtgtaagaagcggtacaacaggtgggtgtggctagaatcacatgcaagcgggctgggtcgtgatccccatacatcagccattgttgccgatgatgagtggtaggaaagcaaaaatgcggtacgtacacttgacaataaatattttgaaccaacaatttttcctacaagaggtattatctgaaatttagtacatgcatgcagttataaatacagttttgtgaggtgtaataatttttttgttcaagttgtgtgtgccaacaaatgactagctgcagtaaaatggaaggattgtgctcacatatgtttcatagttgttactgtcatgtcgtttttagtaatgtgtgccattcccttgtatttaagttaacaaaatgatgtttacactatttaccatgaactgattggcaatgattgcgagaagtaaatgatcttgtacatgtgacattcaaaagcattttaacagattcacatgtgtttaattgtgaaggatatagcttacacaatgtagcattctattagcttatgcaatgtagcagtcaatgtaacatggtaatgctcataggttttgttctctgcataaacaaaatctatatgcagtgtatcagtaaattaggaaagatcttgtacaagtcatttaggaacatgttaatacatattcaactagctgtacacaccttctttctgatgtatatagagagaatgaacaaaaatgtgctcatctacaaagaatataacatatgcagtttatcttatgtttacaatgttcaaactatctttctttcattctgtcagatgtgtggcccattgtaacatgtactcctgattatatttgataacttggtaccaatgtgcacatttactgccagcattttagtagtaatgcacattggactgcacatattcattacgttcaatgtttgcacaagcctaatgcacttgccttgtactaacttgtttttactgtctacttatgttgcagcaaaataaaggtgtcttaagcttcaggaatgatcctctgaagcacattgaccttcaccacgcggtattcagtgggcgcacagttgtcggaaaccactccgccgtcgcaggggcagccccagccgcaccgcaaggagcagttcagtggcagaccatcgacatggcgcagctcgctgctgcttatagaccaccacctccaactccacccccaacggcagcagaccggggcaagggaaagaggccagcagcaaacactcctgcctcagggagttcttccaagaagtcccgnnnnnnnnnnnnnnnnnnnnnnnnnnngaggattgcggacatccgagagcagagctaccagagtcatgctgcttagatggaagcagagaagtctatgggccttgatgcgtgcatggagttggtggaaaatgatggccatgaaattggaggaagtgtgtggtatgctgcttgtgcgctattccgtgacccattgacctgcaaatgctttgttcaactcaaggacgcctctaggcgcttggaatttatacgcactggtggtactggacagtcatctggtggcaccaaactgtactttactttgagttgtgatgtgcgatgttttccaaataaactagtatttatgtttagaactctgtgtgctaacaatttttacattctgtgagtccctaaacatttgcggctttatatccaattcgagcaactacgtattccattgcattgcttttatatccaaataattcttcgattgcatagatcactgccattattaatttctatccttttgattatgacaaacattgcgtattctccggttctcatatgttaaaggaaatcggcgatgagttacggcgcgggtggatcgagttggaatggaggcggtcacacaagcagcaaagaagaagatgccatcattgagtacgtggctgctacccttgatttcaatgagagggcaccaaggagaataccggtgcaaaccggtatcagttggatgatggacacgatggcaaatcgaagccaatgcagggcaatgttcaggcttactgcggaggagatacacaatttgcatgatctattggtcacttcttttggtcttgtaggaacagcaggggtctgttccatggaaaagcttggtattttcttgtacacgatgggtggaaatcgtccaatcagagacgggaacaatcggtgggtccgctccaactcgacagtgtcggttcacttccaccatgttttgcaggctatgaatgatctcgctgggaaaatattgaaaccggttgatcccaacttcttagattacaaccctcagattctgcaagagaatcctttcaagcctttctaccaatcagtgggagctgtggatggcacacatattccagttctgcctaatgcagctagcgctatgcaacacaggaaccgtcaccacataacaaccagaaatgttctagtaatatgtgatcatgatgggagaattattttctgtgatgctggctggcctggatcagttcacgaccaaaggattctcaatgaggcagtgcaggcttacccctacgatttcccacgggtaccgttaggtgagttgtatcagtcaatacacttttttttattgccaaatgtcttgattttatttaattctacacatgtgcactaatatttaattctgcgccgttaaccaggcaggtacctacttgtcgactccggatttcctaccaggatgggattccttgcaccgtacccacatgtacggtaccacagggatcaacttgcggtcgagggagccccaccacccgtaggacgggaagagactttcaaccatcgacactccacgttgcgagggatcgtggaaagacaatttgtcatcgcaaaaaagatgtggaaaatattgaaagaaatcccttattaccgagatgaggacatccctgcacgcatcattcatgcagctttcgctctacacaactttaggttggatagtaaagatccgacctatcggttcactaatgctctctacaacggcaatccagtgccgctgctgaacgattcattcgaccatatgtattacgcaacaaatagcgaggccgctatgagcatgttgcgtgactgtattgctgatgatgcgtacaataactaccattaggtaggtgatgttacccataatgcttgtcgtatgttcagtacttcaattttcaagattgtatggtttaccatttatttttataacgttaacaacaaatttgatgcaccgaatcttgtgttatttgtttcacaattcatttttttcttaattcttgcgttattatttcagacaaaaaattaatcaatgttattgcaaaatttatgtccgaatcttcacatattatgaaaattattatggtaagaaatactgcgtcattacgaaatggttttctgctactgcatagcacaattgcgaaattcaatctacatacaatctattatttcaaacgaaactacatgaaattgaatccatatgaaattactactgtaatgcaattcccatttcttctcaattttttcaaatcggggtgtgttttcttgtgtgcatctaccaattcctcccacgcatttacaccccctgcagcgcatccggcggcaacggcagccattgtcacgcccagaaattcccgaatagaattccaagcagaatgtgcattaaaacccccgtcgaggactggccggggtacacaaacgacaatgttgacatacagatccatgtcttacaaacattataaaagtcttacataaatgcagcggaaaaacaaaagataactggagctaatccttgacttgaactacagcgggaacaccactccacaggtatcctcgacggcacggacgaagcctactcctcagagaacccgccatcggatacatactcgagctctgggattgggggaaaatagagcaaggctgagtactatccactgtactcagcaagtcataccggaatgggggggtatgatgcagggattcaacaagggatagctaaacaggttcatttgcataaatactggcatttataaacaggaattgaatgcgaaaacagttgtaataattaagcagaattaatcgtccactatccaacgttacaccacgttgcaacaggcccaatcatccacctataccatccaatttcattagactaaactaaggtgagtctaatcacggtgagtctggttgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggacccttcgcataaccccctctagccaagcacaccacacctcaggtttcacccccgttcccagcgggcaactggcagtcccctctcgtgcctaggtgaatccgaaagcgacagaggccgtcgcagggcccgccctgctccatcacgcccacccttgcctggatgcgtcagctagagaaaagctacactacaagcccagccgttgcccacgctggcttgtggtaagcacgataaattcttccagggtttcccgcgaaccggtccttaattgctatgggcgcgactagcaaaaccttgcacccacagcccaccatgtgattcattttatttaaccaacaccagagcggtggtactaatccaacattatcatataaacctatagtctaggttttaaatgagttttccccattgtgtgctagttgaactaagcatggctaagcaattcctagtccaaagtctaatcatgttataacccaagctaacaaaggagcatggtatccaaaaagcatagctgtaacaataggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacaatgcaaacaggctataagactactgaaacagagaacaaaaccatttttaatggattctacacatttttcttgatttactgagacttgaatgggcttaaacggagctcggatgaattagttatgaattttagaagattcaatgtgtttattactataacaaaaatccttaaataatttattgcgcaatattttccagggctgacgtcagcacgggggaggcgcggcgccgacaggcgggccccactggtcagcgactcaaggggggcggttcaccgtggaccgggaccacgcgggtggtccaccgccggtccacgggaccgacggcccagatcgccctcggggccgatcggacgggcggcgatagaggcggccgccgggctcggctcggcatcaaagccgaccggccagccagggctagcggcgacggcacgcggccgacggcggcggcgaccggcggcacgggaggcggcggcggcggccgaaggcgacggcgcgcgacttgaagcggcggcgcgacactaggggggaggaaggggaaaagaggggagggatgcctcaccgagggtggccggcgcggaggaagacgacggcgaacggcgacgacgagccacgggaggacgacggcaaccgacggacgggattcggggtgccctaaggaaggagaagagagagattagagggagggagatgaaccacggcgaccggcattcatggccgaaggcggcggtaaaggttgaactcaccggagcgcgaggggatgcgaattccggtgatgaatcccgacgtggaaggggcggccggggtgaagcttagcctcgcgaacccgacggcggcgacggcgcggtgcggcggcgaccctagtggcggctagcggcggccggagtggcggaaacggcggcggcgggtggttgcacggcgcgggagcgatggggagcacgagggagttcggcgagatggggaaaaagcgagagggggcgacagggaagcttaaataggggaggggagtcccggacgtggccggtagggcgagattttgccggccaacgtggggagtgggggaggagagagaggcgggattcgaaaatcgaatcccggccatctcgggcgcgggtgcgagcgcgagagagggggaagtgggtgcgggagatgcggcgcactcgcgggtgtggccaacgcggcccggagaaggcggaggcgtggacgcggcggcggttgcgggcgcggcgacgccggctggaggaaggagacgggcccgacaggtggggcccacctgtcggcgttagtgngcttccacntgattgtccaactcggggacag

SEQ ID NO: 3805 - DNA, 1217 bp, Oryza sativa
  unsure (1)..(1217): unsure at all n locations
agcgggcagtgatagtggactaccgcagtaggccatcatggngtatgtggaactcgtactaatgtgtttcgatgttgatcactgcttgcagtatgtgctaatgtgcatcaaattttcttctactatattcgatgcatcttgttatgtggctggttcatgtaatgcattactgatttttcacatgccattgattattggtgtgcacagagttacttggatatgtttctgactatatgttattcgcaggattgccggtcagatgcccaaagcttttgacatcctacaagatgttgcgcaacacactctgtctaatttgcatgatatccagaagagcttaatattttggcagtccaaagcagaggtataaagttgattcataaaaattgaagtgcttctacacttttaatatgtagagaagtccactacttactcatcttccgttgtcctatgctattttctccagggaacaagttcacagaaactgtattttatgatctttgaaagaggtccaagggcctttgtcgaagcagcatggcaaacactgactagactcaagagcaatgggagtccagtcccgcaccttttgcactctgcttctgatatggtctcaacaaaacttgctgtcctgacaagtatgcaacactgcttggctgcttttcttgctgaggtttgtttaatcaaatgcgattatcaatatcaaatgctgatgtcaagtagaataaattgttctttacaatagtttcaatatcaactttgaagcagctcccctatcaactggtgtactatggtgtccaaattattcaagctcttctttttaatactttggataaatttacttatagaacatggctactgtttctcatacatgaattcgaattctaccttgcctcttctataggtttactttgaagttgataagtgcagaaaaggactaacagaaagttcagataaatcgctacatactctattcattggtctgaattctgtcttctccaaattggaggtatcatttagaaatgctgttgaggtatgcaatgttctttttgcatgttttggatgttacaagtatgacatgctagctatttcacatagtttcatttcttcagggacaaactctattatgcacacatgatgggaagtcgcctgaacttatctttgaaagattgccagaagtgatgttgagaagtcagaagtgacagaagtgttatagcaaatgg

SEQ ID NO: 3806 - DNA, 823 bp, Oryza sativa
  unsure (1)..(823): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccctaattgtgaagcatgcaagaaaatcgttggaaaatggtaatcctcctaagatgtttgaggtgttatattgtcaatgttctgcaagctagtaagagtcaagatggccgagttggtctaaggcgccagtttcaggtactggtccgaaagggcatgggttcgaatcccattcttgacaatttattttttatttttacatccagagtttaactgccattctgataatttgtttttttgggtttatacggagttttaagtggtgtaaggtatttctgccaacatcggtggacaaccttattaacacacacaatttcggttcacttttgttgacaaattattagatccctttttcatgaatttagtgaggaatgttcttcccttttaatttggaaattttatctaagcatagaactagccaataatatgcaaacatttccctcttgcagcgatctggacaaccttataagcacacaatttcggttcactttgttggcaaattatnnnnnnnnnnnnnnnnnncgaactcgaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntn

SEQ ID NO: 3807 - DNA, 21146 bp, Oryza sativa
  unsure (1)..(21146): unsure at all n locations
atgattccattcgcctctcactggtacagtcgttcatcatatttgtactactaccactattagcagtaatagaaatgtggaggggtatattgtaacaaaaaatgtataaaagggtataatcatcattagcagtaactaaactttttccctcttttttggctttttcgatgaaatatatttagccgggaaaaaacatatataaatgacaaagtaaatcataattattggattagtaaattactattttacctataataatatactggtagtataatattataggtagagagcaccgaaacatcactcaattttctttatttcgaccctagtattaagttgtagtactaccaggtttgtgagattagacacccctgctcctcctgaagcaaaattgacacccttcagatatacggagctgttcattggtttgctgcttatagagaggtatggaggagggctgggcaccccgagactgatagctgcaatgtggaaaaaaggttaaaaaaaaagacaacaaaaagagatatatatatatatatataaacacacacacaccaacgaaatttttttttgagtagagataaagcaaaaataatgtcaagtttcaaaagatctatctatcttctattttattttatatactaaaagtccatgaaacttcctacaaacgctctcaagctgccacgtggtgcttctaaaaacgctccaaagtcgccacgtggcgtattgataaatcctaaaaattctaagtaaaaaacaaaacatctaaccgttgattttcttttaatcgggtagacccattattttcaaccattagatctattttacaaaattaccaaatcaaccaccgttagatctatcttgcgagtacaaaattaccaaatcaatttatctctcttaaattatccctcggtccgtgtacctgtacagcatgtacgtttgtacgtacgtatcatcccaccctacttctttttctatttttttcttttttatttagattagatgaaaaacgaaaataaataattcaagtccattcacaaccattgattttccataaaacatggtggactaattagatttttgttattaaacaattgaaaggcccacgtgtgccacgtcctcccttccatcatgtacatgcgtacttagtacatacatgtatatatcggtccctctacccattcggttccctctctctatgatgtattattagccatcaaatcgtattcacaatggttgtgtagagcctcacacattatatataaaacgttcccaaatgaattatctatcacataatgcaaatatattggagtatacaaacccatcaatttaccatagccttatgtcccatataatccatttattaataaataatgaaaatctataccaatcttacttgcttattgataatttttttttaaaaaaagttgacacatagggtgtaatgatgtcactatttgtcatatcatacatttgaacttaaaataatatttgtataaaataaaacaaaagtgtaaaatgaaccaattctagaaaaccttataatttcttagaaccattgtggttcataactttcccttaaattgagataaccatgcataaccacttcatcatttttaagtgactacatatcaatagacttctctctgttctatgccatagcagaagatagttggctttgaatattatatttcttactattaaatttgggttttaacactcgggttgactaaatgtatttaaacaaatatatagatcacacatattataggaagcgaggtctagaatatatctactctatatttttattgattcatacataagtacgtataaaaaattgcatcaattgtgaaccaattaaaagaaggaataaaacacatttattataaataacctttttgagaattttttttaaataagagcccaaaacatttaattaaaaataaaaacaacaccttactttaatttggattaagacctacgtcttcttaaatgataaagatgattaactttatagataggtgcttatatagatgaatcaaatttacatattgtaaactaacaaatatcttaaaagaaacatttaagcaatgattcatgaatgcccgcgcgaatgcgcgagctaccatcctagttgtgagaataacaatcagtcagtgctggatcggacctgccaacatgttcatattggcgtacaaattaaacggagggggctcagatctggttttcccaaacctcgagctctctactatttgattcaaacaattcgtccggaagattccattaattttagacttaagttccagtatatatgcaaccccatgtccggaagtttcattttaatttcataaactcgaactctctgtcattaaataattcctactaagctggattttctgatctaagcgttgcacaagcgctttcccttttgggttgcctctgcagcttaggagggtgcctgcgaaaatcccattttactgtttgtatatttcaatattatatactccctccgtattttaattttaatgtatgacgccattgactttttaactaacgtttgaccattcgtcttattcaaatttgttatgcaaatacaaaaatacttatgttaggcttaaagaacatttgatgataaatcaagtcacaataaaataaatgataattacataatttttttgaattagacgaaaggtcaaacgtttgttaaaaagttaacggtgtcatacattaaaatacagagggagtaacacttttaatacaatacataaatatcggtaaaacacatatgcatatgcacatgaatacatttggtgataactgaaaaactaaaaaaaaaaaaaccatactctcgtcaacataggggctgattgaaacgctagctactgcagtgctaggctgtggccgtttttagttgctgtcgcctgcacgctgctgtaatagcaagcactaccgaaaacacctattgtgttaggtgaccattgcttattcatggaataagccaaacggcatatttaaaaacgaaaagtaatttatgaataaaacttttatatacgtattcttatcgatttaaaagcaaagtctagcaaataaactttgatgaaaaacctcaaaatcaacttcaaatttaagattgaaaatttaaattttagctgataagtataagtataaacgaaaagatgaggcacttagatttgcaatcatgcttaaacattctaggacgacacatatcctccacgtagggtgcgagcgtccatagcacatgaaaacagtttgacataaaaatacgctgtggacaatggccgtacgtacgtgtacgcagcgatcgatcgatgatgatggatatatactcaccgattaaatcgacgaagttgtagccattgctgaacctgccggtgggctttccccccgggtagtcgatgccattgtgagggaagttggccttgagcagcgagtgcagcaggtagttgttgttccctacgtctgcctgcgagtctccgagcacgtagatcgccgggacagcgccgcgcgcgcacgttaggcagcaagcagccaaacacaggaggacgacgacgacgcagacgccgccggaggacaatgtgcaagaacccatcgtcgctcgctcgctccttcgttcacagcgggtgtgcatgcatgtgtatgctgaagctaagctactagctagcctgccctattgaagctatactacacatagttaatttttcctctgattcccctttactttcggcatgttatttaatttagaacttccctattttgtttggctctagccaagcaagcgctctgcgcggtggcgaagttaatcgattagcggtggcgaagttttacggtgcctaaccatgcatggtttgcttaagagcaagggtcttcgtagttttcttaagagcaggtacattagtcaggcgacactaagtccacgtagatagcaatggtgatatagggaaaagagctaaagagagagaacatgcatgagctggcgcgagcggacgacaattttatcatcgggctgcaacacgcatctctagataaaaacgttggacgtgagagagtgagagaaatgctgctatgcaaaaattgcaacataggatcgatgctgcaattttttaatagtgatgtgaagcatataggacccaacaatacaactagatgttgcgtgtacaagctgcaaagtaagttatagatgagttggacataattggagctaaattaccttattattgatcatgctctaagaattatagatcttgcgaaagtagtacatacatgcaggcactgacacaagagatcatttataatgatcataccgtatgctcagggcgttcacagtgtgccagaagaatttggcctgcctcacgtgccatgggctaaaaccacaccttaaaaaaaattgtctcccacaatgcatgggtctctatgtgtggcttcgtttttttgttttagcccctcatattttctattttagccctttctatttctctattaacaagatggcacctctcccttccctctccatcaccggttcttctcccctccctccctgttgacgacacctctccctcccctccccatcgccgacacctgtggcgatgagtagatcggggtgaccgccgaccagatcggggtagtggcgtagtgcacgggctacgaggtccccacggtggcttgggcctacgccgctgctgagcttcgcccctcggaatccggcggcggctcgtgccgacgaggcctgcaaggctatgtgcctctcctccatcttttgtcttctcttctttctccggttagcggcggctggaaaggtaggcccctcttcccccatctcgctgttgctgccccttttgttctcttaccggagttgggtgaggtacccgcggtggcttgtgggagtgggggtgtgccgtgtgggggccggacagcatcgcaggtccaatgcagactctatcccgtcgctccgcccatcacgcggcctcacctaacacgaggttcgcgcgtcatagtttggtagcacgttcctcgcaggagcgcagcagtggcgagaacgtggcagtccaaatctctgttggcgtctcgagggctgaacgtcacggtgatgcagtgtgaacgccctcacccggggaataatagtgccttgctatttttatagcaaccgcctggatgtctatgggtgagctagagtgttggtgcatccgaatacaccaaaaagtttacagcctagttatttcacattcgacaaaaaaaattggtaaaaatcgtatcaaattttcagccaccgaatgggctatacgatctatgcatgttgtattgggtaaaaatcagaggacattgcgcgaggtgagggtcaaactgacaaccgcaggcagcccccactaagccagcacaacttttgaattttttagggacgtaagtacatgcgaattatattataattacaccataattatatatatatatatttatcgtagttatatttgatatatttttagagggatttttgcgttgaatgttagatcgattatcccaaaaatatcagctatcaaaatatatttttgactcaatatatatattactaataaacgtactataattaactagctaatgaatggccttgagatatacactcaccgagtaagtcgacgaagttgtagccattgctgaacctgccggtgggcttgccccccgggtagtcgacgccattgtgagggtagttggccttgagcagcgacgccggcaggtagttgttgttccctacgtccgcctgcgagtcgcccagcacgtacagcgcctcgactgcgccgcgcgcgcacgtagttaggcagcaagccaaagccatcaggagggccacgcatgactgtttcagtgcgcaccaggaggaagaagaagaagcagccatggccatggctagctagttcacagcgtcagcgtcacggacccacgtactccggtgttttgaatagtcgggtaagacatttagcgatgagtctgctcctatccagatatcgaaaaccctcggctcactcactgtcaccggaggagtggtgaaatgtgaatgaaactgagggcttacatttatagcctgttctaattggtacgcacgaagacgcgctagctagctgtccaaattacctatgccaacttaattataattggaggtgtagtgggctcgtattgatatcctggaaacatgcatgcatggatgctcctgagtcctgattaactgcagacattggcgtactgtcacgtactccctccgtttcaaaatatttgacactgttaactttttagcacatgtttgaccgttcgtcttattcaaaaatttttgtgaaatatgtaaacctatatgtgtacatgaaagtatatttaacaataaagcaaatgatatgaaaagaataaataattacttaaatttttttaataagacgaatggtcaaacacgtacttaaaaaaagtcaacggtgtcaaatattttgaaacgaagggagtaataaccagcacgtacatgcatgtcacgcgttctgatcattattatacgttgtacctaaagaagaaggtgcaacaaaattagactaagataatctttgcatcacatcagcagtactatgagcgagcaaatttaatacaaatggaaagtgctcggatcagcttatctgcacgactaatccggaaatgccctgttcccagcacatgtcgcgaatccatccgtgatccttttgctctcacgattttggaacaaaaaaactatttgtccgtttcacaatgtaagtcattttagttttttccatatttatattggtgctaatgaatctagatagatatatatgtctagattcatcaacatcaatataaatatggaaaatgttagaatgacttacattgtgaaacggagggagtaattaaggttccgaaaatgctatacgtccaaccgacgcgtacgaccagcgcacgactacgtcattggccgtccgccgtccgtaacttctgcaacgatcgctaattcaattgggcttgcgccgtgtatttcgccgttgagtcgtacgctggtcggacgtatagcagcgttgttaaggttcatacattgactttttgaaatgtgggctgttagctagctgtttgctaattataccacgcgtgccataataatacactcaatgatttaataaaattgtgctaattaagggcttaaggctcactgatgatctgcatcttaattactaagcagggccatgtgcgatatgttgactccgataagcattcggttactgagatcaccgccagatcgaggcatgcatgcatgcgatggcagctgatcatagagcatggccaaaattcggaagatggtcatgaagataatgtgttacaccctcgctaattagcttgatggaaacctagctaattagtgtttgccgtggaaattttctaagatactccctttattttaaattgatctatatatagttttttaggttattcctaaattatcattatatttatgtgcattcattaagcctattcgttggagtatttgtgcattaatattggagtaaatggacattgatacatgtatccatgcacacaagtatttataacccacatgcaatatcttgatttgctattgaatagaaaataatgggatggtgtatgcatcgagcttgtttttagagtaaatatagtatgagagagttattagtttttcttggttttggtgtacctatgaaatatgtagatcaatttagaatggagggagggagtaatgtgttacacactcgccgagcgaggattaattgatttgctaggtagttagacggcttgactgccatgttgtcagcttatttactaaatcattcaattaattagttgctcaaaaatacatttcccaaaaaaaacttattccattgtatagtaagaccacttatttcattattttattattttctaaaaatatctaatttatccctataatgaaatatgtaatccacagaaataatccagtcaccaatccattttaaatttatagacttcgatgtaacctatttcttagatcaactatgtacaagatagaaggctagaaacttttgagataatatagcttatcaaaaaaaaacagagagaaagctagcaataatactgtcgacgtttgatgtcgcggttctggtatttacatagtatgaggatcgttgttagtaggatatatgcgagactgaggtaaacgagacggagatagagatttttatataggttcgggtccctgaattatcaggtaataacccaacatcctgttggccgaaaccggtcgttgctctttattcaccataatcacaccagtacaatatttggggtagcctatctaactgttgtcgacatggcggtctgaagttctgactcgtagtcgacaacagggtagtcttccttctcgaatccgtgcccggcgagatcagagatagcgcttccgtctctcctgacagtatccagagacaccgtaggggactagtcgtgcttatccctgaagtcgatatccggcgtcttgtcttggcgtatgttggcttgtatgttgatcttgtgtcttgatctattattccgtagattgtggtgggtgttgattgaggtggtcgtcgattgtccgtgtcccctctcctcctagggggccttgtatttattcccataggtgttcccttgtccaagtagaactaggaaaagcaatatgtatataatccgagcagtccttgtcgtttccatgtagaacactggttgtctttccttatccggaactccctttatatccgaagtcagtttccgtataagacatggtatgtggtgggtcctgccgagatttagtcgactactattaggtatgtggtatccataaccatgacagtagcccccgacttcaatgcaaatgaacgaattcatattctcgaccgctgaccatggagtaactgttatcgagctcaagtgaccgttctcggtgagttcagagataacgttagacttcctttatcagcctcgtgcgggcacctaaagggtttgtcttgagtcaatctccgacgtcaaccaagaaagtacataacatacgactaagtctcccgtcttgctgtaatcgagaatttggattgaagtcaaaaagttttatctcggcgggtacaccatctctttattccgtattccttgtcgagatccagcaaccgttctcgagcgatcgagaaggcgtagagtctgcgacggagccttgtcaacatttgtcgtactcgccttagtcgatcttggtgtagaaccatagagacatggagttttccacaatgtcgaatagaattttccagaaatcaatactcagaaaagaatatcaaatagaaatagcccccgagcaaacgctcaaatggtgacatgttataatttgtatggaaaactaaaaatgaattaaatttaccgaccaatgttttatatatgagcgtcttctctcttaccgactttgatcagtcagtttgtagagtcatacactctccctagcccccagccttgtcgtcggagaatcgttctcggaggacaaggctcttggacccttgacctgccttggttgaacaagcactgatcctagcccccagctgtgaagttggaaaactcaatttccgattacacggcttggttaatacgcacggcgagaactcttatacgaccagatcttacttggtcttttgtctctacaggatccgacaaggccttatcggctctgggcgtccccagccgaagttcccttaggttcctcggaggccttgtcaagacggcgtaaagggacagtaggataggtttcaacactaggtgtcgtcgtggtaagggatctctgggtaaaacacttagcattattgtgtacctgatatcaacttttgttgaggtagaggtaataggagaatcgttacacctctggtcgaggaccaggtagtagccccaactcgaccacttgaagtaaaggtagtgggagaatcactacaccactggtcgaggaccaggtagtagtcgtatcttgaccacttaaagtggaagtagtgggagaaacgctacaccgctggtcgaggaccaggtagtagtcgtaaattgaccactagaagtaaatgtacgagatatcgctacgattaactggttgagaaccagtgagtaggtgtctctcgatcatttggagtcgtggtacgaggaccgctacgctgtcggtcgaagatcagtcgtagctgttcctcaaccatctgaagttaagatgcgagagattgctacgttttactagttcgagaaatagcgagcgagtagaattatctcttgaacaccaatggaagttgcggtgtgagagattgctacgtactggttcgagaaccagcgagcgagtagaattatctctcgaacaccaatggaagttgcggtgtgagagattgctacgtactggttcgagagccagcgagcgagtagaattatctctcgaacaccaatggaagtttccggtgcgagagattgctacgtactggttcgagagccagtgagcgagtagaattatctctcgaacaccaatggaagtttcggtgctagagattgctacgtactggttcgagaactagtgagcgagtagaattatctctcgaacaccaatggaagtttcggtgcgagagattgctacgtactggttcgagaactagtgagcaagtagaattatctctcgaacaccaatggaaattgcggtgcgagagattgctacgtactggttcgagagccagcgagcgagtagaattatctctcgaacaccaatggaagtttgcggtgcgagagattgctacgtactggttcgagaaccagtgagtgagtagaattatctctcgaacaccaatggaagtttcggtgcgagagattgctacgtattggttcgagaaccagggagcaagtagaattatctctcgaacaccaatgaaaattgtggtgcgagagattgctatgtactggttcgagagccagcgagtgagtagaattatctctcgaacaccaatgaaagtttgcggtgcgagagattgctacatactggttggagaaccagtgagcgagtagaattatctctcgaacaccaatggaagtttcggtgcgagagattgctacgtaatgattcgagaaccagggagcgagtagaattatatctcgaacaccaatgtaagttgcggtgcgagagattgctgtgtactggttcgagaaccagcgagcgagtagaattatctctcgaacaccaatggaagtgctagagttgttttattacatgtgtatctcatgtggccagcatgactcacatacccaacttataacatatctggatgtccgttcgcaatcatgtcaggtgatcaagccgacgacgttcgcgaggaattatccgttaacaaccttttctcgagtagtccagccatggccggtgctatgaggtaggtcgtcggtcttcgttggtaggttgggcgcgacaactccgcatttatcgagaatgctctcgatagtgggatgtactcgaccacaacctactcgagtgctcaattgttcctgaaaaatattttctagaaggcaagacatatagcagagaatatcgagtatgtacttaaaaaactgcatgggtcttctagtattatcaggatataacgagcagattaaatatcaatcattatgtaaaccgtaagtaagcatgatttatacataagaaaatagagcgagcccccagcgttaaaccgcagtcgatttaacatcggaaacactcgcacagcagatattgtataaaagacatgctgtaggtaaacataataaattatagatctgacaatatcgtatagattggaaaaagtaggtatgataaattggatataaattattgcgtacctttgtagatacatgccaaatgtatttacgaaattagtagattaatttaaaaaatcaatccactaattaccttgattagcgcgctgatatgttcctgtgtacttgggtaaagtttcgattcgtctctgagtacacgactgtgtatagagtcgctttgacttttccagcgtggcatgtatctggtgtccgtgtgcatgtaggaccaatacaggccgtatacgtacacgatacagatatttggatcaggcgcatatgaaatccaaccgacatacatggatgcatttgtctcggtagaaatcgatatcgcgcatagaggaagtcggccttcgtatgaatccaaggagtacagcgccgtgtagaccttagtctgaatcaaaccaacacgtctgtgcctgcgaggacatccgtcagcttccagaacagtcccatattggatcggtcaccaatgctgccagtatcgttcgtcctccacgacggcgataatttcgatctcgtcggaagacatactccggtcggatttgatcttccccacagtgaagtcgtcgagtagtttattgttggagaattcatctcttgaacccatctcttcaaaatcctgaagcaccaaaatcctcctacttggcgcgccactgtcgatgtttgatgtcgcagttctggtatttgcatagtatggggatcgttggtactaggatatacgcaagactgaggtaaaagagatagagatagagatttttatacaggttcgggcccctgaattgtcaggtaataaccctacaccctgttggccgaagccggtcgttgctctttatttaccataatcacaccagtacaatatttggggtagcctatctaactgttgtcgacatggctgtctaaagttctgactcgtagtcgacaacagggtagtcttcctcctcgaatccgtgcccggcgagatcagagatagcacttccgtctctcctgacagtatccggagacaccgtaggggactagccgtgcttatccctaaagtcgatatccggcgtcttgtcttggcgtatgttggcttgtatgttgatcttgtgtctagatctattgttccgtagattgtggtaggtgttgattgaggtggtcgtcgattgtccgtgtcccctctcctcctagggggccttgtatttatacccataggtgttcccttgtccaagtagaactaggaaaagcaatatggatacaatccgagtagtccttgtcgtttccatgtagaactctggttgtctttccttatccggaactccctccatatccgaagtcagtttccgtataagacgtggtatgtggtgggtcctgccgagatttagttgactactattaggtatgtggtatccataaccatgacaaatacactaagtgaggccagttgttctaaaaaaagtgaggccagttataggtatatttgttggcaactttttgtgccaagtcgacaagcatgatcgcaacacctaaacgccttgcggtgatatggagtcgccaaccacctcgatctagccaaagggccaaatcaagatggatttcgtagaaaaacagctaaaccggctaacggagccgatttagagatcaaaatcagcctctaggccgatttagatcgataagaggataactacccgtctcgtgggcaaaacgggacaaacctacaaagaagtgtcgcactctcgtagcgacggcggacgatttacggcgcaaaccgacaaagatggactaaactagggtaaaatagaaaaacatggtaaaagaacgattcaagtatattgtattcgggggttttacagtgaaccggccttgtcccttaaataagggttggtcttgccctctacaggcccttctccacgcccaactcgggatagaaaccaaaggaaacacgaaacatgccttctcgagcaatgaaacccgagacccgacgacaatagactctgactcggaccctgccggtctgaccgcccacatacttgaggtcagaccggccctactagccggtcagaccgcccacacacctgtgttctgaccgtccctgtgaaggaaacccgtcactttccaaactttggcaattttcccctatttcgtccataggtgccaaatttgggtgtaaacacgtgccccccgcctttttggtgatcatatgtgaacctaaacgcatagaatatgttgtctcagggtgataatccaattaccggccataggacttcctaatcatcttgtcaaatgctcgggaagtatttcttcaagtatttcccattaattgatctctgaaaacaccgtcttgaagtgtcttcatctcgttcaaagtcttcaaacgctcgtgatgacatcttcaaaaattgcttcccatcaaggtcgtataatcttcaaccgacaactcgtcttacttgaaataccgaagagagccaagatttacctcaactggcgaaacggcaatttcaacaatgttttattactcgacttggcttatccattagcctgagagtaagaacttaacaacttaatatcataagattgaccaatgaaatctaaagcccaacctccgaacggctatgatttgataataggattcaatacagcgataggcgctaattgaacattgccgatccgttaacaagcttcactccctctataacatttgaaacaatcatcaattactttcggccaatgaaaccccactctcctaagcaaccaatttatcttacgggccgattgatgaatttcacaaatcccttcatgtactactctcctagcaactttagattgatcattatccaagtaatactacatttatttttcggcgatataatatttgagcgcttgccgccgaatcttccgatcaatcccaagactaggatcattgaaatattctattcaaagtgattctccaatctatttcttacttatgggcacaaatgtccgaattcacaattaatccggtctttaaatcaattgtaacgtgccccccagctctctgcccaggatcggtcagaccagacacgcaatgccggtcagacctcactgtctacccggtcagactggccatgcagagccggtcagaccggccgtgcaatgccggtcagaccacctctgtctatgactttgccaatttcgtccaaacttttgaaatcaagcatcggcctttagtatataatttttcttcacataatagccagatgcttggtgtatcaaattattggaccgaaattccttctctctagacatatgaaaaaatataacatccaactaacatgtctagttgaatactaattcaaatggcttttgaaacaataatcatcatggcatcaaaacacttagccaattcaataatgaatcaccaaagtcatatgcctcacagacatgaattccaataaactacaaatgtaagtaatcggcttgagcatgtatgcaaaatattaacaatgccaatgtttctaaagaaaacaactctagaataaatcatcacattgaccattgacattagccgaattactaataagcaaaacttccatggtacaataattataaaatctatatcttatatggtgatccataaaaacacatacaatttgactttaaataaatatcaaagactcataagccaaatcatacttcaaacaaattatatgccaacctaccaatttcactacttagaactggtatttgcaacatgtatgtataatatcaatttgataagcaaacacatgtgctagatagtaagcaatgttctaacatgacataggtaaataatatgatgatgaacacaataaacccataccttgccttagcatccaacaaaatgcggctcaaagatgtgatgttgtatccatcgctgttcatcttctcttggtttcttcacgagcatagtaatgtcttgccccccaagcaaaatcggctttctcgactgcacgattttgaaggcaagacgaacaccgcaccaacatccatagcatcatgtgaaggagacttatctctaatgaccgatgattcttctctcatcaaattggatttatcactactactatgggaaatcaccggtctcttaacttttacttctttaggtctccatacttgcctaggtgctgtttgaggctctaaattattgcatgtcttgttctccgcatcttcggcctccttttctttttgacctatggcccgaagacgctgtagcctcctcttttgagagcgagataagccataaggtatccacttcggctgtggttgttttccaggagctaagcaatgattcttgatattttttgtcgaagtggaagctcatgtattgctttcaattttcccactcttctctaatgcccctcggtcagaccggcctctaggcccggtcagaccggccataagccgtcggtcagaccggccagtaaggtcggtcaggccggccgtagactggcgattagaccggccagctgtctcggttagaccaccaattttgacagtcacggcgtcggcttcgatctcctttgcttgcgtggtttccaccgcatctccagtaggtacatgaacatcttgagactcctctttgatagcaacgacctccggagttttggcttctttcctcacccacaccttttacacttttttcacctttgatccaccggaccgattcttttgtgggaaacggtcttgtcttgggttagatgaatgatttgacactgtcctaggtgattccttccatccttgataatacggcataggtggttgaggcatccatagcatataatacataaaaggataaccatatagtgacattgaatatggataccatggcatcacaaccggaggtttgtatggagttggtatagttgatggctccgattgctttgatgtttgaccaaatctcttcctacgagatgatcttggtctttttgaatcactaatttgattatcaaatcgctgaccggctaatcctttcttgaacttagcgataagcatctcaaaagtgagcttcggctttttggtcttttgggaactagattgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagtcacaccggagatgcataattaatgcaagggggtacaaggggataataatatcggggttaagttttgcagtaaacagcatttaaaagtcacttagttgcccaaagccattttataaaggcgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttaaaacactaacttgggtacattgctaggcttgcccataaccgagggcgcggctattcgaataggttatactctgatcagaggtgtacatctttacccacaagacacgtcttcctcacgtgcaaccacgtgccacataccaccacggcatatggacggaagacatgacatagtttccaacccatcctagccatagacaagagtaccgacccaacctacctacggccggaacccccagacaggcaggcagaattgagcccctagcagcaggacaccagccctgtgccatgacatctcgactaccgggccgcagcccgtgtagccttcatttgtcctagagatgtccatcgacccccggcttcatccatctccatccgtgtacttttgtttataaccagactgagccacaaactaagccttacccactagacatgtggaagtacggtagtgctttgcaacagaggcccgaagaccggtccttaggtggccgaggtgctactaacaaaaccatgcaccccgagcccagcctaaaaccattttgagggttttgaatagagggggaggtatgcatccaattccacaataatctaaccattccataatgtccaagtgatatgaatattcccaaagtctagagttatgaaaccacctaatgttgcctaattaatcagcgaagcatctacctaaattcatactagtggaaccatgaatagagtgcccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcaacgaccgcaaaccacgcttcgggaacctccggaacgacagaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttatatggagatttgcggattattataattaggctttgcaaccataaaacatatgtaagcgctagcctggaaaagacaggaaggctgcgccattgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacgggttgcacacgtggaaaccacgcggctaccgagcggacacactaacacggtcaccacacgcacaagcgaacgactgccgacaccgatacacgggtaccggggccgacaaccgcacaacgggcacgggcgacacctaaaggacgaggacggggcagcgagggagagggatccttaccaccacgcgacgaggcgtgggaacgacaacgacgaacgggcgaggcggagacggacggcgagggaacgacttcggcggcgatccttggacgaaggcgagacgcggccggcacaaggcttgacgacgcggaggcgaggacgaagacgacgacggggctgcagcggcacacttgacggacgcggacgagacggacgagaatggcttgacggagggacgaacgccatgacgaccgggaacgacgagaggacgacgaccggaaccggcgaggaggcgacgagggcagccggcggcagctgcacggagacgaggacggcgcggaacacgccgctgcgatgccgacgacggaggcggcgccgcgagacgacgagccggcgaggatgaacgggcggccgaagggacgtcggcgacgatgaggatggagaggccagcacgggcgacggcgttccggcgaaacaaaggagcagctggaggagaggacaacgcggcgacgtcgatcggtgtaccggcgacgtacaggagccggccggaggcggggagatactggacgccgacgaggaggccactccggcaagcttcgggcgaggaggaggtgatgccggggatgagggcagcgtcgcggagccgagggaggtggcgacgacgacggctgccgcaccgacgagggacagtagccggctggagggagtacagtggcaccaatgccactggttgccggcgggggcaccgttccggcgagtttccggcgaggagacggtgagaccggtgaaggggacggtgttgcagagccgaggaaggcgacggcacggccggacggcgcgcgggcgaggcgggagaggcggctggaggcggccggcggcacgggagagagaggaggacggcggggagaggtggggaggccacgggagagcgcgggagggggctaaaacgagagaacggggcgagggggttccattttataggagaggagagggagccggccatgggggaggtcggaacggcggtggaaaaggcggccggcggccatggaagttggccggagttggcgcgggcgttcccggcgattgggggcacgattcaagggggaaattgggggcaattgaagaggattcaatggggattaaaaccccccaattaatttggaaagagccggcttgaatcgcgtggatttaggggaggaaacgacgctaggtttcacgggagagagaagagagagaggatgccgggcgggaggaggacgacgacctggcgcgtgggccccacgcgggcgcgcggcgtcagcgcgcgtgcgacgcgcgtgcacgcgggaaggaggggcggctcgggcagggggcggcttgggccgggcggccggcccaggaagagaggaggtagatgctgcccgggggatagagggaggaggagggagtgggccgttatggggaggagatgcccaccagactcattgtaatagaggtatgacttggctactttctattacattcatacacacaaagtgtactgtgttccagattagttccacacatgcattgaagattgatggaatttaatgttattaattgactgatttgataagaagatgtgcgtaactatggattctagatcgttaaatgttctgattggttttgaatatcttctttattttcaatgtgaaagttattatatttttttcttacacattttgattatttttttgcgtctcttacgggctgctaatttcttttccatttctcattaaaattattgttcttttctaacacccactaatatttcgattatgacctaatttaacccggaccatagttgtttcttgctttataactaaatatagctgtgagcataaaatttatttttttttttttttggtcaaccaaactgaattattttattatacactacttgttatagcgcttcgttacccataccgggagacgttaacttaccgttttggcattcggctcacacaaaaacccaattttcttctttgtgaccctttcgtgttaacctacatatactccatcccgttttctgtattcacctttcatttatttaatctcttttacccn

SEQ ID NO: 3808 - DNA, 1963 bp, Oryza sativa
  unsure (1)..(1963): unsure at all n locations
tttttaggtgtgtgtcgagagccaaacaatttttttagggagagggagccccctcaaaattgggcccccataccccctgtttatactttaacggtttccgcagggaaaatgggtttaccggtgccccaacaatttccaaaaaggcagcggtgtttaagggggttgtccccaacaggtggacgaccccccccccaattataccccggggtacttataaaacccctcctcccaagaaaaagcggaccgtttcgataacgaaggtcggacagaaagccccaggaacctacaggggaaccgctggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctctcccgctccccattcggcctgccgccgcccactccgcccggtgaggaatcccctcggctcctatgcttcttatgcttcgcaggcttttcatggagtagtgtagtaactagtaccattaccatgtacttgtgattcgtggattggtggacatgacaggtaaaacaaattggggcgaattctcggttagcaggtggtgtatgtggaactcgtactaatgtgtttcgatgttgatcactgcttgcagtatgtgctaatgtgcatcagtttttcttctactatattcgatgcatcttgttatgtggctggttcatgtaatgcattactgatttttcacatgccattgattattggtgtgcacagagttacttggatatgtttctgactatatgttnnnnnnnnnnnnnnnnnnncgaactcgaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaaaactcagtggcactttcggggaattgccccgaacccctatggttatttttaatacaatcaaattgttccggtatgaaaaataacctgtaaatgctttatattttgaaaaggaaagttggttttaacattcggtgccctattccttttgtgggattggcctcggtttgttaccaaaacatggaaagaaaaactcaaataatggggcccagagtcatcaatgtttcaaagcgagaatcctgaatgccccgaaaagttcaaaggacttaaagtttttgggggttt

SEQ ID NO: 3809 - DNA, 16719 bp, Oryza sativa
  unsure (1)..(16719): unsure at all n locations
nnnnnnnnnnnnnnnnnnnnnnnnnnnnnnnnnnnnnnnnnnnnttaggtttttctttttaataaactttgataattgctttttttgcttaataattatttctggtgctctgaaaattcaagtaaaatttgagggctccttttagaccaaggagaatttaacaaaaattctccgggccacatttgaatttttcttgtacgtattttagtgtttgccaatttcttttcgaattttaattaattctattattccttttagcgaatgatttttatttcgggatgaatttatcaggacgtgacatagatgactcatcctttgcaactttatgatcttcggccttcgtatttttgatcctattcttgggccgaggatccccaaataacacttttccctttctttttgtcaacatcaatagaactaacaggaagaggatcactaacaattccggtcttaggaatagatgtaaccgaaatagtttcacaagtgaccgatgaagtatcaatcggtctttgctccatcaagcttgcatctttgaaataatcatgaaactcatgctccattcatgaccatgtagaaattgaactaggagcaagtaaactataccatgtagatgcaaagtttgacaaggaaaggggaaacaacttcaacttaagcaaatcatcactaccagccttaccacattgttcaataaattggccgatatgctctattgttgttatagcatcctcacctgtgaatttcgtgaagttggacacttcaaatctttgcgggtatggaactgaatctacatgttcaggatacggcctttgatatgtatgtatggcaactttggattctatttcactactatcccgcaagacattgttatcatcttttccaacatccacatgaccgatttgtgactcggtcttaggtgacaatgctatttcactttcgcatgtgatacaatccgaaccatcatttagttcggctatatcttcaatggcattattctgtaagctagcaatacaatccgaaccattacttgattcgactattccattattgtctaaactagtaacacaatccgaaccaacacttggttcggctatattggttattgcgttatcatccaaactagtaagacaatctgaatcaacatttggttcggctatactcgttacggcatcattgcacaaattattaccacgatccgaaccatcgcttggttcggctatacatgatattgcactatcatctaaggtggcatttaaactattgtcatccactcggctttcctgagccagagcttcatgcaacacatgatcaacatcaagaaatatctagccattcaatttctctttaaaagaatcaagcaatccatcatatgcaatgttggccaaatctttgtcagttattttctaattgaaacatcggtttttaacatctcttaacctttcaatataatcagcaacaaattcattgtatttatgcctaaccgatgttaaatcagacaacttaagatcagtttcattagtgtgaaaataatcatgaaatttttgttctaattgagcccaagtatcaatagaatttgccggtaaagaagtaagccatatcaaagcagtaccggacaaagataaagaaaacaagcgcaacttacatgtattcatactactagccctaccacattgcgctaagaattgatctacatgctcgtatgtagtcctactatactcaccactaaatttggtaaattcaggaattttataattaggaggatatgggacaacgtcataaaaatcagaatacggcttttggttctccctagcacgattccttacctccatgatttcaggccttggtggatttggtggcctaaagagcggttgttgtggcacaatattgttatattggccatacctagtatcgtgagaatatcctccattaggatcattgtaagtattagggacatgtggagtagcatgactaacagtattaacaggtgatgaataataattaaaatcagtactgctagtcgtggtatgaaaacctggagaaattcctagggaaccggtctgaccgactatagatagcccgtctgaccggcccatggcccggtctgaccggaggtcagtggtgcggtcaggctagccatagcaggcctgatctagccaggatagggtacggtctgaccgactatggtgggcacggtctgaccggcatagtacatggtctgaccgtccatgttggacatggtctgaccgacatagggtgcggttagaccggtgtcacgactggtcataccgtcagttcgactttgcatatagccgattcttatgtaatcggctgtataaacacccattgaccccccccccatatcattataagcatattgtataggagcaaaactagaagtagcatatgaatctacacaacgatcattaaccttttgaatagcaaagtatgggttgggcgaatcggaggttacctttggtgaaagttttctctcatgacgccttgatcggtcctaatgtattgtgtagtagtattgttgaacccgttcccgcttgtcatagttgatgaagaaaatccttgattaatttcggccatatagctcatagccaaaatatttgaccgaataaattaatatacggtcataaattttccttgtatgctactgtactcggcaaaagtatttgatttatttggtaatcaaccgagtagacttagcaaaatttggaaactaatctaaagtttcacagtgtaaccgatacaaattgaatcggtttttgtctctttttttttaatgtgaacagtaatagatcggcttgaatagcctgatcttttctaacccgtgtacagtaagctttggtcaatcaaatctttctgttgccgtgtggaacaaaaaggaaacaatgttgctaatccggctgctgctccctgtgtgaacagggtttaacgtctagccgtgatcaaacagaacaattaagcttaagcttgaagacaaaaccaatgtcggcgacaataataattacagtgtaggttaattccggctgtttagccgaaactaattcgatgattcgacgaaacagtaattattagattaaacgaaattcggccgtgatatggccgattagatcgttccccagtggaatcgccaaaaatcgtgttggcaactttctgtgacaagtcaacaagcacgatcgtaacacctaaacgccttgcggtgatatggagtcgccaaccacctcgatctagccaaagggccaaatcaagatggatttcgtagaaaaacaggtaaaccggctaacggagccgatttggatatcaaaatcagcctctaggccgatttagatcgataagaggataactacccgtctcgtgggcaaaacggaaggttttcaagacaaacctataaagaagtgtcgcactcccgcagcggcggcggacggtttacggcgcaaaccgacaaagatggactaaactagggtaaaatagaaaaacatggtaaaagaacgattcaagtagattgtattcgggggttttataatgaaccggccttgtcccttaaataggggttggtcttgccctctacaggcccttctccatgcccaactcgggatagaaaccaaagaaaacacgaaacatgccttcccgagcaataaaacccgagacccgacgaaaacagactcggacacggaccctgccggtctgaccgcccacatacctgcggtcagaccggccctactagccggtcagaccgcccacacacctgtggtctgaccggccctgtgaagaaaacccgtcactttctaaactttggtaattttcccctatttcgtccataggtgccaaatttgtgtgtaaacaatattatccatatatactatttccattcaaccgtttaaattcatgtttgttttccatgtcttcacatcatatcatacgttctaaaaactgacctaaaattattgacaattgtctaagtatgcttctaaaattatttcaaatatttgagtggttttatagagtatcattgaagtttgggtattacttatagggtgtttgcatgtttcaattgttttaaaaaatattattgtgcatacatgaaagatcgagggtgcatggtcaacagcggcggcaccagctggagggcacggcggtgatatgaggcgagagggaggagaggtgagcttttttccgagaagatatgtaatggaaacactatctctagtgcaaacatagaaaccacacttggatgcaaaacgtaggttccagatatgtccacgtcaccacagaatgaaatgttcaaaaaacaccccgcctaattccaaactttagcatctcagcccccaaattgtcccacagcacatcttctccgattcagaagggatccatccccaaatccatccccaaactcaactctctgctgcggcacgacggtggggttgggggaggggtggtgcggcggcggcacggcggtggggtggggtggggcaccggcggtggtcggcagcagcgccacctttccacgtgattcacggcaacacgaatcaacccccatgctgctccggtgacgtcgaggcatctgcgaacggcggcctcgattcgccgattgctcctccagcatccactgaattaaggtcattctctcttcttgatccctgctatagttcgtgtatgttcttccgtggaatgtgcttggtttgaacaatttgggggctgagatgaactagggttttgatgccaccaacactgacaactgcagatgaactagagttagtattccgtcggtgttcttgtagagacagctacagcttcctcttcttgttgttcttcttgtccttccctccacttgggcctggcccctcatcgattggccaacaaaaggtagtaatggtgtccctccattactgctgttctgtaaggttatgatgagctacccactgatgtggagcaaccggcggcgtctgcagctgttactgttgtgttattcatcgatgggaggatcgtgcgtagaattgatgttgctgctgccggcctgccgtcgtgctttatgttctccattatcttgcatattgcattagaatgatggtgagatgtgggtctggggtctggggttcagtacaaagttcgatcaacggcgttcatgggtgccagcttattttagtgacatacctttgtcaggattgttaaggaccacctcaaggtcagagagtgccaattcattcttttctcgtctaattgggcggaagcttgctttggtggagttttggctcaggtttgatgctgcactagaagaacaaagacataaggaactagaagaagataacattacgctccacacaatccgcaatttgaagacagaatgggtgatagagaagcatgcaagtgagttcttcacacatgaggtatttagcataattcagaaagaggtgctagctgccagggaccgttgccttattgacaatgtgcaacaagagggctaggtcaaaatcattgatatcattgaagaatccaggaagccaagagttgtgcgttatgatagacagacaatggttgcaacgtgcacatgtatgctatttgaaactcatggtataccatgtcgtcatctaattccagtcctaagaagtgcccagctaagtgaactgccgagatactatttattagaaaggtttaggaaggactgcaagaagacacatgtgttcgatgcagatggtatcttgttggaagaaaacacaagcaacagtaatgatcctgtgatgcaaaaaatgctttcagaagcatgcaaccaaatggagaagcttatcctacaagctaagcaatcagcagcagctatgcaacttttgagggatgaactagttgtgcttggtgataaattaaatgagatggttcctgaaaaagagcttagccaaattgaggaatttgaatcatatcttggatgtagcattccaagtcaaattgaaatccacccgccaaatgacactcgttccaggggtcggataaagagaattaaagggcacaatgacaaggagaaaaagcaaaacaagaagataaagaaaaaagagagagtaccacaaaggtgcaagaagtgcaaacaagtcgtgctgcacgattcgcgcaactgtcctaacaaagaaccacaacagtgatgcaaggttctatacatcatgctttcttaactatcagtcatcttataatagttgtcatacaatttcctggaagaagttagcgtttctctgtaaaagattgtgtgttgtcatccaaaattcaactaacggtgtatcgtaaagtctatagtgtgccaagaacattctggttctaatggacatactgtagatttccttggaacaaagtagcaattcatgtaaaagataataggtggccatataatatttaactaacagtaggtagtgaacacatgttgaaatataattagttgggaccattgtgaggtaataacatttttagtattgtcgtcgtgagtctaattaataatataaatcgcaaatgtacaattgtcctgttagctgatgtggtcccttgcatttttgcatgggttcttatttatagctctttaagtttttgactgtatgatttgggacctagtgttatcaacttggaacaaagtataaaaaaatatgggaaggattcgaggtgggcaagtgggcatgtaatatacagcgggatgtgtaggaagcacaatcattttggattgcattttcagtttggaatggttaagaattacatatggaaaatatttaaatatattgcgacaagttcggctcatatacaaatgtatattgcgacaaggacattttggacagctaatattcagcttgaaatggttaagagtacatatgggaagacaggaaaaaaatattagaacaaccattgtgttccaggaacattttgttatcttagtttggtccgtagtgtgaataaaactttgtatgtatctatgctcaccagtatatatgtccttaacaattttttatctatgctcacaagtatatatgtccttcttaacaatttttttcactatgcagtttgctgggtgcaggtttttttttgctgagagcagctggcgagaattcttttgctgagagtagttttttgttcaaagtagagccactgccatcatccagtgcacacgtgtgtgatctattaatagattttagccatttaatagcaaggttgcattttgattagacaacaccttgaaggggataactaatatttgtgcacaagtgttgtaacttatgaatgttattacctgccaaaactctgtgggatctaaattgtgtcagcagaagacatctgaatatcagaccatgtcggtatacattgatggactaggttgactctgccaattgtttgtggccacaatctggacctatgattttctaggaaaatcctaaatatacttgaactggataaattttctgtgtgctgtatttttctacttgaactagtaattttctgcacctgtgttcccacaaaccggtgtgctgcatttgcacaccatggtcatgaaagtttttcgtgtctctataacaatatattcatgttgagtttcttcagaattaagttccctgaatgttcagatgtcattttttttcatgaaggtatatatctgttcaccctcgtccatatatgtggtctgtgtatgtggagagggagatgccattttccaccctaggcacgatnttcctgttgtcatgtgcataaggtagattatattcacttcagtctgctctgcagtgtccattgtccacttgaaattcagcaaaaccttgttcttgtgctcatttttgaattaaggaagggaagaccgatacctctcactgccgtgcattgtcgtggattgccgtcgagttctgctcgtgcgcgggctgtcattgagatgcaaaagcagtgcaagtcaagttggaagaagcagaggcattttacacattgtgtaatattgtcatttcagtatatagacaaattgattacaaactaactcttatatgaattttctttttaaatcctaatagcatgataagtgctatgcattgtcttgatgaagttcttcatctcctccaattcctgcagcacctcctctagattgtcaccttcaatcatcttagttagcacctcctatgtattctcacaatggtcgtcagttttgaagtgctgaaccccagacccacaggattattgtctgttgcatgttgctctcctctcaagcttttccaatggactgcagattgggatagcaccaaatattaatataaatttagggatagcaccaaatattaatataaatttaatttcctcagttcaaatcattctcattagtacattacccgttgtgtgggtcataataaaacccactaacagatatactagaaagtattgctctttacttctctacaagtagcataaaaaaattcagaataatgataggtgttaaaattcagtactgtactagaataactcagtaagagcatcaccaagagtatcccaaaattttgtttatgggaatcttaaataaaatttaaggtgttaaaatattgagccctccaagagattggctaaaattgactccctaaatctaaaaagtggtccctctacaaaactaccaactgaaatctgtttcaggctctccctcctgtgagattatcacgctcgcccgtgtgaccattgatcgcgggaaccacttggtggtcacctccctgtcacccctctccacgcagtagcacgtcagcaaatctgatcctgcaaacaatcaagcagaaccactacaagtagcagcatcagcaaagtccctaattaccaaccagaaccaacaacatcgtaccattttcaacaatagcagatcagtagcgtcaactcagatcagcaaacgtcgttcaaaaaaaaattcagatcggcaacagcatggcaattagcaatagcatggcaagcaacaagcagcagatcacaactagcagcaggtcagtagcatcaacaacagcacatcatcagcaacaccaacatcaactttcaacaccaccaccggcaccaacaacattattcagtaccaactgtagaattcgtagtagcagattagcagcgccaaaactagcaagcactagcagataccttcgctcatctccatcatcgagagaccaatcccgatttgaggagaaaccaactcgggccgatggaagttcgcctggctgtagtggagatggtgccgctgccgccgccagagcaggaactatcgacgccgagaaagctctaggcagcggcgcgcgcgtgagatgtgggcacctgtaggacacctcgatgcgacggcgaacaacctcgtgatgaaccccctgtcgagaacacttcacgtgcgcgtgggaattcgcacgacggcacgagagagggagattgggagcgagcgcctctccctacttgtggagaacgaaaaattcggtttttgaactattgggcgcttggctagggattctgttggactgggtttttgaacgaaaatctccaaatttcaggataaccatatacagatattgttggtgatgctctaaggaactaaagatacaaaatcatcgagagtacaatgcagcagccacaacaactcagttctcggagcatttctcttggcaattaagagaacagcagcagctccagccttgactgctaaggaggaaagggatttggaggtcttcagagaggctcaccgcaggatcgatggggaagaggaagaccagattcaagctcatgagccgcctctgcctccaccgttgtgtctcctcactcaactattcgactggcccgagctcgtcgtcgctctatcaatctccacgcgccgtgcagcctcccccctcctccatggatctggtttggatctagaccatttggtgttgaagtggagatgtagcaacgtgagaaaagaggaaatttaaaggatgtatatgaaattgtacacagcatggtgcggggggcatttcataaaatgtaacgtggggacggttgggctggcaaggcttcatcaggctgcacattttggatccaatggtccacgattgagtttgcaagttttcatataggttgcagtttccactacatattttctccttttttcctgtcacatgtgattttagtaagagggatcacaggtaaaagataaagttatctatctattatataataaaagttcattaaaatttctacaaacgcttctaaaacatcacttagcgctctaataaattagagaaatccaagaaattctaaaaaaagcaaaacatcttaccctcgattttcacttaataggcccattattttacaccattagatctattttaatagaaaaaaacaaaataccatctaccaaaaatcctctctcattgctcactttggcctccttaatttctagctagcaaataataaatattcattaaattaaacatcgtgtatatcaatatattatgtaataaaagtccattaaacattcttaactgtgctcctaacctaccacaagatgcatctaataaattagaaaattgatctaaaaattctgagaacaaaaatggaaaaaaaacttaccgcactctcacttagatcgatggacccatttgttttaaccattagaactatatgtagagaactttaaaagtaaaaaaccactcgctgccccctcccactcgcatgcgtttgcggtgcacactgctctgtagctctcctctctagctcatgctctctcctcctcctttaatttagctactaaattaatcgagaaaaatcaataattttatatactaaaacagcaaaaattttcaagctacaaatctcattcctaatctagcaataaaatactataaaaatttgacagcatatattgagtcatcatatatcattccataaacatacatatctaaattaaatctacaatatccaaacaaaaattacaaattcaaatattaaataatattttatcgagagacaacatccctaccctttcatatgtcatgcgaattaacataaaagtatgaaacagttcaataatacaggttgccccatcatacattgtttttcaaacatttataactaattggatatagaattaattcaagtatgaatagtccaagtcgcggcataaaaaaccggttaaataatatttgataggacaacacgtgctcaaggaaagaatccaattactctatattttttttgaaatttgctcgagtaatccaagcaagcctaatagtcgctatgtccgaaataagtccattttcacccatcctacgtataccgatacaaaacataaaagactaaaatacccttactatatcaaatcccaatgcaattatttctctctttttatctactcccaatatatttatcctttaatttcacaaactctaatgcaatgattactcaaaaataaacttatttgaaaacaaacggtgtgggggcaaaataaagttattatagcagagggagtaatcttttacataggtgttctaaaatatattctttgttactatataatcgactttagaagctatttagtatagcatcaaaataattatgctattgagcaatattttggaaaaatcatactttttaatcatggcataaatatttcggttgattttgtacccttatatggcataattaatttcaataactttttgcatatatgagcctcaactacaccgttctataggctacaaacaagctagggaatcatggatcggaggtcacctgaaaaatggatatgtaccacatgttcatatttgctgatgtccaatttgatatcacaataactcatgagaaaattaaatgctcatgagtcattaagaaaaaaaagagatatcaaaatttgtagagtaattagtttggtaattatcaaagatctcagctatagttttattgctgaaagtttatatgtgcaaaggcgtgaaattctttaccgtaagtttgaatgaccaagaactacattatgtgtgactgctatgtatgtgtaaacatctatgaaaactttatatatggataaaaaatagacatcataaaagattttaacagttataaaaaaaacagaagcccacgcaatcagcctcggtgctccccaccgcctcctccatgttcccatgacaacaacaagccgacggcctcctaaacagatcatcgatccggcattggcgcatcgcctccaacagcaataggtgatacttgttgacggtcgctatcgaccagtttcgaccgtcattattacccaatatatgaagactagctatgtttgcaatgcataattcccaaataaaatatctacttccactatgtgctatgctactaacatgtatgcaggagaagcacgcatgaatggaggagaatcgatgcgaaaccaaacaacaatcaatcggaagctgtcgagaggtgattaaccaccaaagttgggagagaatgaacgtgaagaatgtgaatatattttgcgccgatggactcacatggttttgagctacaacatataaaatgagaaattattctgagctaaaacatggtgtaccataaagtggggcccacatgtcagcatcctgaagaaggctgtgggccaggggagccagccagggttcggccgaccccccagttggcccaatccaacccatcttcggccaggcggttactaccggcatcctatgacggttggagctaattctatctgaagaaatcgtcatggacacatagcaagaggagatgaaatatgctatttggatgcttgagtatgccacttgtcatgaggagagcaaagatgctcataggatgcttggagcatctccacactcccagagcacctctccacctataaatacccctcctctcattcattccctcacacacctcaagaaaaagatctagagctctctcaagtttagtttagtagttctagtgctagtggagtagaaaatagaatagtcttcatagtcctcgagtcttcaggagattgctggtatggctccagtagctttcctctcttcttttgtaagacatattgaattaatagaatattcttctttatacattttcggtattttattccattcatattacttgagtgccgactttacttcatacttgaatcaatatagccatgcaactagctttccagataggtgtattggtgtgggtttagtgtctgagtattcggttgctctatgtcggttgcaaggatgtagagtagtatttagtaatataagcacggtgcttagtttattagataccattaattggggtaatatacagtggttcagaggctggccgctgatggtgacggctcagtatgggtgtcctctgcatgtgtatattattctaagtgcaatttcctggggagggtactcctccgtatttagccccggttggatggccaggacaggttgtcgtaaggaactcagcaaccaggggtagtctcttgaaacaccaggaggacactaggtacggggtattggttgcatgactgtataatagcaagtatagactaaagatgtatgtatactagaagtacaggaatgatacttttcttattctttctccatttattttagactatattttagtgagagtatcttagttttttcttctgtgtgtcaccctaccctttgaactgaattaacctctgcataaactttcatgtatataagtaatatatgaattgttagtaaagttctctcttatcatatctttcattgggatcaaataaatacgacaccttggaatactcccgggtgaaatgctacaatggtatatccgtgcacttgcggatcacatatgtaaccataatataccaggattatttctagtgctattgctgggaattatatttctagtagtgtcgctaagaaataccaacaatactctccatggctccaaatcaggtattgtgttcttgtagtctaatttgaaatttgggatttagaaatttagtgatgagctttgctttaagaaattatgtcaatagcaacttataatttgtttaattgttcatcattcattaggaccctaaaaatggcacctagaaaaagaggtactaaagcaacagcagctgctgaaactagcatggttgcctcatcactagctccaactgaaggggtagaaaggtcatcaactgtgggcagtggcaaccaacactattgttgttgttcatgtggataacaatggtgcagatggggattgagaccatgaaactaatgatgaacatatagcaaaaaaagcaaagaagagatcctcgccagcttgggaacactacaatattgtttataaggtggttaagataaatggctagatggttaaaaagagtgggccaagttcaaatattgtgcctatttagctaggcgcaatagcaggaaatggtacttatgtgttcttgaaccacacaaaaacccacaatgtggttccaggatagcagtaactcaaaatggataagggttccggtacaacatcggttgaaacatacaggtatgatcaagagatctctttacaaaaattttatttggcaattatcatgcatgagtatcctttcaatattgttgagaatgagtattttgttgacttcataaaatctctttggcctacttttcctttgaagagtcgtatcacagttaggaaggatatacttggtatattttcagaagaatggaaaaggttgtatgagctttttaaaaatgttaatgctcactttagtgcaataatagacatatggacctctaaccaaaacaaggggtacatgtgtatcactgttcattgggtttatgacaattggtgtgttcaaaaaaggattatcaggttcatgcatgtaaagggaggcatattgggctaaatttagctgatgtattttctccatgcttgcataagtggttcatcgataaaaaaatgttttctcttactttggacaattaagcagcaaatgatgtttgtgttaaagatgttattaaggtgctgaatagaaaaagtcccctcatgtgtgatgaggcattctttcatatgagatatatgtcatatacttaatcttgttgctagagatggtttggcacatattggacaacctgtttttagtattcgatcattcgtgattcttgtgaagtgttctcctatacagaaggaggaatttataaaatgtgcatctgagagtggattggatatagcgaggggagtctcaaatgatgttttgacatggtggaattcaacgtactatatgttgtcagttgtcagatgccatatattatagaaagtctttcgagaggctttatgaaactaaaagagaaatttatgagggtcttgttccaaaagctgaagattggtataaggcaactaaacactttgcatgtgcttgaagaggtttgatgatatcactaagatttttttttcaggtacttcttatccaactgcaaatttattttaccacaactttcgtgaaatcaaggctttaattactccatggatgacaagtgatgatgttgccatcaaaacaatggccacctcaatgaataagaaggttgagaagtactggaagaggtcaaatcttactcttgttgtggcatactttcttgaacctaggtttaagacaaaggcagtagagtataacatgctgaggtgtatggtaagcaatcatatcatgcacctatgcaaaagtttactagtgttgttaagcaattttatcaagaatatgcttctttttataagactactattgcaccaacaactagtgtcaatgttgaatcaaaagaaagccatactatagaagaagcagattatgattttatgaattatgtctatgcctcacatgtggatagtggaagtgatgcaagtgacttggataaataaatggcttagccatcactgttggttcctaatggagataaatttgatgtcttatcatggtggaaagctcacaaagatgtatatcctgttcacgtgcttgtccattcaagctttcattgttgctttagaatcagcttttagtgcagggggacgtgttattgatctatttcgtactaaacttgaactcgaaaatggtataagcattagtttgtaccaaggattgagttgctcgatgtagaagaggtgatcacttgtgtcatttctcatttatattgttgtaaagggcattcttggttatttgctaatagtctaatatagctttgtttctaatttttcagatcctaataagagggttggatgaggttgcagagaccttggttgctaatttgacgcttgacgagattgatgatatggtatgacactgaccaacttaatcttgcattagtaggaacattttatttcatacattttgtagtcctattgtcaaaaaaatgtatattgattgctcataattacagaaaagcaacagagtagtgattgtcggtgatataggcctgggggtattgtgtctagagggaggaggccgcccccaaactcatgtggcactcccctgagggtggtcgggcccggggttgagcagcggctgccccctcccagttaggggtcaggccatcccgaccccctccacgcacccccccagcatgcgtgagttaggtgggcgcgctcaacgcccaactaacagcatttaaggctggtgctgcagccgcataacgccgcattattaaatgcggcgtgcaggcgtggctgacaggctgagtgacactcgattgaccggcgtggcagggtgagtgtgcctgtgatganctnctgtaccatcgagtagtcattgcccgg

SEQ ID NO: 3810 - DNA, 4888 bp, Oryza sativa
  unsure (1)..(4888): unsure at all n locations
ggtttaaaagttttttttgaccccccccctttataaaaagtaaatgaaagaagggccgttaaaaaaagcaccctctaatttgtttgggttaattaccccccccccaggtttttacgagggtttacctagataggataaaccggtccgcaagcaacttatttggggaaagcaggtgccagcccatccaaanaaaaagtttcccaatgtcggaccaggccgtgttcttggagtctactgaaagaagaaagctttgcttttataaatcaaggcccaatcgagtgtgggcatcaatccacagcaatagatagagccctgtgaaaaatattcggagaagccaaagccctagtcatgtattccactcgttgagatgactcggtgggttctagccgtaaataagagtagttncaaattcccacattgtaacgtgtgtgtatttttccacaatacatataacttgaagtagggtttattcatctcgagggctgaacaagtataatccttgtcccatgtctcttgatacattctcgcatatatcctagtaccaatgacccctatgctttatggataccgttgtcggctatagcctgtcgacggctagctacaaggttttcgaagagattcaggaatctcatggatagtacaatggttgctagttttgctacacatatggccattcatttgagacattcctaacattcaggaatacgtgatgcttgatgcttgttttttggtcagtgatttattgtcatgcatagttctgaactactgatgttggatactcatcacacaacgagggagacatccatgttaataggattatttgacacatccatagttgaaaattttgaatttaaattatggtgcttgaaatttttaatttgaatatagtaaattctttgcaccataaatattcatgtttgaactattgtgtggtgttaaactatgcttatacataaagcgtatgtttatatagaagagaaaaagaaatggaggctgagcaatacatgtttgtgcttgacatggagccatttggcttttagggagtccaaaatatgggatattaattgctggagcctggaaatgcacttaactccatatacggggcttgctctcaatcaaagtttatataaagatagctttctttacagggtttctatttcttctctaccaatataccaatcacaattagctcttccacctgtcccatctcgacccatctgtctcctgattgcccatcccattgtggcttttcctgaaccctcctgtagttgtagattgttgctccttcctcaacatcatccccttcttgcaacagaaacaaccttccttcttccttggttttttgtccctttcaaacacagactccaccaatttccaccattcactcgagtctagtgtagtatgaagcctcaaaattgttatgaaaattggagtagaagaaatggattggggatttggtgttcgccacaagactgcaccatattacaagttaccggtaacaacaaatgaaatttagagttcaattttgtactttcccattcgctgatatgcaagtatctaaattggttcaactcaggttacaacacttaatatctaaaggagtttagattctgatttcacgcactaatcagaaatgataacaatctttcattaataggaattatgaaactggttgtaggtcatcgtatctcctgtggcccatctccttctcatcaagccatttgattcccttcaagtacaagtccgggagaccagtaccaaaatgccttcttgtaaatcttcatttctgaacatttttgctccattttttaataattatagctaaggttttgatagttaattaggccacctggcattgggtgctttgagccttggtaattgctaccctgccactcaatgccatggcagcagcctcatttctacatatcggtatgatccatataaagtggtctcatggaggaaccagagaccaggtttagctcctacaacctaactttgtcatgcccaacacctcgtaagtgtttctcttgtggggctcttggggttttagttttagatgtcctgcattccaaaatataaggcacaaccaccttaatccaaagaccaagaaatagttattattatcttgtagtttggattatcctaataaatgtaatgcatgcatccaatagagttagagaatgtgagagtgaaggattttaaaaaatagtagtttaatggagaatatgtcatagttaatgacatgcatgcatgtatgccttatattatggaacatctaaaaaaagtgtgtaacatcccagcccagggcttaataggattaatagaatactcatatcaactagttgcaacttcttttccggaagccgatttccaaagaactccagggttaagcgtgcttggcctggagcaatttagggatgggtgactgatcgagtgaggacaaagtatgcagaaaagacttgtgttggtctgtgagggcagtctataagactataacctatgaaagctatcagatgtaaacggctatcagatgtaagcgggcctggcctgggagaggcgggacgttacaaagtggtatcagagccgactctcgcggtttcacgagtgcgtgtgtcgcagttgcgcaggcatggtgcgcatggctggtgtggaccgggagtggtcacacagcatggcacatgtgctggcactggacgcacggacgtggccaggaggggacgttcctggaacaagttgcaacttcttttccggaagccgatttccaaagaactccagggttaagcgtgtttggccttgagcaatttagggatgggtgactgatcgggaaattcttcccgagtgcgcacgagtgaggacaaagtatgcagaaaagacttgtattggtctgtgagggcagtctataacctataaaagctatcagatgtaagcgggcccggcctgggagaggcgggacgttacaaagtgtttgtgctttatattatggaatggagggagtatatgcgttggttgacttatgttgctcatgatgttcatgatcaaatgtcaactgagataaaaatgacactataggaatctttactaaagtaaatttcctaaaataatgcaaattgtattgtattcttacggatgaaaatagtacaattgttggagtgatactcatcacagtaggttgtgatattcatgctagtcagtaccacttaagattgtacttttgtcggttcaagcacgtgtaagcggcggccagttttaaaccatgtgacgatgtgactttttgcaatagtgcttgttaatacccttatgtaaatgaatttcacaacggccatttacacctatatggtcttgcccctagcttatatatataaagtgcatgactagttgctaaatttgttcacctatatatctaggccccatgctctgaaaatacatatctaggtcttagaagttgttaaagtatatcattttagtcccaaattgctacgacgcctccggtatcctaactggtgttggttgccacctcacggaaattcctttcaattttcccctcttatttttttcttttcctctgttttttgttctttttttttaatcttctcctcttcccatgcacggctcatatacatgaaggggctcaaggatggtggcaacccgggtgaccgcttgagggcccatgaccatggcagagcccatctgtggtgactgaatacgagctcaatagaggcgatagggtgaagagtttgggggggggggggggggcgagctcaagggcccgcagcaagggctaactcggtgatggcgactagggacaacctccaacttcggtatccattgttcgtgccatgcatggtgttttgggtctggatctcggcccggacctttgcccctacaccaaacaacagctcccaaggatgtagacgacaccgtgcatgatccccctctcgtggaggtgacaacaaagcagaggagccactcgttattgttcccttcatcccaatgacaacatggacaagtttatggcgatgaccttgacgacaacaattgtagtggaaaatgagaaaaaaaggggaaaaaaaggagataagatggacaaggaaaaatacaaaagaagaaaagaaggaaaaggaaattcctaagtgggacccatttcagtcagtgtagagttagtagtgatgctatatcagcgtccgtgtggcacattaacaccatgtagaatcctagagggatccgtgcaatttcagactgaaatgacacgttaaccagttaataactacatctatttttgattgtatgaaaacagataacataaacgaacaagtttaggctctgttcgtatgagcaagtttggaagctttccagggatttacgaacctgagtactgtagctgctactgtagtatattactgtagcagttgacggacgagatggcgtccaccgcgccgttggagcgccgacactttccgtcgtcgagagaaggatggctgtcacacccggaagttctcctcctaagcctaaaatcgaattaataagagaccctaagaaaataccggtgcaaagcaagagttaaccctattaaatcaatgcaaataataatcggaattggcatgtagaatttttcttgagttctacatgtcgaaattcactaacaagatttttagtggaattttcagagctctcgaaataattttaaccaattaaaatcgagcatgcaatattttaaatcccagggaaattcttttcctccttttcttttttccttttcccttcttttgctcttctcgggcccgcggnacattgcaccccgncgngcgcgcgccctacttcttgtggactcgaccaaacacgcccttccttttttcaagggacgccgacaggtgggcccacctgtcggccn

SEQ ID NO: 3811 - DNA, 1315 bp, Oryza sativa
  unsure (1)..(1315): unsure at all n locations
gatgtcccttgatcgcttctctgcagtagctcatcaactttatgcaatatatttttagccagcccatataccaacatggagcaaaaataatgacttagaagtatggaagcatatactcacatagccattgaattgctcgacagctgcctcaacttcttcaacactagacattgtcacaaacccaaacccacgactccttccagtcagcttatcatagatgacctgcaacaatgcaggttagcatgatacaatataggaaaaatcaaccaaagccgagtactactcttaaaattgagcaattaaccagaaaaatgcaatcctaaatctttcgccagtcacagaattaatagcatgagcgccagcacaccaaatttaacaaccttaaataatggcaaccttatcgcatccttaatcatctccaaatacaacctcacaatgagcacccgaaataagtttttttttcttaaaagaacgagaatatgcccacactaccatatgcaacccaattgtatcgcggtttaagcttaattaacaacagaatgaatttgtcgtgaactgtaatatgaagcaactagacacaatcattcatcaccacttcaccagcgacaagcggtccatttctggtttcacaaagacagggacacaccagcgagcgactcgacgaaggtggtgtgataggagtacttagtaaggcgagacgaatggggtggtgacctcgaccatctcgacggagccggcctgctcgaagaggccggcgagctgggcgctgtcgacgctgaagggcaggttgccgacgaagaccctcaggtcgtcggagaactcctnngcncccggagcctnnnctctctnnctctnggnctnnctcggntngacctnctccgcacaggcacggncaccggnacgaaggggncttgtcctcttcgcggncatccngcgacnngnnaaggcggngagcaaccgctttgaaaagaaaganaaggaggatnnagcgngnnttgaggaaaanngaggggnnnnnnnnncnnnnnnnnnncnnnnnnaaaacnnnncccccnnnnnaanagaaaagagggaagcaccacaggggngggcacaggcggcgcgggggagggagcggcccaccggcaaaggccccgnnggggggggggcggcnnananggcgggaaaccgcgcgacccgcgcgcgccgaccacaaancaagagagagggcccaacgccaaccggcaaacccccgcgcgcggcggccccccggnaagggccnannncgcgccaagaccggcacaccccccccnnggcggcgcggacgacgcccgcc

SEQ ID NO: 3812 - DNA, 1195 bp, Oryza sativa
  unsure (1)..(1195): unsure at all n locations
cgcgcgcccttgaatagactcggcnnnnnnnnnnnnnnnnnnnnnncttcatttcacacctctcttcattacagggttccttacttataaagatcatacatgccagcctggccgcttggccgaattacacaacacacatgcgcacacacccacccgacacgttactgtaaacgtcatcctggcattgtagctcgtcacgcgtgtggcacaagcgtgacatcccgccaccgccgctgtcgctgccgccaccccctcctctttctcatccctatccccaacacaaccaccttctatcaaggctggattcggcaattgtggggataatctggattcgagaggcatggctcgacccgacagcgacgcactggtggatcgctgccacctcatcttgcgcatttttccacctgagcgcctttggttccccaggacctcctttgtagcgcctcttctcatcgtcctccaatgacgatggccaagggaaatacaaaaggtccgaggaactgcaccattatgtaagtatctaaaaacctctagcttctcacggtgtttatgttggtgaagcctgtacgatgtgtcctaccacggctttactaacggtaagaagtggaatcatgcatgccttactgctaaatggaaatacagacatatcattaagtttggaatattatggaagtgtaaattaactaaagtgaacattaagttatatgaagtttaataacctttatggaatttagttttgaggggcaatttcaattagagcctttaaaaagatggctctattaaaggttgtatgaaagtcaggtcattttatattattattcccacccattggttaaaagtttcaagaattggggatacctaggttttaacctccgaaaaggtttccaatggttggaaagtttttgttccgagcccagggccccttttgaataagccccggcgggctcacggagggaactaaattattatccccccccaaaaaaaagaagtaactggtaaccatggccaatcgataggccagggaaagtgttctgggagaaattttccctccaatcccaacatataccgaaacaaaagaaaccggggccaaaaggaccacccataagggtgccactccccttcagggaaatcttgccctattttataccacccggaagggtttttggcctttcttcctcaaatatggcgggggggg

SEQ ID NO: 3813 - DNA, 1763 bp, Oryza sativa
  unsure (1)..(1763): unsure at all n locations
agtggccaaccattgaggcgcctccctatgatacccggtatttaaaacgccccttccagagaaaagcgacggttccgtaaggccgttgaccagaagcccaaagatctccggggaacctcgttcttaaagccgggggttccccactgattgagggcatttgtaagctgtcgggggggacctatgaaaacgccacccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggctaaactaagaaattgtgatatatattttggtgaaaatgtttttattaaaattattgacttcataattaatactttaattaaaacacttattctacataattcttagttttaaaattcctaaaatatttcattattttcttcgtgtatgatttatttaaacaaaatgtgtcatttcccaataaaatacgaaaaataattaacaagtgtagaattggtaaaaaaggtaaagatccttaaaaggagtagaaggaaggactcaaaccagggtcttcaggatgagagcaccagacccagtagcaactcacgtgtgtattacatatacaagcatgtatttatatattttcttataacttagtaccgagcaccagatccagtagcaactcacatgtgcattacatatacaagcatgcatttatatattttcttataacttagtaccaaacaccatgaagctaattctatatgactagttaaatttttgtcttctcgaataggatgtgagtgtcaatattcttgacactaaagcattatatatcaccactaatcttaatagcgttgagctgacgatttatttatgcaaataagtttttagcacggtcgttgcaaaaaagtttctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttctcctacgcattggggatttacaccgatatgtgactctaagacatctgtttgatgcggatagtaacccagcccgacaccggcacaccgtgacgcgcctgacggctgtttgtccggatccttacaacagttggaccgttcggagctgatgtgtaaagtttcaccgattaccgaaccgcaaaaaaagggccccggaacccctattttaggtaggcagaaaaaaggttttaaagtcggtggcatttgggaaaggtccggaacctttgttattttaaacataaattttccctcggacaaacctgaaagtctaaattgaagggaggtggtttacatcgcggccn

SEQ ID NO: 3814 - DNA, 1305 bp, Oryza sativa
  unsure (1)..(1305): unsure at all n locations
nnnnnnnnnnnnnnnnnnnnnnnnnnnnnnnnnnnnnnnnnnnnnnccccactatcagcaaattgattctctaattttgattttgaagcactgcttggtcttgatattacttctttgatgcgagaatatcctttaggagcacatggatcaacaagtgtaccatttttggagtctgcaaccacatgagtcatgataaggcactgctttgaacttcagtacatgcagccaagttcctctaaaagctaattaacgaaaataaaatagaatttgtgtattcatattggtttcattcagagcataaaatgcataaaagaataacaatacaatgatggatgcaagtacataacagctttgatattcaacccagcactcatcaaacttaaaatgtacaactgttgctttgaactatagtcctgacatatttgtgtcactgtagcacatcagaagtagaatagccatagttagtatactaattattgatgttctattggctaacatcagcacatcatatttgttagctgtgaataatattctgatattctcatttctgggaacttagtgtcccttgtcacctagctaccattgtaagggatgccaaatgtctattttttttgctatcctttacattgaaagaataagtaaaagataccttttgaccgcagtatttcacgaaagattcttgtgcagcatttctgcaaaaagaattgaatcatatggtcagcatatcgtatcatattacaagattgtccataacataagtggtgggtgattcaatgtatacaaatagctcacttgtccaaagtttagaaagctgttgctatagagagtatatgttgttccaccaaaagtgaaatttcttgacagttccggaggaagtacttcatcagaaacaaatgtcagctgaaacaataagcaataattagattggcagaaaatcattaatataaccaaagcattaagcgccgtgttaacattgatattcaaatgtggagcttgttctagaatacacatctcangtaanggaggcttttcagataaataactnactttttacctaatagtacactttattagatggtatttatttaaagagatgaacaccttccactttgttaagcgccgtgcataatgtttctcggtgaaatgtttccgttacaaattccaacaatacaaccggaagctaaaagtaaaaccgggggctaatagggagaaaccactaattgtgtggtccctgcccttccattgggaacatttggcccctcttataaattccaaccccgcagggggttggtttgtggtcttctt

SEQ ID NO: 3815 - DNA, 12697 bp, Oryza sativa
  unsure (1)..(12697): unsure at all n locations
cggtgggttgttatttttttcccgaagacccgggggtctccgggggaaaacaagggggggtggtcttccgatattttcagggcgccaaagaggtgggattaaagccacctgatagggcctgatttaaccagaagcctttttttcagtagtcccaagacccggcatggtccgacatggaaaccttttttctttgatcgactgacactgtattccacnatatagttcctccgagttgtttatctctcaatctagtacccttctcgtataatacataggttggcggtatctcatacacccgacctcagtaatagaggtatgccttattcgtagcactgacgctatccttcacattatcacttctatagtacatggtggggagtgggttacgaacaaaaatactatgaatgaacccatccttaatgatcgatgcatgaagttgtctgtctaactcaattgaatttatagagctgaaaacggaaggttggcatttgtcatttggccctaggccatcatgaatcatccaccttaacaactaaacttttggttactaaccccccaatatgaaggctgaccaaatacttctattgcttaatgtgccaccttcctaacttgctctaacaactcaatagacccaaagtttttatatgttgaaatcaaagtatccttgacaacgtagaccaagaacaactatatctttgttatcataccatgcatctggcaagccttataccatagacttccgagagcaagcaagcaagatatacacgaacccacaccatatcacgaaacatattgatgaacaaacattccatgccattctacactgccatggagataaccacacctgaaaccatgtgttgcactagtccctatctacaaatgccttgaacatgtcagaaaagatgccaggcatagttgcataacagatcaggaagggagcacggtggggcagggaggggagggttgcggactgcccaacttggggatcctagggcatcaggcaaagtaggcttggagtagggtagagtctccagtgacgctgatgacagcaatgaacaatgtagccgggcttcttttctaagatggtgtagcaagatgctagtgtagggcaggcctcaggcggagcgggagcaggtgtcgcagtcacgcgggatcaattcagcacaggcacgagaccagaatattcctctttcacgtagaagctatcgatgggggttatagtttagagctccgggattaagggatatgagttgagatttgggtggccttcctattttttaaagggttctctagcaggggcattgttagacctttttttacatcagtcaaaaatatttatgggttatgtttagaggccttgtgtcacaccccgaagttttcctcccaagccaaaattttaatttttaaaacgaccctaagaaaatgcaggtgaaatcaagagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattccagggaaaatcctttttccttttctttttctttttcctctctttttcctcctttttttcgaatgggccgtcggcccattccctccttcctccccctcctccttgctgggccggccgcaggccgaggcccagccaggcccgccgccgccctcctctcccggggtcgccgacaggtggggcccacctgtcgggtccttcccccaccttccgccgctcccggcgcgccgccgcgcccacgtctccgcctcctccgggccatgtcgaccacgcccgcgcgtgcgccgcgtctcccacgcccattcccctctctctcccgcccacgcccgcgcccgcgcccgagatggccgggattcgattttcgaatcccgcctctctctcctcccccactcccccacgtcggccggcgattcccgcctctcccggccacgtccggtcccctctccccctatttaagcatcgccgtcgtcccctctcactttttccccatttcgccgcactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccttcctccgtcgatgttcgtcgccggagccctcgttccctcgcactcgggtgagcaccacctccaccgccgccttcggccatggtttccgatcgccgtggtccatctccctctctctaatccctctcttctccttccttagggcaccccgaagctcgtccgcccgccgacgtcgtcctcccgtggcttgccgtcgccgttcgccatcgtcttcctccgcgccggccgccctcggtgaggcaccccctcccctcttttcccctccctctccctcctagccgccgctttagcgccgccgcccgttagtcgtcgctttagcatcaccgcccttcggcgccgccgtctccgccggcggttgccgtcgtcggcaacgcgcgtgcgcgtgcgcgcgccgtcgccgtgaccggtcggccggctttgtgccgagccgagcctagcctggccgccgccgcaccgtccgatcggccccgggccgatccgggccgtcgatccccgtggaccggcggtggatcacccgcgtggtcccggtccacggtagaccggccacccgtgcgccgctgacatgcgggtcccgcttgccggcgccgcgccccccttgatgacgtcagccctggaaaatattgcgcaataaatcatttaaggatttcttttataggaataaacacagtgaatcttctaaaattcatatctaattcatccgagctccgtttaagcccattcaagtctcagtaaatcaagaaaaatgtgtagaatccattaaaaatggttttgttccctgtttcagtagccttatagcctgtttgcaatgtttgctttgtatgtcgctagattccgattcctccgacgctccggtgtacttcgagatagtcgccgaggttcctccagcagcagagcaaggcaagtcatgcttgtcacttgaacatgttgatcctatattgcaaatgctctattgttttctttcaaatattgcattgttttataatagtatactatgggatggttacatgttgttacagccatgcttttggataccatgctcctttgttagcttgggttataacatgattagactttggactaggaattgcttagccatgcttagttcaactagcacacaatggggaaatctcatttaaaacctagactataggtttataagataatgttggattagtaccaccgctctggtgttggttaaataaaatgaatcacatggtgggctgtgggtgcaaggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaaggatcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcacattagtttagtctaatgaatttggatggtataggtggatggttgggcctgttgcaacgtggtgtagcgttggacagtgaatgtttaatactgcttaattattacaactgttttcgcattcaattcctgtttataaatgccagtatttatgcaaatgaacctgcttagctatcccttgttgaatccctgcatcatacccccattccggtatgacttgctgagtacagtgggtagtactcagccttgctctatttcccccccccccaatcccagagctcgagtatgtgtccgatggcgggttctccgaggagtaggcttcgtccgtgccgtcgaggatgcctgtggagtggtgttcccgctgcagttcaagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttctgggcgtgacaccttgctagagtcgctcttagatggataaatgggcaagacaggtataggcatgaatacacatgcctaccctcttgcatggagcgctagataattggacttagtagcatagggtatggtatcaagattcaacaagtcatgtcacgtgcacatgcacataattagtgaagcccattagcatagaaggccaagataaaactaacagttagtgggatttggattgcaagtgtactatagtgatactatatgttcacgagagtcctgtttggtccatgttaatcagtctagtgcgtggcttgcaggaaagtacgaaaggagtgacaagttttccagtggcgcgtgtctgagacagtgcttattatcgaaaaaaaagaacaagcctggacttagtgcatcatcaattaaggctgagttctttccccagttttcccaactcatcttccttgtttttcatccgcatacttttcaaattgctaaacggtacttttttaaaaaagtttctatacgaaaattgcttaaaaaatcatattgattcatttttgaagaaaataattagctaatacttaattaatcatatgctaatgggtcgttccgttttctgtgcgcaggagatgggtttccaacccaaatcaaccaacacagcctaaatatgagcaataggatataactaggatgtttgttggatgtacaatgacattaagtaaacactagtacagacccctctattggcaccggttggaaaccgaccatagatgttggttttatagtcggaaccaatttaacggcaccacaccaatacccaagggcaaaggtgacggttcacgacacttatagagattatagtggccagttcttgcctaacaaccagaacctatagttttcaatgaaacaaaaaaaaaaaagacagccggtggaggtagacatacacggagcaccagcgctcgcggccggcggcaaaagtgtcgagcgatggaggctgttgcacaatcacgaaaacacctgacaaccacccgagatcccatccaataacatcatccccatatatatatataaaacacgatcttgaaacacacaaaaacacatggcatgaaggcgcagacaaggccagtgatgatggggccggtgccgcggctcctccggcgctagtacccccttcggaccagcggcttggtggcagcggggtcacctccaccaaccaccgctgccggaagggaagaaggaaaagggaagaacaggaaagggagagggaggcagcaagggagtagggaagggagaggggaggcggcaagagaaggggagggagaggggaggggtggcgaacgaagagggaaggggaggatgcgcagcgagggagtggggaaggagcgcgaagaggggagagaaggttggggagaaacaagagaagggggagaggggatcgactgggtgtggctctgtgtagtggataaggacatgcatagtggtatggataagcacgttggctagctctggctcggctcgtatgggtacccattttttaaccggtatttataatatgttataggtaccggttcttttaaaaaataacacctataatattggtgcatgtttttgctccggaagcggcacctattgttgcctaaaagtgctggttctatattttcctgtgtgaaaaggactataggtgccagttttaaattaactaacaccaatgaacctatacctatgaggtgttttgtaatagtgaaaagaggctaattaagttataactcttattttaagagctaaaaggtgaaatttataagaccaaaataaaaggatactaaaataattttgattgtgggaaacaatgtaactagattataaatatgtgaaacaaaattataccaaatcatggagtaaaacatatctccatcaaaaattagttcaaccaataaacggtatgcaaataaattaatttaaaacggtgatataaaagctaaatttttgtatgaacatgactttgacttattatcatattaacggtgaatatatattgggttttaagatggatatcaaagtggcgcaaagcatgactatatggctagtatacagagtgagcgaaaagagggtcagacttatttctgagtatttaactatcctggtcattttggccattttactttcattaaacatttttcgtatctgcctcatgcctcttaattttttaataaaaaatagaagaaaaaaaagaaacttttcaaccgaaacacgcatagatactgtgtgggatcacaaagaatgaaaaccgcttgcagataaagctgcacaaaaccggagggagggctgatctacgcacgcattcgcgtgtttctactgttgcgaacattctcagccacgccgataattggctgtgcgacgctgacggcgttctattttaacatttactagggcagttgaccagttaatccggggaaaaaactcctgcatacatgcgcgtaaatagttggacgatccaaaagaacttttgcacgcatgttggagattagtttgaggactttgtaattaattgggtttcgcgtgattactgttaactttgctatattaaatattaagaaatacattctattatactgaaaaaattcaatggaaaaaccttcttatcaacaccttctagtatttgaattttctaatagttgacatcaaaactttgtactttgataaaatttatattcataaactttctagataaaatattttcattcataaactttatacataaaagaaaacatatctgttgaaaaactttatacgtaaataaaaaaaattagattcagaaattttctacgtagataaaacattttcatttatatactttataaataaaagaaaaaatctattgatgaactttatacctaaataaaaaaattacattcataaactttatacataaataaaaaaaatcatatttatcagttctgacatattcgctggatcggaagttagcgaacgttcgctaactaccagtttggcaaaaggagagagaacagatccaccaagcatatactgtacaatcttgaaagtgatatcactgtgtggtgtgtactggtccatcgtccacatgtagacagcgtgcaactcgagtcttgaatatcgccaaattaacctgcgcttgtgttgatggaggccatgtcgtccacacgaccaaactctccaccgatttcattgtagcctccacatatatagcagtactccgctgcgaatagtgggggagcttttcgcagacttctttcaaaaaaagatattcttttacagaagcttctgggtcaacgcagactggccacagcacagcctatatgagctggaatcttcctgccagttcgtctgagaattacacgcgcacatacagaacaacgcggccaagattacatggaaaaaggttgcacatagggccggtttagttgtcaaaataaattttgcctttacatgtcacattgaatatacgaacacatatttaaaatattaaacgttatttaataacaaaataaattacagattctactagaaaattacgagacaaatttattaagcctaattaatctatcattagcaaatatttactgtagcaccacattatcaaatcatggcgcaattagacttaaaaaattcgtctcgcaatttacacgcaaactgtgtaattggtttttatttttgtctatatttaatactccatgtatgtgtaaatattcgatgtgatggacgaaaattttttgttttgaaaactaaacagtccaatagtacaagctttgctcattagctgtgactacccatgcacaagcttagtaatccctctgtcccacaattactcaaaccctatatttccaaggtggatttaaagagagatatgaatgatcaagatatctctaattaattgtgaagttatatcgatgaataggtaggtaaagggtatgaaagaaataaaatttttagatttgcaaactaatggtaggtaaaagagtaaaagttgatttattttgattttaaattttagaagctgatttattttgggacggagtgagtatatagcatataggaccaccgaaccgcgagacaggcacgtcacgtctccatcgatcgatcgcgcgtcggcgatttgatttagctgcgccttttacatggaaaaggttgcgcatagtgcaagcttagcaatagagatcataacagtgtggctcctgatttagctgcgccttttatatgttctccgtctcgcgcgggcgcatatcgttttcctttgctcgatcggcaacacagtacagcggtgcattattctagctgtttcccccttcctcctgttcggaatgcagctagcagtttggtgcttcacatgctagtatctttgattcctttcgcgtggtcgcgcgtagacataatcattcttaattgatctgatgtacttctctataattttgattaaatttaaagaagcttaatctagaaaaaatcaaagcgcattataatttgaaagggatggatggagtagaatgttaaagtagttttgttccaccaccgttataatatctttatttgttataaccaaattaatagaaaaatattcagtcacaactatgaaatggacctagagacatattgatcgagatggatgaaattgcaagataagagtttttcaggctcaataataatgcaatgtttctttactatatgcatataatctatgcaaaggtcagatgcttaataaaaataatattttctacaaaataaaaataatccaaaagtatttttctgtgacaattaattctataggtcagataatgccacattaaattgtaggactaaaactcttaaatctataataaccagagcagggtgaatagttgcagaaacacctaaatctacatttttcataactaatatttttagaaatttccttgggaagcatatgtaaacgtaagtttagaaatattacttttatatattcataaacaaactgattcatatttaaaattagtgatttgtaatctgcatgcatggaaattaataaatatgtacaaataccattaattttttctactctaaggtcatcttgatataagaaactaattcaactactacaagtccaaaaagtaaataacattccgttcattcagttttcttgacttagtaataattgtgaaggggttgttttttgtaatactccatcaaaatttttcttttaaattttttttttggaatttcaagaaaatgtttaaattcattcaatatctcgtcaaataaaaattttattgagtttttttaaatttggaaatattccattctgttggtccgcaaaaatacctttttttcgcaatttgggaagaaaagtttcgaaatttgcaaatctgttaaaatttagattaatatcattcaatttttcatgttcaattttttgaaattcataaattttccaaaatattttttatttttgaattttgggacaaaaatttactcaaatggagcatgcatgcaacttgtcgtaggggtaaaaacgtcatttgtaaaaattttagatgccaaattgaaatagaaatgttaaattaaattaataatggtcatattgcgttctagcaaattactatatactacaatagaatatgcggcatcagtgtccgtgcgtagtggtgtttggaaaaaactacagcgatttaatttgtttcacacaagctcgtatacatatcgccgtccaggattggcagtatatatgtgaacacgtatcccaagagataaagagaggcggaggtatacgtacgcgccaagccaaataaaatcccgtcaagtcccactccatatacgctcggtcgtttggacgtcgaactatcatatatctccatcgcttttgctattgccagttgacatgccgtcttctccgaacacaccaaacagtcaaacaccgcatacacacgcaagacaacaacatacgttaacgttgtgcctccaatctcccaatcgatcgatcatacattcatactccctatctagctagctagcctagttagctacgtgtgtaccggggagattaatggggatgcatgtaacactcaagaagcaaattagctagggaagatgtgtatctcaaagagtaatagagtggtattatttgcagcacataggctactcgaagctctcagcaattcttagtttcataactactctatatggctgtgttcggcagcctatgttaggaacacattttctgcacacgaaaaacggagtggtccattagcgtgcacgtaattaattaagtattagctattttttttaaaaaaatagatcaatatgattttttaagcagctttcgtataggaactttttttaaaaaaaaacgcaccgtctttagcactgtgaaaagtctgcgagcaaaatacgtgggaggtgagttgggaaaattggaggaaagaacacagcttgtatatgtagttctctgcacgtgtttgtgtctatttaacgaaatatcctatagatgcaagtcttcacatgttacatacacataacatgtacattaattaactaacaaatattcacaaaattctaaaaaatatgtatgtatactttcaataaaagaatttgtaatagtattatatccgcatatgaaataccatcttcaaattcatcatacatggaaaaaaagacaacattttgacaaatttatagtcttaaaactatcagaattttttttgttgtcacagccaaaatataatgaattaatttgtggttagttttacacataggtgtaatactatccatagtatatgcatatatttttttttataattttagataatatttattagttggtatgcacggagtgtgctgtgcacaggatatgttccccccttactataccaatttacatctgacatagctccatacatattatagtatggtaatttttttggccttttcagtacgatgagtgtagctcaactgattatgttccttgtgatggaacctacccacccaaattcaagttccagacttgatatagatgagtttaagtcctatacttgacacgactgctcgcatctatggctaattagctttttaaggataggcaacttaccatcggtgattttatttgggtgctcgcatttacggctaattaggttttcagtgatagatgacttacccgtgggttcaagttttagacttagacacatgtgtttgtatgtatggctaattatattttcaatgatagacgacttacccattaattgatagtgaggccctattgatgacttcgtcgattttaaaatatgcgacatgatgactttatcaattttaagatataccggttcagtctttagatatgtttataaaaatatccgcgtatttataagcccttggatttgtagtatgttttaaaaaagaaatattttatcaccaacatataggaactggataaatctacgtgcatggtgcatctatgattggtgtagagaggaagactcgtttagcagtgtttgcagtttgcataatgtatagtaaatactcggtgcatatatatgcacgcacacgttttgatagctagtatcttgtagtttagcttctaggaaaaatatcaatatttatgggtggacgactgaaaaatgcttgagttgttctcgctatggtataaagtctgcaggtagcgcgcgtcgtctccagtccagtgaagaaagctcacgcacgcaacacgcacgcacccctagctcatgtgcaagacgagccggcgagctgtatacgtagcagctggactctggagaagcatcagctaagctgtacgtactactgtagttcgatcgatggatgctggtaataacgcaatcgctgcggcgtccttcgccatcgtcgtccttgtcgccgccgccgcctcgtctttagcggcggcggtgccggcggtgtacgtgctcggcgactcgctggcggacgtggggaacaacaaccacctgctgacgctgctcaaggcggacttcccgcacaacgggatcgactacccgggggggaaggccaccggccgcttcagcaacggcaagaacttccccgatttcctcggtgcgttatcgtcgcaaggcccccacccccctcccccctttcttttttcttctcttttttttctttctcctccctcttccnctctttcaatctccccctttctcttntttctttcctctttttttcttctattatctatatatattaccctctttatttctac

SEQ ID NO: 3816 - DNA, 6479 bp, Oryza sativa
  unsure (1)..(6479): unsure at all n locations
gagaaatgtgtcaccaaagggtatctcgcccaaatctttttattacggtgcggaagtagagcatacagaaagcgcaaaaaaaaagggggttaggatcgtgaccaataagaaataatgtggtataggaggatcattttttaatggttataaatatgagggatataccaacttgaagatatatagcgggagagaattaaaaacgagcctaaactgggaagaggtttcattaggaaaggacttgaaaggcgcaacgaaaccttaaattagttttgtatccgccgggtaaaaccgggtttgccaggttttgcctatcggaccccccattaagagagacaggccaaatatttaatttactttatttttctcacatcccccaactttaaaagcatttttggcagccaaaggaaaagagggaacaatcaggccgtgttaaaaaggctcttgggggggtcgaatacctgccgcggcccaaaaaaaagccgggaaaagcgttttcccctcggtactaaaaggttgtgcccggggtcggcgacctgacgcgggtccagaaaaaggaactgccggctatcaaaggagaggaaaactcgggggggcgttcttcttggctcaacggaaaacgggcgccgccaatgaaagggatagccgggcaccgggggagctcggccaaccgtagttggcgcggactgtcgcgttttagccaactggcacggattcacgcggttgaggaaacatcggcgtgtcggcacggcacagcttggcacagcgccgggatagggtcagcggtggtataagaaggggagctcggtgtggaagagaagtctgcccaggcggggcgtggcatgagacagcggggcggtgtctgagcgcgtcagcacggccgggcgcgcgcacgggaggcaggcggcacagctcaggagaaaggtggtgcggcgcagtggcttggccacgcgcagctaggaggcgacgccgaggggaggaaaggaggaagggacacgcggctgggaggcaccgcgcggcgtgtcctcccccaatcaccgtcgtcctccctccctcccgtcaacgaggctttggctgccccggcgacacctcccccctcgcgcacctcagccgcttccgcatgaatgacgtgccgccctcctcttcgtcccaccactccggcggtggcccccacatggccattgtcgccgtcgagctcgcgttgcccagctcgagctcgccccaccgccccgctgccgtcgtcgagctcgggcccgccgacgcctccccccgcacgcgcggccgcggtcggcgacccctcccccgggagcggctggcgacaccaccccccgtgcgcgcctcggcctcttcgccccaccactccggcagtagccctcacatggccgttgtcgccgtcgagcttacaccgttgagcacgagctcgccctgccgccccgctgcagcggcttctctcctcccgccagccgacacccgcgcgccgctcctttctcgccggccgctggccgcgcacgcgcgccgctcctctcctcccgtcggccggcgcccgagcacgcccgcgccgctcctgccccgcgtcccctccgaccatacgaggtgaggaaggagagaaaagatggggagaaaaaaaggaaaattaaaatttgtgccatgtcatcgtctacgtggcgtgccaagtaggcaagaccacggtcaaacgcggctttggaccgggatgatacaataaatcaaatttagggatctcgatgtgcgctttgcaagttcgtggacctaagtgaaacatcgttacaagtttaagtaccgctagtgcaatttactctatgcggaatctaaagtgaatttttcctgccacgttttgagcgctagtatccctgaaagaaaaattgctgcaccacaaatcttctcgtcttggtaagtactatagctgtctgacaatcttcaataatcacttgttatgattccgaccccaattccaggtgaatttctgatgaacttcaacaatcacttattatgaatttgctatattatatgattctaccgctatatgtaccaatcgtaagtaaatacactagtatactttacatggtatatagtagtatatttctatggctgtacttgaagcttgaaaaaagtggaatctcacaagcagctcgatcgatcagtacaccgtgaagatgagatgaagcctacatagcagcgagctgcctaatgttcacggggaagacgagcggcggcgagccgtcgaacgcgacggcggtgagcatccgcgcggtggcctcggtcgggtggtagaagtcccagaacacgtagcccgtccggttggcgcagtagaagctgaccggggtgcagccgatcttggcgttcatgtccccgaggccgcagcacgccgcccgcgcctccgcgaacccgtacgccgccggccgctcgatgtaccggagcagcgccgcgctggagtcgaacaccgcgtagcggaggcccgcgcgccgctcggccatcccgcgcagcagcgacgccgccgccgcgttgtaccgcgccgacgcgtcgttggcctcgccgctgcagcccctgtcggcgctcagctcccgcagcgacgggcagcagcccaccggccccgtccccaggaacagcaccctgcgcgccccgaggtcgtacagcctctgaacacaatcgatcgaacaccattagaacgtaacaccatgaaattgatcatttgatgatcgatttaattatctgtcgatcggtgacctcgatcctcacctgtagctggccggtgagcgactggatgagggcgtcgacgaactgctccatagggttggtggccttggcggcggcgctggacctgacgtagccgatgatgtcgttgctgccgatggtgatggcgaagagggatttcgccaggtggctcgccgcctgggcctcgccgaggctctgcaccagcgacgcctgcaccttggagtagtactcgatctgcttgtcgaagctgatgcactgatcctgcattaatgtttaacacaagtaattaaaaccaattttcaactctaaaacaagttgaaaacaaattgactatatcactgtcgacagaaatatgtaaaccatttgtattatttttttaaaaaaaatgaactttatatatagtgcgttgacgactaacatgcatacatataatcctacgtcctggtaatctatgagaaaagtttgttattgcaattacgtgtacgagttgaaactaattagaactaccttgtttgtagagttgaaaactccggcgccacctgaagcaaagttgacgccattcacgtagttagcactgctgcttgacgatatggcgaggtacggtggagatgtcgccaacccaaggttctcagctgcaatgcaccattcatatcaaaaatgaccaagtgataaattaatttatgatcggatacacaaggatcgggaagcttgtaataacatgattaaattaacgtactatatatgtaataagcaggttcaaaattacggactgaaattttcaaaattttgggtctatcgcccccctcccccccccccccccccaaaaccaaaactattccacccttttttccattttttgtgaatttggcaaattttgtttaaatgtgaccaaattttattaaaattcaaattatttcagtacctgatagaaaatagccaaaataaaaatttgaaccctggtggttagtatgtaagggctaagctgtgtagaacgtacgtatgtacaagttgaaaattgtaattgctaatgcacatatatatatttcttgtttttctgacttttttaaaaaagctgtttgctagttgtcctctcacacccttcttttttttctcgtcaataatgtagaggtccccttccaaaatcgaaacttacatatcttttatggactaattcatgagaaacttatgcctctagcctattggagctccaccatatggcacataacctatacatagaaggtcaatccagcaagcttgcaagagataaattaaagaaaacagtgttgtagccaaactaaagaatgataaaataaaattccaaattaattaaccacaacattttttagaacaataataaccagcttgtcaacatcaaataggtaaatcgcctaaatccgatcctcaaatgtagaataattaaggacgtacacgtatggtaatctgacccacgaaagtgaagtagagaatgacaccaaatttgttctcaattgattggcttcgccaacggacaatttccatttcactttcttgggggaaaaagttatggccaggctgaaaaggacatatcggaaaaaccctttggctagatatctgatatctcatatgatgtgcttgacctatcattcattaggtaatatgtctccagttatctttaaaaaatataatttgtctccacctaaatttatagctaccaaaaaccaaaattaacaaaatagagaaggcaatactatggtgtggcttcacctagtaggttgaaatctaagtgcacacgaatatatggagaaactacaaactatagttcattatagtgtacatccaactattgcgtgaaccttaaaatttatatgtgtctatatatttttataggtataacaaccaaggaaataaacatatcttgagcgtacaagcaacgtcggatgaacacgtacagaaattgattacaagctgtatggaatcatcaacaagtagccaacgtgcatcaatcaacattttgtcattggttctcaacgaatttagaaaagaaaataaaattactccctttattttataactaggaaggaagcccgcacggtgcgcgggctttttatttattgttttatgaaatagtgctaaaagaagtcatatctcaccatttctacgtcgtgagatagatcgtagacttcaatatagttaaattataagaatgtctcccagaattaaaaacactttgtcccgattacatataaattttcctattatcgtaacaactcattatcactattttaaaagctcgctaactaccaatacatgaaattgcgcataataaaataagcctaatatattattaatacactacttagctaagtgtttatgtctcacttatttccaaatccacatataaatattctaaaaatatcactaacgggtgaagccggtcatagccgtagagactttctttctctattaccttgaaaattgggtagttgtgtcccctcaagatcagcccgaagcacaattttaatgtctaatttactataaccctttcatagagtcctatgacacactgggcccactcaactcggccatttgtatgccacgttagagggtaaataacgggtccaccaatttaaatgaaaatcgatggtgagattatacagtaccatgtgatggcctaggagcacttatagcagcgtcatatggcgacttaggaatattaatagaaagtttaatgaacgtttagtatataatagtttttcttgctgcgaatagtagtaccgaagctttatttctttttcaatctaacgtacgtttgtatatgtacttatgtttttttcacggttagtatatatatacatctaatctaatagtctaaaataacgggtccgctaatttaaatgaaaatcgactatgagattatacagtactacatggcggtctagaagtatttgtaggaacgccacatgaagacttagtactgttttgtagatcacaaattggatatataatttaaaaataatttgaaaagatgaacatttaaagatggttgatttgatatttatattatagatctagtttaacattgcatctatatatttgtgaagtaatatatttcatctttatatcgttgatagttctattttaaagaccgtggttttttttgatggtactaagtatttatattttattttggcttatggtaagtacgtgcatatatttttttcttccggcaaacattatgcacatgagaaaggtattacatatttaatagtaaaaaataacaggtccaataatttataaatcgataatatatatggataaaataatggatcgaaaatcattcaattgcatgtatatatttgtgggccaatatatctttatattgtagagtgatatttgcttttttgatagtcgtactaagcatgtatgctttattttggttgtggtatgtacgtacatacgttctattcctccgacaaccagtacagagaaaggtattatatatatatatatatggatataatatattanctgaaaatcgacggcatgtatagatctaatctaacggtataaaataatgggtccaccaatttaaatgaaaatcgacggtgagattagattgtgccatgtagcgatctaggagtgtttgtaggagtgcccaatgacagcttgagagcgtttgtaaaaagtttaatggacttttagtatataatagaagatataagtcgtttaattttttttgatganggacttgcagaagacggaatcaaagcggg

SEQ ID NO: 3817 - DNA, 1526 bp, Oryza sativa
  unsure (1)..(1526): unsure at all n locations
ncgttttattttttttcttagtgactaaatttatagataaatttatagaaaaatatagtaatatttttaataaaaataaactttgtatcaaaatatattctatgttaaatttaataaaactaatttaatcaaatataaagaattttgactaagaaaatagtcaaaatgattataataagaaacaaaaggagtgcatggaaaaaatatatttttatttatgtcaatacaagtagcatgtcacaccatgacagttcatggaagatattttatttcagaaaaaataaaactctgtagaagatatttagtgccgaaccaactagagccaactggtaaaatctatgcgttaccttcttggttgaatttgcctagacaacatgctgacttaattagtagcagtagtcttgttgcctttattttaagcacgtcctgttaagtacgtatgccaatagtacgtgttcagctagcctatgataaaaggttgactatataccgttggtacgacgtcaacggtagcacacctggtgctgttaattgttaacatacaaaattcaaattacgccactaacagatattatagaaacgtatttctacctgccccttccgtctaaaaatatagctatttctaactggttacctgaataaatttgtgtcggagaaagtagaatcagcaaacttaatcaattaaggtcagcctgcactgctgaacggttggtcatatagtgtgttttctttttaaatatgtggcactgctattaacttctctaataaaaagtcaacacataatatatacttactaatgtatacttagtaagatacgttggaccattcatcttgttaaaaaatatgtaattattatttattttattatgatttaatatatcatcaaatgtttttaagcatgaattaaatattggttatgtttgcataaaagttttaaataaaagaatgatcaaacgttgataaaagtcaacggcgtcgtactttaataaaaccgaggtagtatatcggatgagtagcaaaacaggaaaaatcaagaaaacaagtcaagctaggcgtgaaagaaagatcgaccaaatgcaacgtgactacgcgagacccngcgcgcgtgtttgtagggcgagacngcangccgtacagcaggncaaatcgtcgtgtgtgtgcgcgcttgtgcaacgtcaactcgacgtcttgcgtctgggcacgcgcgctatcgtctcgtggcttaaatgatcaattgggtgatactatataagaaacatttttagattcaagctattatattaatcagaaacattttgtctgttaatggnactaatcgaactcggggcgtaggtatcgcacatcttttgggtagggattgacttagactcgtaggaaacaaaactctcaaatgttagttaaattaaaacttccactaaaaattttatcttaccaattaatttaccttgaacctgttccacttttacctcccacgttcataatccccattttagctggggactatgacctttattgtgaaaggaatt

SEQ ID NO: 3818 - DNA, 5637 bp, Oryza sativa
  unsure (1)..(5637): unsure at all n locations
cgcgcccatgcaaccncgttagaanaacttgganttaccgttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttataggattttctaggattgtggatttgatttgtggcgcaaagggagacttggagtccaagggaagtggttccctttagactattgcagttgcagtccacacaaagtctcgcggtgggagcgcgcactcgaatcatatcattttcatgcggtacgtgtcattgattaatccatctcgcgcccactaatgatggatgatatgactgctatggtaatgctgctcagtgcaaagttagctataacagtaacacactaacggtacgttagttaaaacacctcatattctctgtcgatcatgcatcgtatactggacaataaacacgatcatgcaacctaatgggaaaaagtgttttcatcgttgaagagaacatttcctcatttttttatacctttcaaatggttatcaaactttatttttttaaaaaaaagactcaaagataaaaaaacaatttgatacgacagatcaatatgaaatatgtcacccgcaaacatatctaagttaatttttttattgttggacatgacgagtctattgatcatcctgatgccttaccctgaatcgttgtatggctaatcgttaatgttaccaggcgtccaaactgcttccctaccacggcgagctccttcatgcttttggtggtgcaaatgcatgaaattatgatatttattttttaagaataaattattaaatacataatctcagagttgaaactacacatcttaccgctgcactatcaagcacatcacataaattgtagtaactctcccctcccaaacaaaatcttaataaatacagagatttacaatgcttttgcgcatcgtcgaaacaaaaaaacataaatgaggtaattaaggctttctttgaatggaggaatttagatatttttttctcctaaaaatcaaactaatttctaataaaatagccctgtaaatcttgtatactccctccgtttcaaaatatttgacaccgttgactttttagcatatgtttgaccattcgtcatattaaaaaaatttgtgaaatatgtaaaactatatgtgtacatgaaagtatatttaacaatgaatcaaatgatatgaaaagaataaataattacttaaattttttaaataagatgaatggtcaaacacgcaacggtgtcaaacattttgaaacggagggagtatttactatctccgtctcaaaatataagaacttagaatcggataagacattttctattacgactgtccagattcgtagtattagaaaatatctcatttaattttagatttttatattttgagatggatgcagtaactttcaaaggagtcacgtttggttgaaaattccacgccattgatcagaattcagaaatgcttggggagggtctcttcaggcagggtccacggtctgcaccagctcagcacgagcttctggaagacgtgcaccggtgcaacaccccctttataaacgccgctctctgactccatttcttatccacccgcgtcgtcgcctctcgtctactcctcctcctatctctcaattctcattccttccccctctcctgccaccatggaggagaggattccagagccgcaagatcccaccgccgacgtcgccgctgacgtgctgccggcggaggcttcttccagcgacgtgacgacgacgggagtggaggaggaatctgattccgatggggagttcgagttcgagttccccttcgtcagcagggactcccccgcgggcaccgccgccgtggccgacgacctgttcgccgacggccgcatcaagccgttctacccggttttcggccgcgccggcgccggaggaggaggcgatcgccagcagcatctggccaaggacgacgctgcggcgacggtgccgccgcggacgaggggcccgctcgggcggctcttcctcgaggagtcccgtggttcgttcgacaggtggtccacgttcacgtcgtcgtcgtcgtcgtcttccgcgccggcgtccgacgagggcggcctggacggcgcgccgccggagagctactgtctctggacgcccggcgccggcgccggctccgcctcggcatcggcctccccgcgcccgcccaggaagagcggctcaacggggtccatggcgcggtggcgccgcatcagcgagctcgtcgtcggccgcagccacagcgacggcaaggagaagttcctgttcctccccatcccgccgcccagtagcaaggagaacgacgtcgaacacttcaagcccaaacccaaaccacccaagccgacgccggcaagcggccgcaagacggcacaggccgccgccgcagagatcgacacggtcgccgccatccacaggatagcttacggcgctaagggcggtggcgccaccggcaccagcgccggcgggggcacgccgcggcggacgttcttgccttaccgggaagagctcgtcggcctcttcgccaacgtgaacggcatcagccgcagccacccgcatccgttctaattaattttacagtgtttggttctgcatatattgatagtcaattaatcacgtgattaggttaattaattacggcttaatgtggactatgaacagtgtgaagtcagtgacttaactggcctttgtctttctcggacagagtgtgaacgcctacgggtggcgcgagaaaaacctccattagacaaggttttgtacacccgagtttgtacatgtgcaatagcaaattcattaattttgtgagagtgacatttttttattttccgtaaattaatatttacctgtttttactatattctttaataaattatttctgatggatgatgcacacgtggtgatagtactgttggatcactgtgtagacacacatgatacatactttgagcacggtgcgtcctgctactttaaaggaaaggtagtaacagctaattacgactagctttagggctggaaacgaacgagattaattagcacaaagcgcgacacgtgtgcggcgccggccggccgaggtcccgtggatgcgccgccatcacgagcggcggcggcggcgccaggtggccggccggactccgacgattcgatcggtgctcgcccaggcggtgcgtgcatataggtggaatttttgacctcgttgaaatggaggatagttttaaaggaatagaactggacggtgcaaaaatcctgtaaaatttgtgatccagaaaaaggccttcatgtctttcttttttagtaatcgagagatttttccaacgagacctaacctacaattgtagcattgagatttcaacaattctgcacattctaactcatattcatgatgcctaatttatgttatggttaattaacaaggagaaattttaaaaagtatttgtagtaaatatcaaaattttcagtgaattctacactagaaaaaaggcatataaaggtatcgagttttatagaaaaatacagtgatactttcttataaatggtaaaaaaaaattaaaaaatcagatacaaaatatttgccttgaaaaaaaaatcagatccagaatgtgtagcagtgcttcgtgattgattcggtgcttgttgcttaagattgctgcagacgtccggtaagatatatgcagttcgctcgttcataattgggatcatgacagcatagggacaaacgtacggaatggccaatctgaaatgggcaccaccgatcgaccgacgattgctaaattaactggacaccatgatgaaaatggctctcctgttctatcgatttgaaatgctggtgttcgatccattttgtgtatctttcgtgtcaattctccgcgactgtagcagagcattcatacatgagagcagctgattatcacgtgctcaacgatagttacatgaaaagaaaagcacatgcagttagaacatataactggagtgatggatttggatggagaggttaattatctctcatctgcttgtttggtttttcaaacttctaatctgagatgagatgcggtaacttctagctgaagcccataatctatttctctgtctaattctacttgtctacacacctttactgaatttcctgcattccaatatttcctcctgtctgaacttcttctccatgttcagaattactttttcagagtttcatattcagagaccaaaacctgtgcccagaaactgcattcatttcaggtagcagaaagtcagtaacattgggtgagatcctttgcttgagctgggaaacgtgcctgatcgggctcaaaccttcaaccatttccatttagttttcgcgtcgcattctcgcaggaggaagcttgatcggctagcgtgatgttgttttcgggggagtaaaacgaaacagaacaaaaggaacaaaacaaaagagccagaaggcattgcgtcgcagtcagtctcgtactcctattaaaactgtgaaaaagagactgtgcgtgcctgagctgctgaccacttggccgagcaaactccacatttttgcccaggagaatccggcgccggtgagaggaattatccatttgatctcgacgcacaccaatagcccgtttatagtcatctgttcccgtcaacttgttctctggattgttactagctcacaccagtgccatcagcatcagccatgactacagaaaataacccctttttttccatttaaaaacctcctgcaataaaattttaagaacaaaactgtcatatatctaatttctaaaaaagaaatgttactatacttaagagataccaagaggtaccgagaggtatcaaattttgatacatatatgttggagatatgggcccgggggtatgagaagtagaggggaattactttccctttggccacgtgactctgcaggttggccccactcacgcgacacgcgagtcgtagaagcagcgcgggggggggggggggggatgtttagagaataactacctctctacaaattgtgggtcagattcggctcaaacatgatgtctgagatcacgatagaactcaaattcaatcatgggcgggttctgcatgctaagaccaagtttactctgggatcactccgaccttgaaagggccaggagcaccctatgattatagcctagaagcttcatgcacatcgaactacttacgaatgagactggggatgcatctcactgcgtactggactgtaagagtgtgagccttccctaccacactggaggaaatgattgcagttgctttctatgacacaaacgcaaaagggtttatcactgccacgcttgtcgtgcctcgcccaacctcgtggttttcctccctaccctgcatgtcaagcaccttatcctagaag

SEQ ID NO: 3819 - DNA, 3349 bp, Oryza sativa
  unsure (1)..(3349): unsure at all n locations
cagcgttttgaagcgcgctctgcggtagttcatcaagctaacgaaaattgggaggtcttttgtgcctgctaaatctgattccaacaatagggaagtacgcagatcagtgagctcagagaaagcaggttcagagaatttcagaaaactgttgcactagaaattcgagctttttggctaagtatatgttgaaatagtttcccagcatgttcaattccatcatcacgtgcttttgcatttacgactttgtcgaggcagcatcatctgtgtgagcttcagaacctgcaaccgtttcttccagcaatagtgagtccccttgatttgatctattctccgtttcagtaaattggttggcgctgtcaagttgaatttctgatctcgattcgatggtgtccattgactgagatttcaactcccagatggaactttcttgaccctgcttttcccatggctgtttaccgacaaaataaacgtgagtgaactgtgttgtccgaaaacagcctagcatgaagttactctaatttcagcataaaatgctggttgtagtccctacgtacatgtacatactttctatcatgctaacaaaagaactacatcctatactactaaaggtttgtttagctggaaatgtaaaactacaaaccttgggctttggtgccatgcgggattccgagattggttgataagggtttggagggtcatcattaatgtcctatattgaaacagaaacgataaggtcacaaagtcaacttgacaagcataaactcagatatacctgtatatcatctggccgctctcccctttgtatcatttccatgatctgtcaagtgtcaaatccagtatgacagttaagagctaatttttggttcagcaacagaatctgcatactttaatattccttactcatcatcacaacattaaatccaaaaaaataataaaactttctggctgataagttgtttttgtcctaatactttaataagagcacactaaaattacttgcaccatcatacaatagataatccccaaaatatataaaacatgttgatgagttgccctccaatgtccagtatatggtacatcaaaagaaggaagaaaaatctactgtgcatgccagcaaagcattgagctgcacttagcgattaaagtggatgaaggagtgctcaagtttatatctaaaactattaagaaagcgcacttcctagcaaggtagtcttgactcttgaatgacctttcaccagcacaagcaaatgtaacttgcgttcacttacagactactagaatcatagatcgtgcaacacgatacagtcagtaacaactgtacactctaaacttcattggtaaatattcaagtagcatgcttaggagtaaagaaaaacacatcgattctacgctcatgctagagtgacaggaaaaaaaaaaggtgatgctcaatatagctgacctccatatatgattttgggtggcgaggcaccacaggatccacagattcagtttcaggctcaggtctccctataaaagcaagaaggaacaacagaattagaaaacatggataaattagtcaacatgactcatggaaaggcagcatgagcaaacctgaatcatcatccatacattttgtaactgttgaaggattctcctgtggcaaagagaaagggataacttaaagcttgcaacataaacatcataatgcatgatcgataccaagtgtggactgaaaaaaacatttttctgtactttttagctgacctgtgtgatttttgaagaatgatcagatacccctgaaaaatgaaggaaaacacaaggcgatgtcattagacatgtcttgatgaagccatttacactttagagcaccgttgtgcatatataaacctaaagaggggaagttcatttggagtgaccaatcacacagaacaacaccatcacctaatcaacaatcttgacaggtgaccacagcataccttgatatgtgcaataatttggactcatggagtttgaagatgggctctgaaaattgcagaaactaagttagagaaattaatcaagtcagaaccaccagtgattcacccctgctctgaaaaaaagaagagccgacaaggcagcgaaaagaacaaatcttacaagtaaacgtcgaaatgcctcatcgatttcatccacggtgagccctttcttctcaaggaaagaacgcctctggacatcagaagaggccactacctttgggtgtttcagaaaaccgaccgcgctctgaaccagctcctccctcaccggttcaacggccgcaacagcctcctttcctgtcgaatctcgcaaagaagtacgaacagaagcatctgagcttcctcgacctagagccatggcaagcatggagttcatcgattaggtatcgagctactgattttgcttcccttcacaaatcacaaccctaactacagactaactagagcttcactaccaagtggcgacgaaagcaagtaagattatggatcgaacctggatcctgcacctcgtcggagaggtgagtcgccgacgaatcctccatcccgacttccggggagccaagcaccatgggttggataagaattggagatcggaggagagtaggaagacgactagacgaaccgaggagaggagcctgacatgtgggcccatttatgtgggctcagacaggcctggcccatagccgcaggcccacatttgtgggcctacatgggccgggcccatggttgcaggccaggcttgtttggcaagaaaggatgggggaggacgcgggtggcgtacaaggccgggagagatcaaccgcgagcgcgaaaacgaaggcgaaaaggaaaaggaaaaaggacttatcagcagcggcggccgcttggttagtttggaagcgagatcgatttgcaggggaggaggagcacgatgcggcggtacgacgagatgccgccggcgatggtgctggtgccgccgcccttcacatttaccgccgccgccgccgcaccaggtcaccaacatctgcgcgatcttctactactcagattgcttgcattcatcgacgaaattggttgtcttttttatggagcctgagtgtgggtggcattgtttgggcaggatggcggtgccggcgtacgacgtcatgttcgggaaggttcagcggccgagcctgtttgacgattacttcgatcaagtggagcatacctcaggatgatatgttagccactggtgatctcatgtgattgacgccaagtaccatcgaacatgacttttttcgtntgttagcattgtgagatcttgatctggttcctttttatttcggtgaaattttgatgaactactgtaccatctngganttcaatnntcaaccctg

SEQ ID NO: 3820 - DNA, 10140 bp, Oryza sativa
  unsure (1)..(10140): unsure at all n locations
agcttgtttgacgattacttcgatcaggttgggagcataacctcanggatgattatgttgaggccactggttgattctcatgttgatttgaccgccaaagtatccattcgaacattgactttttttcgttttgttagcattgtgatgatctttgatctggttcctttttatttcggtgaaattttgtgcgaaacgtggattatcaataacgtttttttcttctctgtttgttatgatgttttaaccggtttttttttcctcctacgttattgcaatgtatttttttttcttaactcggctttactagatgactacaacgggtggtgaggctctgtttcgctggcagaggtggttattattgcatagtttactaaagcttcattatttccagatttctatgccactttgttactattctaagcatttactctaaacaaaaaatggctcaactgaattactttacagatatttggatgatccaaatacctttatggaccttcatttgtcaacaccaaaaccgtaagcattttcttgttggattgacatttatgttgaaacttatatcctaaatggtgcatagataatgttgatttcgcttataacttttttatccagcatggtgcagctgaggtcgtgtgcttactatcctaagtatcgaattggtgcatttggaacattccctttacttaaggcaaacaggtaggccatatcttgtttatggtcgcagatcatgcataggtgttatacttttccactatatgctaccaataattctgatattctcattattgatttctatcaatatgcattgaacccataaaaatgacatggttaaatttatttatttatttatttgtagggactgttcagaaggagattatggtattatgggtttaagatatggttcagagaatctgtctattggggcatcctttctgccgtttgcttgtatgtaattactcatagttctaattctaacttatttggacttggagaatgaaaataatatgcagccaagtagatcagctgtctcaattttaaatcaatatgtttaagtcaagctctaatgatattcttacatattgtcacaacataatattttctttgcagtatctggtcaagtaccctacggtgcatggttagttggcaggaaagggaatataagcgcagggatacaatacaagccactctgtgagtgcgagttactaaaccttaacggatcataggaagagtagcctaatgaaacttaagaattttcccccttatctctcatgagttttgaggcattacatatgcttatatgttaaaaagttgtcctttccttgcattcaaataaggccttcaaataattagatgttgatttccccttttataaacttttaaaagtttatggcattatgttgttgtatttgattctctctttttcattcataaatactctagcaggtgaaagcatgcatcctgtgcctttgacagacttgaagaactggaattgtgcaattagttatggtatgggctcaactagcccactcagcccttcattcaatttttctctagagcttgtcagaaatacacaggtttgccattattgttctcattatttgataacagagcttcacatagtttgtactatattgcagttgttaggatattttgacaagattatcgaaatagcatgtttttgatggataccttgtgcatgttattaaggcatcttttagttttagttctgccgcactaaaaatgtgactattcatgtcatcagtctcagtatatgtatgcacatgtgtttatacacaagaatttcatatccgcacgattatctatacctccatgttgaataacgaaacaccgaacaatgtcatgaaactatgggcataatgtcttggttctttctaaccttgactctgttggaaaggaagcatgatctattatctaaaataacaacaattatatttgttcgctgctaagaaaaacttgataacctgccgtaatttgatcttatctcaatctcaattgcaacaatatttatcttttgaatctcatgtgtgatgtcattttcttttccttgatgtgcagctagttgcatcgttctatcagcacttcgttgttcagagaagggtatggaatttttaatttagtctatgttccataaaaatgcttcatgttttctcaatttatttaaaggattacccattctgttgcgctcatcaatgtgctctaggttctagcagcatgttaaggattagcttatttgttttagcactattctttctaggatgaaatgtaaattgttgtatactgtgtgcacctgaccaaataatttccatccttttttggttcgatgcatattcagattataagatgtgcatgcaggtgcatttcaatggagaaagaagaatctgagatagcaatgccactttacatgttttcaaaatagataattttgcttactatattccctcgtgcatactgttttagtacccccccttttttttttgctttcattatctttgcacctctaggaagccattgcattgtgcactcttttcaaaaaaaaaattgcattgtgccattatgatacaactaaaaactatacaaaactgatattataggatataggacactaagttatgaagattcatgagttgaaacgctaagttattttatttattaatcattttaatgtaactaggacatattgaatcttgacaacaatctgcattgtgtatgtctaattgtctattaggtaatgaatccccgtgaagaagaacacattatcggaaccacgaactttgttgactttgggcttgagttagccacaaggtaaacataaaaattaagataattttctgaattacgcatcaattatattaactaatcccttttttttgagccttagcttggataaagacaaggcgaaagaaaatgctagcaatccctcattccaggtagctgcaagttggcaggctagtaagaactttctagtaaaggtcagttatttttcatatcatttatgcattaataaaataaaatttattagagaataccttaatggatgaaggaaatttcaaaaaatctattaaaaagaaaagaggcggctcacatgctacttggtggcaaagttttgtaggacttctctgctaaacatattttaaaattttcttttaaatttataataaactagcatattactcgtgcgttgcaatgagattttaattattaagttatcattaatgtgttattaccatctcttaattattgtacatatttgttactcacgtgtggatctttttagcttcacactctctcacaaaaagtagagagttggtggaagtagttgacatatgggtcctctaacccccatatgtcatctctttttcttaaaaaaatttgagagttgatagttaggtggtggtggtacccccactactcattttataaggattattgaatggttcacaactcacaaggtgtattgagagtaaagatgaaattaacccttatgcttaggttggtatcttcattaatcatgtggtgacactatttctattttctcaacagggaaagttaggtccctccaaatcttccatggctttggcaatgaaatcttggtgtagaccattctttacattaagcttcacaggtttgtacaccttctaattttagctagcaacaattttatttgcaaggggaaagttatcacaacaagattcatggacacttcaacattaaattacgctttaaaagttctgtgttttttttaccctcacttaaatatctctttttgttcccctctattttggtttcaatgagaattttatgtttcccaatagggagatagaaattctcttttaatattagcaatttatatttgaaagattaacaatcgaagattcgtaatctaaatatccccacatacccccccttttgtttctcttacatcaagtgctatagtattcaagttttttctcaataagtaaaacctcatatttgggggtttgagatgctcatatattatatgtggctcgttataataggaaatgatgttgtttaaattgttcataatggctccataatatttctttttgcagctatgtatgatcatttgaaggggacaggatcatatggatttgggatttccattgaggatcttaaagagcccaggtttttttttatctaccacaagataatattgctaatatgttacaatattgataataatatttgctatcttattgggatgcagttatcaaatggcttattcgaactatgtgattgtcacacaaaacaaagaggatgtggaaccccggtttttaaagaagctagggaagaagtacatatttcagccggacattgattcaggcaattatgacaatttgcctacagggttgaagccaatagacaagatattgtaactatattccaatagacaagatattgtaatcatataatttccattctttggtgtaggaacttcaatatagcttaatgtctcgttttactttttttttaaaaaaaatacctgcatttttttctcatagtgaatattgtggcatttttctatgagtatgtatacacaatgatacaaaatgagacattctctacgatatggtgggaaagttagccatatctgcgatttggtaagtaacaaacatcagcacttatttagttgattgattatagattgattattataatgtcttgaagcaacacgcaagtagagagactgaggttcctttccccttcccaactccccctatcgtttttcacgcacatgcttttcaaattgctaaagagtgcagcttttgtaaaaagtttctatacgaaagttgcttaaaaaaatcatattaatctatttttgggaaaaaaaattagctagaacttaattaatcacgcgctaatggactgctctgttttccatgcgcactgtgttccggttgtgaacctcccgtaacgaacatagctctataccacatttgttttttaaatagatgacgtcgttatttttttcacatatttaaacattcatcttattaaaaaaatttatggcacatttgatcattcatcttactttaaaaaaaattatgtaattataaatagatgacgtcgttatctttttcacacatttgatcatttatcttattaaaaaatttatggcacatttgatcattcatcttacttaattatgtaattataatttattttgttgtgagttgttttatcagtcaatgtacttaagcatgatttatattttatatatttgaaaaataaataaataaaataaatggttatatctattaaaaaacggagtaagtatatgcatatgcagcttttaaattccaatctaaaacgaaacgaaattccgtagcgcgcagttgtgtgacatgggagcagaaatatttcagccaccgctctttcgatttcagagttcaaagtgaccgactgagaggaggagggttcaggaaggaaggagagggagaagaagaggcagcgtgcgcactcggcttcgtcagagatggggatcttctggagcaaggcggagccgccgccgccgatggtgctcgtcccgccgctcttcgactacccacccatcgccgcccgcaccaggtccgccgcctccgctttcgccgccgccggtctcccccctcttctcccttctcaccttccctccctaaacgaaatccgtcgaactcgctcgtttgcgtcaggagctagtgtcactggtagtgctcgccttattacactctcggttgattcaaacgtgttctacttctacatgaatgcgcgattcgcttcagtaactagagccttgtagttgcaggttcccccactcgctaggctgaataatcgtgattagtgtttagtggtatctcgcgcttggccgttctctacattctgaactgaaccgaagctgtaggtcggtgcaaatgtacaatggcattcacaccggctgcttatggttgtagttccgattctgataatttttgctgggaatgcacatctctggctgagacactggacggacgcaagcattttgataagatatactgataatctgtgtgccttgtgattaattgtaatgctcctaaaaggacgagaggtctctatgtagttagcctatgatccttctgttgtgattcactgaaatggttccggtcctaaatatgcaggatgtcggtgccagcgtatgagctaatgtttgggaagctctcgctgcagaatctgtttgaggactactttgatcatgcggggaatatgacctcaagggtcatgctgaagccactggaggatcctcatgttgatttgattgccactgtatcctgccaaacatgacatgacattaccatgttattttattttgttgtttcaggttcttctggtactatggtttctgtctaagcttaataggaaatgaggaaatgaggataagcggatcaccattttttttacccttcttatagttgtcattttctgttgcttcattttgctagcaattaccattgcctctgttcataactctttgctcaaagaaggttagatcatctctccctttcgttaccatgccatggtttttataccacttaatgacattgttgctgttatttataaccaaaatctggaaaagcaagtctgtgttgaaaaggtctgccctctaccatttttgcttgttctggtgattatgatctactggtgccaattatatgttaaattttggcacaaatttatgtctactgggaggcctgataggatcaatgttattgcatgactcatgactgataaattaacttagattgttaacatcgtttgcatttgttcatctttggtacaagaaattattttaagatgatactttctgggaagtcagattcagtgactttttcttggtgcaataaatatgctttttatggacttgaattctagtttttgaaagaaaaaaaattgcctaccttaatattactaggtgtctgcagctgctgataaaatagacggaacacaagtaaagggagatgctctatttcgctggcagaagtacttactattccatatatattaccagtccttgatttttatgtactatactttataatttaacataaaaatgctttactaattttttagagatttagatgatccccatacctttgtggaccttcttgtgtcaacttcaaacccgtaagtactttcttgttatgtggataatatcatcaatgcagttattatttacttatgaaaattatgtggatgatgctggtttggctcataacttgttatccagaatgttgcaggttaggtcatgtgcttaccatcctaagtaccgtgttggtgcgtttgggacattccctttactaatgggaaacaggtagattaccccatcttgtttgcagttgcaaatcatgcatggagttgttagagctttccacaactatgtttgttgacatcatagataaatgattgcaaataatgttcatctgaataatttcaatcaatatgcttataatttataaaccatcagaatcagagagataagttttttcagggtgcgttctgaggattatggtgtcatgggagtaagatacggttcagagaatctatcatttgggtcttcctttgtgccatttcctggtatgtaatcatttatgattctcatgcgatttattgttatgactaaagatgatatgtgactgtttataaacataccacaatatccaatctttacaatgtcctcgaagaggcccctaataatgtctatatgcagttcactttttcctaaggtcacatgtgctgatattaccttctctctctctcttttttgacaggatctgctgaactaccctctggagcatggttggtcgggagaaaagggagcttaagtgcaggagtgcaatacaagccacttagtaaagtttttctagtctgaagcccaaattacttccaatcacattagtcttcagtaaatagatgttgattagtttatcaactggtaaaatttcaactccagcacctaagttaatcaacagaagatgaaaaaagttcaatcgtgaattttgaatagcatctttgtattatgttagctgagttggactttgaaattttatgctggttttgaggggcctatttgttggaggtgtggagcatgcaaagttgggaacacaataaatagttgcagcacttggtgttccttttctcttctagtaatttttttaacaaaagttttttaatgtatatggacatagttttcccttaaaatgtcagttcggcgcttttcatttcaatcattcttttttttttttaccaggatttcaatcattctattcaccatcagaagaatatacatgcatgtcatgggaaacctgaaatttttcattcagatagaggcctatggactgcatctttgtcttatatccaaataactatggatgaatgttcttctaaattcagataaagatactaaaaggctgaagtttattgtatgttggttttaatattactggactggaatgctgtttttgttatgacttgtgcaataggtatctgctatcttggcgttcatctgcattttcatgcatttagagaattaacatgaatattgagttatttatttgcaccttttgagttttttttaattatggtgctatactaattctacattatgcgaattctgcaataggtggaaacaaacatcttatgccatatacagattggaagaactggaattgtgcaatcagttatggtgtaggattaacaagcccactcagtccttccttcattttttctctagagcttgccagaagtacagaggtttgtggcaattgttctcttttctcatttaggaagcttcacccagttaattagcttgtatttgctatgatctcttaacaatggtacagagtatagacaatttaccatctctgatggagtgatggatagttgtatgtggtctttgaggcaaactttaaatgtggctttataaatacgtccatgctatttttctctctaaagttctctttatccaattacttctcccttgatctaggtgcatattataattagagttggactagtaattttaaatggagtacttgaaatgttgcagctcttacagtatgtgtttcttgtaataaaagaaatccttcatatattcaagaattttataattaatcacatgaactgtgtcaagaaacaagctggatgcttatgtgtttctttcttttgggtattattattattttattttattttattataagtggataaaagaataaggaagtactccctccatctacttttgataggcatatttccaaatctaaaaaaaaaaaatttgatgggcatatttcaatccaccaacctattatcttaataactttctctgatttaatgtgtgactctccattcttccacaaaggttggctacatgggcatcgagaaatgtaaatattaatgaatcgcttgtttacgaggaatgactagtagcatgtttaaatgaatgataggtagaattacttatccttggtctgtgtgccaagatgaaatatgactatcaaaagtagatggaggaagtacaacactagcacatatgaaataatcattgattggtgacatctctagctagtgtgaccttcatcgagactcgtgtgtaacaacattttgttttccttgatgtgcagttcattgcatcgttctatcaacacatggttgttcaaagaagggtaagagtggttctctttcactatagttcatgaaatcttcttgatgctgaaaactattaagaacatcaattttttagcttaatcaaaattttctagtattagttcagaatctattaatttatgtggatccttgattcctcagtttcatagtttcctggtatcggttgcatggcatcaattttatgataggttggataaatatctgctactccagctttttataatatgcagaaaagcctatctttaaccaattaacagaaaaaatacttacagtcatgatatcttccactcatccactgttgagtcgtttatggtacgccacaagtttttaaacttgaagcttgttgagactttgtgctgattgtatctaccaggttaaaaacccttttaagatatgaactacttgcagacgaagcaatcaaaagcg

SEQ ID NO: 3821 - DNA, 795 bp, Oryza sativa
  unsure (1)..(795): unsure at all n locations
ngcgatnaacttcgctattcttgcagctttacntgcatttgggtgtttcgctttgctcctcactgtggtgcaagcatggattatgaatgtatgttaatagagtcccgtgattctatcattctctctttgaaatatcatcatctgtcagaagtatctgtaggtctgtggggccttgttgtgtttccctgtaacctatttgtgccacagatctttgcagtatgtggacatgcgtgtagaaaagcaaaaaaatatggtgactaatgtcttaattataaattaggaccaaggcgccgagggaagaggcaggattgcacggcgccaaagaaggctgctgcttcttgatgcagagagaaaacttatggagtttaaaaattgcatgattaatggaatggtaatgttatctacatctatatgagttgctctttaggattcattctctcaatctttaaagagcttttcggcctaaatttgttgactgagaatgcttcttttgtatcgatgacaaagccactttgatgagtgctccctcttattattattaacttttggattataaatttaataatattggaatgaggggcaccctttacaaatgatgcctctgaatttcttcctttacaggaggaagaggcatgctgtaagttcggattaacactgtacaaccttgatagattatacagagctgttgaatcacatgcagaagaaacaggcgagtggtcaaggtcagtatcaactcatattctttaccatttgatgatgagctacttgcggtagtagacgttcaactnnccacan

SEQ ID NO: 3822 - DNA, 763 bp, Oryza sativa
  unsure (1)..(763): unsure at all n locations
cgcgtcattgacatccactggcacagnacttcatcattttatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacagattcttagagtatttctggtagaattggggagcattaagtataaatatgatacatagccctttcttatn

SEQ ID NO: 3823 - DNA, 757 bp, Oryza sativa
  unsure (1)..(757): unsure at all n locations
cgcgtcttgatgactactgctacagnacnncatcatattcttaaatggaaccataagaataagaatattcgcctgtcctactctaagaaatagacgaatcatatactacatacccccgtatcgtatgggggtatagtgagaatgacataactagtatgtcgcgatttattatcgctaaaaatagataataatccacctttcaataaccaataagaaaaggtcttttgtttgtaagagaggaatgaaagagatatagattagaaagatatttccccttttctttttatcctttatttcttttatttctatggatcaaatattcttttttatggaagaaaaaaaatggatttaactcatattcacgaagccctagatttttgggccgagctggatttgaaccagcgtagacatattgtcaacgaatttacagtccgtccccattaaccgctcgggcatcgacccaggaagaatttattctagggtttttgataatctatgattaacctcctttcataatactccctacccccaggggaagtcgaatccccgctgcctccttgaaagagagatgtcctgaaccactagacgataggggcatcactagacgatagggcggtatacaaccgctcctcattatactataatgatagtatgagcagttttttggaattgtcaatatactcgaagagtataactagatccaaagcaaggagtccttcctacttttccattatgcttttgtaggatttttttagtt

SEQ ID NO: 3824 - DNA, 758 bp, Oryza sativa
  unsure (1)..(758): unsure at all n locations
gcgtccagtagtactactggtacagnagttcatcatttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacattaggattacttgttaatggttgatcaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaaagaatgggaaagacgatttcactatatttcttaccgggaacagggcctatcacaagaat

SEQ ID NO: 3825 - DNA, 756 bp, Oryza sativa
  unsure (1)..(756): unsure at all n locations
gcgtccattaagtactacttggtacagnagttcatcagagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacgggatcgcaggcctattcattagcgcttacttgaggtgcactattttgtggaatgtaggcagtggttatgaccgattcgatagaaaagagggagtagtgtgcatttttcgatgaggatttcctggaataaaacgtcgcgtcttccttcgattccttatgcgggatatccagtcaattagctttcaggttaaagtaggtcttttttctcgacggatcctttatatggaaatacggcgccagggggccattcccttgactcgtactgatgagaaggtttttactgcacgagaaatttgacaat

SEQ ID NO: 3826 - DNA, 746 bp, Oryza sativa
  unsure (1)..(746): unsure at all n locations
ctgtctttgtantcagtgtgcagcacnccatcaccattcttgcaattgctcaggataccctcttttagctgctaggtctatttcttagttcaagatcccttttttttactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtacttacattctatttaggattaggaataggtgtaattagacctgctttcgacatatctatcctatccttatttgggtaccatatgcacctttttgggcttctattgaatcgagaaattggattgtacatctttttgattttgatacatataaggtgtcctacggataatgcaaatcgaagctatttgatgtccgactcaggcctatatgaccgaacgatcgaaatactccaagactccacctttgccatatattccatatatcacattagatagatatcatattcatggaatacgattcactttcaagatattacattagatagatatcatattcatggaatatgatccacttttaagctgcctttgtggtgaaatgtgtgacacgtcagactcaaatattcgtgcttagaggttggggttcgagtccttttcct

SEQ ID NO: 3827 - DNA, 756 bp, Oryza sativa
ccgtccagtagcacctactgttgcagcagttcatcatttccataccatttttccgtaacaaaactaattaactattaactaggtaaactattgcaatgaaaagaaagttttttggtggttatagaattctcgtatttcttcgactccaataccaaaagaaagaaaaaaatgaagtaaaaaaaacgcattttctgtaaagtaacattaaggactctgcttttacttattttttcttttacctaaaagaagcagctccaaatcaaaactgaatccattctatctaacgagcagcacttatcttatctttaccggtatggatcattccggatacttaaaaagtcgcgtatcgagatcgattttgcttagccagcagaacgtaaaggatgacgggaccttccttactaataaacatactactaaagaaatgtatcgctatcataaatctatgtttaccataaaggaacatgtctcgatccttatacaacgatctacgtcgagtgcaaaaccgtttcatgaagataagagtttcaatttgactggacttgacactggatgatgcgatctgagacagagagcgaacgcattaggactgcatcgaatctaagagtttataccaagagcaagcctctctttaataaacgtcatgtctggcgcaggaatcaatacgatgtcagcgtttcgttcatcagaaatgatctgtgacggcaggattatggcctaacagtaacggcaccaaaaaccggtgacttacacttg

SEQ ID NO: 3828 - DNA, 743 bp, Oryza sativa
  unsure (1)..(743): unsure at all n locations
cgcgtgcatgagaaccactgttgcagnacttcatcatagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagactgcaaaatcgatccatttttcgaatcgattagtaacatggtggtaccgtatatgaag

SEQ ID NO: 3829 - DNA, 793 bp, Oryza sativa
cgtgattgtaatcagtgtgcagcagtccatcattttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcattttcacagaccaagaactacgagatcaccctttcattctggggtgacggagggatcgtaccattcgagcctttttttcatgcttttcccggcggtctggagaaagcagcaatcaataggacttccctaatcctccctttctgaaaggaagaacgtgaaattctttttcctttccgcagggaccaggaggttggatctagccataagaggaatgcttggtataaataagccactttttgcccg

SEQ ID NO: 3830 - DNA, 746 bp, Oryza sativa
  unsure (1)..(746): unsure at all n locations
cgtcattagatcactcgtacagnactccatcaatcgcaataaatgcaaggatggaacatcttggatccggtattgaaggagttgaagcaagatatccaaatgtttaggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgaactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcattttttaatacaaacccctggggaagaaaaggagtctaatccacggatctttttccgctccttttctatccaatt

SEQ ID NO: 3831 - DNA, 862 bp, Oryza sativa
  unsure (1)..(862): unsure at all n locations
cgtgtgcanctaggacctacttagtggnacagncgttcatcaattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgct

SEQ ID NO: 3832 - DNA, 887 bp, Oryza sativa
  unsure (1)..(887): unsure at all n locations
aacttcactattgtgcgcgcgtgctccataaagacttattttctacctcgtgtaagttagtctttagcacgaccgggagtataaaatatttcanccccccccncgtgtanattgcatcnatngctggtacagacgnncatcactntactgggtatgccttatataccgcgtttgggcaaccctctcaacaattaagagatccattcgaagatcacggggactaattgaagtaagaaggttcggtactatctctcacgcactctttctacgcattttggataatctatttttaactttttctgccttctgtccagtgcatggcatttccttcttgcgattgatgttattttctaagaaatcatagctgccatttcgtttttcctctcttctattttatattttttctgtattcacacctcgttactaacgttttcgctacttacttcattattcatgatcagactctagccacctttctttggcatgtttttctgcttgttttgcacatcttgccaatatatattccttgcactagaacattttcgggttctttctcgcatctgctaatttttacgcggatccccttccagtattatctgtactatgttcatctggttcatcttcttcttttccagcgttttattccgttttaattttgcaataatgtactgttccaattctttctaggataactcctttttcctggtttacaggccgttgtcgcttttgaacatttggagtaattttattcccttcgctcattttatcacctagtgtcacttaaggtattaatacggcaaggttcctttgtctctctcttaactatcttccttctccaggattaaacctctcctgttgcggtagtatgtactccgtctcccgaatcg

SEQ ID NO: 3833 - DNA, 753 bp, Oryza sativa
  unsure (1)..(753): unsure at all n locations
acgtccattacgacctactagttggnacagncgntcatcagtttctttactatttttttttcggaagcaaggggaaaaataatgcctaaattctaaaggaaagtagaagttcaaggcctaattaatttaactcttccattccatggccccgagaatgctaatattagcacgaatcgtacggaaatgtaactcggtattcaaacaactattcagagttcctagagctccttgtacggcttgttggaaaacccgttgtcggacctgattcatcgccctttgtttttcaaaataaagggtttcgtttttagacttttctaattgttccaaactaatagaagtggcattaatcaaatttgctttttctcgttctatctcagagtatccattcattcgatactcatccgcttctagttcgactttctgtaatcgaattcgagctttttcgagctgctcaatggttcctctacgcaattcttccgaatttcgaatagtactcaagatcctctgttttcgattatctaataaatcttttaatgaaagtagattaccttgctattaagtttacaacttttatgatctcttcccgaaccaaacatgaatctttcgattcatttggctctcacgctcccttttttctttttttgctatggctacttccatattttttttaatgtaatgagcctatcctctaccctctcttttctgtttatatttcaatataccgaaacccatataagactagataaatattaa

SEQ ID NO: 3834 - DNA, 753 bp, Oryza sativa
cgtgcagtagtacacctgttggtacagtcgttcatcactagcatcaggaaatagaataatcgggaattccgggtaaccggccaagctgctaaagtagctaaagtagtcataaatcctgtcaataaaatagatcctaatgaaagtccatcgattcccaatctccagtggaaattgaagacatctatccatttagaatcctcttttaattggattaagggatcctccaattggaaatgataacagaatgcataagtcattagaaggaattctaataaacaaatagacatagtataccacctaacgattttgtttcccctatgaggtaaaaagaaaattaatgaacccgcaaatatcggcaaaacaacaagtattgttaaccaaggaaaagaactcatgataaagtgataaagacaagatacgttttgaccagaaaagcccgtgctcgattattttgagcacaggcttcttcggtaaagaggaatcagacgattcaagtggaattttttgtaacgtatcaataagatagagccatgctgcgggttgtctcaggtcctaaataaacgcggacacttaaaaaatctgttgggcaggcggattcgcatctcttacaacccacacaatcttcggttcttggcgcggaagcaatttgcttggctttacatccatcccaaggtatcatttctaatacatctgttggacaagctcgtacacattgagtgcatcctatacatgtatcataaatttttacggaat

SEQ ID NO: 3835 - DNA, 750 bp, Oryza sativa
  unsure (1)..(750): unsure at all n locations
ccgtgcagtagacctactagttggnacagnacttcatcatccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaaa

SEQ ID NO: 3836 - DNA, 752 bp, Oryza sativa
  unsure (1)..(752): unsure at all n locations
tgtgtcattttggatgactagctggtacagncgttcatcatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaccacag

SEQ ID NO: 3837 - DNA, 749 bp, Oryza sativa
ccgtccttggatcactagctggtacagtcgttcatcacgactaagcagagacattcagaatcttctttacatcaagtaaatccttcggctcctatgtgcctttttctttaagttatttattgtttctctcaagccatagggaaagtgtctatgataaataaaaaaaaacatctcactctttctctatggcccagatttcatgataagtgggggaagatgttttcttccccaaattctttgttcaattctgaacaaaaaagaaagtaaaggaaaggcccgcgatcgaagtaccaaccgctaactgtgaggaaccttctctgtttcattaactaagagggaattagcatctttctcgaatggctacccttgacaaagggtagcgttggtatcagaatttacatgtagcgggtatagtttagtggtaaaagtgtgattcgttctattaataactgaatttgaaatgatatacttaaggcgtccttaaggttttttatattccgatgaaaactttagttcttagaaaggatttactcctttttctctcaatagcatattgaggaagaatatgcattttcgcgatttgtacccaaagactaattgaaattgcatccaaaaaacaaataggatttggattatgagtacagagtcgcgaagcataaatttgcattggattaaggattccaattttttaaatatgagtaaaggatctatggatgaagatacaaaaaaatttatttccaatcgtaact

SEQ ID NO: 3838 - DNA, 7157 bp, Oryza sativa
  unsure (1)..(7157): unsure at all n locations
nggtatccattctttagtgggaacgggtacccaaagtcttcagatggttaatggggaatgacgcacacgtcccccgtgtcacccgcggtgatttgatagggccatgctggagcgtcgaaggcatgatttcctctgtcagagaaataagatgtgtaataaatgtaaaggatgtcttccttcttccctaggtagatcttttgggcccctgtggtaaccccttgaattataaaaggaggtctagacctagtgagagggggatcgatcactctctgattgaaccaactagtacacggtgttcctcatagaaatcaagcacacacaggagtagggtgttatgcttctcagtggcccgaacctgtataaacccattttatctcatcgttcttgaggggcccgaccccctccacatcactccttgcaccaaaccttgattctcacccgctgccccccgccgaactgaaaggggggccccttagtcccccgctccaggagttcaccctccgacagtaatgatgaagagtgagaagtgaagtctggatccttgcatgttgatgtgtgttgtatagatctagttcatatttgcaacttagtaaattgcaagagtaattgttgtacttctgcatggaattattgttaccatactgttatcttgatcttggatgtgttaatttgttaggacttgggacttttacacctgatgttatggcattggcatggaggctggagccatggatggacttatattttcaagcaatgcctggaagggttttggattattcaagcacttgatgttatatattatgcaagctgcacttaagcacttaagcaaaattatactattatggatgtgttttggctggtttttccttgagagatcatgttcagatgttattttactatcgcattgctgcttattgtattgctgccttcttgttgtatgtaatgaatagggctctcgctaggctagaaatcgttaaagaaacatgccttcaacaacaccatgaatacaaacataacatccgacaattttatttcatttccgaaccgagtttgcactgactctgtaccaaatccgccgtccgaaataatccgatccacatctgcatccacatccacactagtccagatcccctagagttgggtataactctaccgggtggagttggccaaatatgtgccattccatatacttcaggggctgggattaagccacattaatttatactttaaaaaccagtaactgaccatgcaacaaataaactcgcatcaacaacttatcacgagatcatttttattgtataattagaacaaaaatttcatgcttcatcaattatctaaaaaaatcatacacattaatattgatatggttcactgtttgcatatatgtgaaagcactatgttggtatacactgcgagttgctttagagttgatcgactatatctgttgtttggggaataacaaaacgttgttctgttacttttttttttgggggtgagaacttaatcaaatcgctattatagagcaaacacatgaaaaaactaagtttcctcggaagccttaaccattaatttaaggagttaatttattaggtgaaattgatgatgaatgatctcagccgtaggaaacaatggatagtacagatttggccaactccactcggtagagttatactcaactccaggggatccagacccggtatactaactagtagctatatatcaggtgatacctaccagagtcatgcatgatacttgctaggtatactagctagtagctatatatcaggtgatacctaccagagtcatgcatgatacttgctaggtatcatatgataccccataggtatcggcacaattttcaattttgatttcggcccttttggtagaaccgaaattctgggaattttggtaattttggactgaaatttactgaaattttgacacaatttaactgaatttgactaaattcacaaaaattggagaaaaaccaaaaatttcagccgagatattggcatgccggggggaggggggagggttctgaaatttcgaaaatttcgaaccaaaattttaatccctgggtatcagccgatactcgtcggtactagatattgatatccactgatatcgcccaatgctcattgtcttattggtaccaagaaaaaattgattcgtaccatacatgggcgtatagcttgaggatggtgagcagatcttcagtggcccgaggggaggagtgactgtgagatgaagaggacgtcagtgatggcgaagagctcatcagtgcccgtgaggagcatatctgcctccatcgcatgcttcgtgaaccgcttgtagttggtgaggtcgtgtggtgaggagcttcgatctccatgatctctagtcaactctcgccccatacagtcacttggatgcgggcctatcgggagtggcgggactaccttcacagtccaccgtacacaatctcatcatctcctggagaagtgtgtccatcctcatcggctccagcgattcatgtctgagggattggagcgtcccatgcaggggatgggggatggtatgtgtcgcctagcattcgcgagaagataatggaacacgagagcacgctacaccatgacctacatatggaagcacttagactgtcggtataaatggccattagagcaagtttaataatatagccaactactagctccaattcatctatagctaatctaatagctcattcatacaatagttatatactacactattaatacatagacccacctgtcatacacacactgcgtcttggagtgtgctacagctggctacaaatctgtagcccactgcttttctctcttctcatttatctccttaaaatatatttgcagctggcttatagcctgctattgtacctgctcttagcgtcaaacaatttgtcgacacttagtctaccaccagtgtttgccaatgatccagtagtcaggaaaagtttttaattaccgacaaatgattttttactggtagatgtctatctaccatatatgaatgcatgcaaacaaacagagatgtatggcatatcctctgctccaccagcaaaattccatgtcaaaattaaagatatgtgaggaagacaaaaaaaaatctggaggagcgaagaatggagcaacaccatctcgaacttcaggagggtgaatctgtggaggccacagcacggtcagcaaagacgatggtgccggtgcttcctcgtaaatccataaagtcatttatagcacacaagaaaaaatgttagtaaaattttggaaaccgatatgctaaatcagtggcggacccaggatttataccctgggtgtgcccacaaatacaagccctacacattggtctagagcatatacacaaaaatataggcaaaccgagcattttatacaccaaaatgtagagccctgtacatggcctagacaaagcataatctgaattttctgatgccttgctaaaagaagacaatgcccttgttcctcttcgtattaactgatttcagaattttcaatttttcaaccaatctctagctctcctttaaaagaaaattcagggagacaaagaaactaaaaatagtgagagactaaaagtcccaaagagtatatctgtatctgaagttttagatagatgatgcgaagctggacctgcttgcttgccttggtcaatgtggttgctgctagctgcattccttgcgttgctcacagactcaccgggctcgcatcgacattgcttcgccatgtctctaaatgctagtggctgcggctctcgtctccaccgtcgacgctccacactcgccgtccagccaatatcggtgctctggcctgttgactgtcgtgctcttcggtgtcaccgccgccgctcgctgaatgtggaacaacgcctgatgccctgaccctagctacctttcacacgatgccaagtggatacgcgaatgcgaagtgaagcggggaacttgcacgatgcaaagcgcacaacacatcacacaggcatctatgatgggctggctcatgcgttcatactcatcaacttttgccccaaactaatacatgctatatactataagtttttcgtttttttgggtgtgccggtgcatacccggcacaccccctgggtccgcccctgtgctaaatgttccaaaaaataatcatacataatacaaatagatatgaaccgacacaatttttctcatcaatttaaggttatatggtttcaagtaattttacttttagtatagagtttatacgtttcaaggtaattagaaaaaaatcataaccaatgtccaaatcagttattaagcaaaacatgtttaaaatgaagtcagggaatatttcaacaatattattctaacataagcattcacaataaaaattaaagcaaaattaacaaaggtgtccgtgcatttctagttcgtattaataattgaaaccactcagtgctagaaaatcagtgcaatcggcaccaacgatcatcatagtcggaaagtcagtggcccttaaaaaccgggcactgacgaagtgtcctaagctattgaccttattttattttatttatttattttcaaaaacgtgataataaaaagaaaggatcatatcacagattcacagctactgctggcgcaggtatttccacattagttcggcaaatagtctagtgcagtcgtgcagacataatatgatgtgcacttgcaccttcttcaggtacaaacgtagttcaatgtaccatcagaatgtgcagtggcgaatgtacaacgtgatgaaaatattattggggctttatattaaagtcataatacataataattataatatactttttcaaaatcctacgcggatagggaaaaaaagaggattaaagactgaagtgaactgaaaaagattgaaattaataggtataagagcactgctacacatactagttttttcttactaaatctttactaataatcatctcaaccgtttgatttaggtagatgaaagttatgaaaactctagatgaactcgtagcatcacacttcagtgttagaatttagtaagataaagttagaacctatagtcttttccatgtataaaggccatgagctgcacactgcaacagcgactagctagaacacaagagtaaaaataatctacaatataattaatgatcacaattcacaaatgatccagctagtaataaccagcttaatgttttttcatgcacatcatttctttcaccctgaacgtctccagccaactagccatcactgcttggccgtatgctggttgctgtgcaaattttgctggcactatgaactcactacgcaacagatatatgggattagattcctgccaaccagagagctggggctagagccccaaccaataacatgttcaatatgtaatttggtgttaaatctgtacggaatttctcaaaatatattttgtttcatgaaatttactcaattatatatatactccctccgtttcgaaatgtttgacactgttgactttttagcacatgtttgaccgttcgtcttattcaaaaacttttgtgaaagatgtaaaattatatgcctacataaaaatatatttaacaatgaatcaaatgataggaaaagaattaataattacttaaattttttgaataagacgaacggtcaaacatgttttcaaaagtcaacggcgtcaaatatttcgaaacagagagagtagtactgtacggtgactagggttgactagtccctctcgtccaatcctaaagttggcatagctttggacagccgctgccgtctttgtgtgcacaacaataggctataaatgtagctagctttggcgtcctccgatcctatggttgtgtttagatctaaagtttgcatccaaacttcagtccttttccatcacatcaacctgtcatatatacacaacttttcagtcacattatcttcaattttaaccaaaatccaaactttggatccaactaaacacagcctatatacactactcactccgtctcagaatataagaggttttagagttggacacgattattaaaaaagtagggtagaaataagtggtgaagggtcgtgattggatgggtagtggagacaggtgggaaaaatgaatggtgaatagttgtgattggttaggaagagaaatatttgtggagaagtagttatattttaagataaattctaagggctaaaagttgttatattttaggacggagagagtagctaggaggctttaatacacacgtcacactgtacgctgtgaaggaacaatgggtttctggcgccggtgcacaccgtcgacatcggcctgtgcaggcgtctgtgtcgtcgccctcctccttgtggctttggcttgctgcccgacgcgcgcacgcggcgctgccccggcggtgtacgtacttggcgactcgcaggcggacgtcgggaacaacaactacctgccagcgacgctgccgatgtacaaggccaactaccctcacaacggcgtcgactacccggggggcaagcccaccggcaggttcagcaacggctacaacttcgtcgactaccttggtgagtatttcatcaacgcgtacactgcgcactcttgggaattaaaattagaggctattgtattggctatgtatatacatgtgaccattgtcttaaggctcgttcgggttggagagggttgaaggggattggaggggtttgagggggaataatttcacaccacaataaatatgtaataaatttccgctgatctctttctctttgggattaaccgaagatggccttaagggaaaatatttttttcacggcaaatacttctcttgttgttgcatatcccccatttgccagttggcgtaagaccagacatcctcgaaccctttgtctttgcaacccgttggtaagcttgaagggtgtatggtgctttacaggagattctcgcgtgtcgaatctgtcaggcattgcacacatgagtataggtcctctctcagtacgatcgagtttaatgtcgtatagttaagcaggcctctggtccatccttccgcgcaagaagcaaaaacttttggacagctttgaacaaagcatggtacagtgtatgctatacagagtcatcaggtatagcttgtattcgcgaatgtctctccacgctctctactgacagccg

SEQ ID NO: 3839 - DNA, 741 bp, Oryza sativa
  unsure (1)..(741): unsure at all n locations
cggaagtcnccgttnaggttgatcttcttctactgcaagtagttcatcacaacgaaggtgatgtgatgttactaaatccataaacatttgagaaaattcgaaaattttggtccagccggccggtgggggtgtctgaaattactgtttcgaaaccgaaactgcaaaaacccggcctgatgttacgttgaccttaattgcaagatcgttttgcaagcataagtatacgtacctgcagctggcgtttgagggtattttccagattgctgacgatctcatctcgggagcgtaggagctcgctgacgggactcagcaggaggtcgttgatgatgtcgttgccgccgatggcgacgacgaagagcgatttggcaaggtgggccttggccccaggaatgcccagctgctttcccagcgcctcgtggactctgtggtagtccccctctatctgctcgtcgaagctgatgcactgggcctgcatgcgccgtactagaattaaatactcatgtaataattaatatagaattaaatactcatgtaataattaattgatggattaataagtatgtaacctgtaattaaatttctgattcatacatattctgttcgtgttacactaaaaatatattcaaaattttcttgagcctcagtgtggtgctctctattattattggaagacagtatgaaccggtgatctcatttaatcgaagtgttaaaatttatttgtactactaccactattagcag

SEQ ID NO: 3840 - DNA, 763 bp, Oryza sativa
  unsure (1)..(763): unsure at all n locations
agctccccagattagaactccatgtcagnaccncaccatcctaaaagaaggccacacagcaggaaaaactgaagccgtcccatactcagagttggattcaaaaactgataacttgtaatacatccatgctgttcagaaatttccatagacatcacttacgttattatccaactatgttaactgattaagcaaaagcatacacaactctgtccagaaagaagcagcccagtagcagcacgggccgaacgaaacactcagccagccaaaacgaagaaaccacgtcagaggtaaatagcatatacaagggcaagaccactaagttcagagaacactaataaagttaggagaaattgataaaatagaattcagagaaagaaattctgatacctgagccttcatggcctcatcagcgtgttgatgcttattccgatagttggcccattcctgtaaggctggaatcaaagcaaacatcaccggagccatcatgggcgtcttgatgctcaatataatcacagaaaccatattacccaaagcgcaaaccatgctctcaaaacgaacaataaagaatagggagccagctattcagcttagcacgacttgctgatctctgaatggaagcaacataagtcaacataattttagtttcatgtacctgagctcaacataaaacaaacagtaactgaaatgtgccagacatgttagactgcttacagttcatggtcggtaggatgaatttgacacaacaaccacattttgacatcag

SEQ ID NO: 3841 - DNA, 811 bp, Oryza sativa
  unsure (1)..(811): unsure at all n locations
cctgtccgatgatcggcttctatgcaagtagttcatcaggtaggtatcacctgatatatagctactagttagtataccgggtctggatcccctggagttgagtataactctaccgagtggagttggccaaatctgtactatccattgtttcctacggctgagatcattcatcatcaatttcacctaataaattaactccttaaattaatgggtaaggcttccgaggaaacttagttttttcatgtgtttgctctataatagcgatttgattaagttctcacccccaaaaaaaaaagttacagaacaacgttttgttattccccaaacaacagatatagtcgatcaactctaaagcaactcgcagtgtataccaacatagtgctttcacatatatgcaaacagtgaaccatatcaatattaatgtgtatgatttttttagataattgatgaagcatgaaatttttgttctaattatacaataaaaatgatctcgtgataagttgctgatgcgagtttattcggtgcatggtcagttactggatcttaaagtataaattaatgtggcttaatcccagcccctgcagtatatggaatggcacatattaggccaactgcacccggtagagttatacccaactctaggggatctggactagtgtggatgtggatgcagatgtggatcggattatttaagacggcggatttggtacagagtcaatgagactcggttaggaatgaaaaaaaattgcggatgtagtgttcgatcatggngtcgcagaggcatgttctttaaacattctagcctacgagg

SEQ ID NO: 3842 - DNA, 731 bp, Oryza sativa
  unsure (1)..(731): unsure at all n locations
cttgncattgatgacaccacttggaacnnccncacttttgagaaggctgcaggttttcaggttacttgaaatttcaaattctgttaatatacttgattgtttacaaaggcgatcttcccaccttattttcttcccccgcaggcactgattcaatacacagatgcagccacagcttctgcagcaagagaagccttagatggaagaagcatcccaaggtgacatctttgttctctgtacattgcatcttttaatattgttcacactttgctcctcctataaactgaattcctctgagactttaatttaatgtaggtacttgcttccagagcatgtaacatcttgttgtttgcgtatttcgttctctgcgcataaggatctgaatatcaagttccagtcacatcgcagcaggtatcacttatatcttttttgccttgagttaatttacaaagatcaaatttcgcggttgttaagatggatctctatatgtctaggaggattgtaatatcaacatactacctggtaccatattttaatgtctacattaagatttatgcctaggcattgcaagatcatacctcatattttccctgcaaattcagaaatacgtgttctgccacatcatgggcattttacctttattcatctttcctgttcatcctgctgcctccttatatactgacacatgattactttgaaaaccttgtaaaatagactatcaaccactggattcc

SEQ ID NO: 3843 - DNA, 9659 bp, Oryza sativa
  unsure (1)..(9659): unsure at all n locations
catccttggtttgaaaataggactgtgcagcggggtggtttgtcaagaatggtggggcctatacacaagggtatgttgtatagtgttggattaatattgtttaattacttaactgttttgttaaaattctcaaatgtttgctaaatgctgcttttgcaaatggaaccctattatgccatcctttgtatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaccccataccatgttgaacaaacctcacgctccacttttttgtattctcgctttgaagagtacgctgtggaacctccgaagatgtgcgagacatgaagatcggaatctaggtacgccgagtctgagtcctgagtggttgcctcagtggccttctcgactacacgtactcgcttgcccttctccaaagccagttgcttttccagcgactttttgaagatgaggcactcctccagagaatgtctgtccgacttgtgtatggggcaccatattctcttcgtatcactgccttgtgggtttgggtgtttgggtgggcgctcgtattcagatgcgaggacttccggttgagctttcctcttcctactcttgccgcttttcttcttgcttgatttgggtgcgtccttggctggcttcttctctcctctcgcctttggcttgtcgttcttgcgtctcagtgcgttgtctgcatgggcgcatcgatcgacaacttcgaacaaccttcgagtagttgtgattcgccttgttgccaactcctgggtagtatagcgatctctgacaccagttttgaaagcgcgaatcacagaagtatcggtgatatcggggaccgtatttctacactcattaaagcgccgaacatagtccctcaaagattcacccggattctatgttaacgcgtgtaaatcgtcttcgatcgcgtggcgcttgtaagttccttggaagttagcgacgaactgctgccacaaatctgcccatgaagagatcgagtagggtgggaggtgcatcagcaccaaacacgcagaacctttcaacgccgttggcaaatagtttgctaacgcgttgtcgtctgccccggcagcgtatagtaccgtggagtagacctggaggaattcttcagggtcagtgctcccatcgtacttctctattgctccgggtcagaatctcttgggccatcgaacatcacgtagagaacggttgaaagctctacacccggcgctgggggcggtgggttgtcggcgatcgtgtgtcctccgtcgatgtctatcggatgacgaagatgaagatgatgacgatgattcactcggctccggtgtgcgattccgagggcgacgttcaggttctcgagaattctgtcgtcgtccaccattgttgtcctggcgccgatccccattatcatcaccgtcatgttgacggcctcgaccagcatcgtctggtgtccgctgttcgcgattgtcgtggtcgcggcggttgtgacgattatggtggtgttggtcttcgttcgagcggcctcctcgctcttcgttctcgcgatgtcgtgaagaaacacgatgtcgggaacgattctcgttgtctcgcgcgcgtcgtgcttctcggcggccattcagatggtcgcaaagatcgctggtgccgcgaggtggaggggtagctcgtctaggcgacgtccgctgctccggtggttcgccgtcggcaccgtcagttgtcggtcgttctggttgtgctctggttgcggcctcctcgaacgcgttactgagattagctaccgattcccgtagtcgttctgtccatcgtgcgagatcatcgttaagcacggggtcatagggagcttctctcagtattgcgttgacggtgccaaggtgttgggccggtgtgaccgtctggttctccgcctctgcgttagcgtgtgcagacgtgctagtcccatcgatggcaaacacgtcgcgtggtgtactgtcagatgacgagccatagtcttcgagcaagtgtaggactgatggctcgtggggatcgatgtcgattactccaatgaatcgatccgaggtcaacgtcgctccttgttccttgtctgtatccttaagggaggttcctgactgctggaccttaggaagcgtcgttttcatggcgcggagaaagaccttgcagcttaagaagtcgtgattcttcgtcttgtgaataggacaatagacatcacgagttagagaagtacgctggattccatgctccttgcaagcacgaatttcagcttgtacgttgagaaaaacccagcaagcttgcaagttgtacttcctggacttgtggataggacaccagaactttgttacctcggaagttgtccttgtcggctcgcggttcttgtcggaaggacaaggtttggccgcactaggaaccttctcgggctcgtatgacgtcgatgttccgttctccgctacagcgggaggatccttcgacatgggatcggtcattgatggatcagccgagattggtaccgtggtgtaaaccgggaagacgatttcgccgacttgagtccacaacagcattgttgaagtagggactccttgaatggggccggtgttgatgatgttgtcgatgaagcttgatgtcatagtagtagaatcttgagcaccaagtccccctacctggcacgccactgtcgacggtgggtacccgtagaccggatatagagggtattggggtacgctggtacgaggatctacgtagcatgacatcaaggaaacaagagataaagattatactggttcaagccccttaataggtaatagccctaatccaattgatatgggattatatggagagaaccacaaattacaaaggaaataacagaactcgatgatactgacgagatcgtagtcgagttgattcgactagatcacccggtgacttggctcctgcaaactctggcttcgtaggttgtggtcactgtgttggctatgagattcgatcccttaggtcctcccggggggtcccttttatatcgcaggtcaggtggtctccaagtaggactcagagacatcggactctgcacgatatattgacgacccagtcttatacgggtaggaacctttgcattggtggacttcgagatgaatttccttaacgtatacagagaatgtccgtacacgcgccgatgtacaatattgtcgtatagcgtacatccaagggtagagggtatatcttatccgtaaccctgacacatccaaatataagtcggtttttaagttcgttcgcttttgggaatacatatccgtatttgagtcgggttttaagttcattcgcttttgaaaatacaaaaagagtcgtataagaaattcttttaaaaaaaactcgcatgctaacttaacatgattttttagaaaaatatatatctaaatgaattctcacagtgaatttcagtgaaaaaatagtttcacctgttgcaaagcacgggcattttttctagtaatttaaaaaaatcactaaacatattttattttatcatgacttgataacttaagtattaattgtattatatggactaaatttttatataggacagatcggtaaaaataaatcagcttaatctctactattataaaaattgaagatatttttgccggtactttggtacgccatccgtctatgagtcagtttttaaattcattcgcttttggaaacacagatccgtatttaagcccgtttttaagttcgttcacttttgtaaatacaaaagaaatcgtataagaaatctcattaaaaaaagctcgtatgtcaacttaagacgatcggactcctaattgtaactcatgattttctaacaaaatatatatccaagcgattttaacacaataaatttcatcctacctaaaccatataacaataacaagattaaaatagccttcacttgttgcaacgcacgggtatttttgtagcctatttaaaaaagaaagaaagagctactccagtatgctctccgattgcaatccaaagtggtttcaaattagaaaatgcctttgcctcccactcttaaaaatgctcttggctttataccagctagcacttccaaaaattgcagatctcggcgtgaccacgagatagatttgcggctcagcgtcaacagtcaacagtcaacagtcaacacacacaggcgcacatgcaaacatgcaatgcgcgtcattctttctgatatgaagcctgtgctgaacattttcttttactcgtctggttgactccccctaattcagtttcagtcttcacttcttgcatatctggactacttttttgtcggccatgtactggactatgcagcattctcatagtgccaaattcaaaacccatttgatgatttgaagttggcatcattgtatcgcatcgcgtggtcatgcttttgcccaaatctgtgaacatcatgaaattgatttcctgttggaaaaagaatatcagattgatctcatcagtgcttaaatctttggcatggattaagttttccctttggagataaaagcatgatatattggtccaaaaaatggaagaagtctccaacaagcagcgcccattgcattgatgtcgtgaaagaacttccactgaactgcaaagttttaaaaaaaaggggttctctaaaagattaactcaactggaagttgctgaaagagatgtcaaacatatttcttgaatagtttgcacatattattacgcagtcaaaacgatgcattgtttaggtctgaccaatgagaagattattaagatcgaggttaacccactgtcagttcttaatacagactgattaggacgtgcacccacaccatgacgttgacctggattctgagagctgaacacagaactgatattgtctaaaaaatcacagaactgatcatagaactgatattgtctaaataaaaaacacagaactggtctggcttcgaaacattgcatcacagtcgtcagaatcgatcatattccttacaaattccagtcctccactaaccttccctttcttcactgtcctgtccatcatgtctgtccttcttggcttcctcctcctactctccctgcaccctccgacgagctatgccactacggacacggtgtcacccggccaaacactggccggcggtgacaggcttatctccaacaacagcaagttcgctctcggcttcttcaagatggacagtaagaactcctcctacaccagccgcaacttttacctttgcatatggtacaacaagctccccatgataactccactgtggtccgccaatggcgaaaacccagtggtggaccccgcttcaccggagctaacaatatccggcgacggaaacatggtcatcatggaccaggctaccaagtccatcatatggtctacccgtgttaacaccacaaccaacggcaccgttgttgtgctgttgaacgatggtaatcttgtgctgcagagttcatcaaactcatccatggttttctggcagagctttgactacccaacagatagcctttttgccgatgcgaagatcggctggaacaaggtgactggcctgaaccgccgccttgtttctaggaagaattcaattgaccaggctgctggtttgtactctttggaatttgatatcaatggtgttggtcatttggtatggaactcaactgtaacatattggtccagtggggattggaatgggcaattttttggctcagcaccagagatgtttggtgccaccatacccaatttcacatttgtcaacaatgacagagaggtttacctcacatatactctgaacaatgagaaggcaattacgcatgccgcaatagatgtcaatgggcaaggtttggcaggtgtatggttggacagcttgcaggattggttgatcaattacaggatgcccttacttcattgcgatgtttacgcaatctgtggaccttttacagtctgcaatgacaacaatgatccgttctgcgactgtatgaagggcttctctataagatcacccaaggattgggagatagaagatcgaacaggagggtgtatgaggaatactccattaaattgtggtagtactatgaacaagacaggtttcagcgataagttctactatgtgcaaaacattatattgccccgtaatgccatgcatgtgcaggaagctgcaagtaaagatgaatgctcacatgtttgcttgagcaactgctcctgtactgcatattcctatgggaaaaggggatgctctgtttggcatgatgagctgtataacgtaaggcaacagtctgatgcttctgctgtcggaaatggtgataacttttacattcgccttgctgcaaatgaggtgcatgaggtgcaaagtgcggaaaggaagaaaaagagtggagtcatcattggtgttgccattggtgcaagcactgctgctttctggttgatgatccctctactgatgttttggaggagaaaagggaaactgtttgctcgcggagcggaaaatgatcaaggcagcattggtattactgcatttcgatatattgatctgcagcgtgcaactaaaaacttttcagaaaagttgggaggaggcagttttggttctgtatttaagggatacctaaatgagtcaactcccattgcagcgaaaaggcttgacggcacatgccaaggggagaaacaattcagagccgaagtggattcaattggaatgatccagcacatcaatttagttaaattgattgggctttgttgtgaaggtgataagaagttacttgtgtatgaatacatgccaaatggctcccttgatgtgcaactatttaaggataatgataaagttttggattggaatcttagataccaaatagctattggagttgctagaggccttgcctacttgcatgatagctgtcgagattgcattatacattgtgatatcaagccagagaacatacttctcaatgaatctttcgttcctaaaattgctgattttggaatggcaaagattttggggagagaatttagtcatgctctgactacaatgagaggaacgattggatatcttgcccctgaatggattagcggaacagttgttacagctaaagttgatgtttacagctatggaatggttttgtttgaaatcttatcaggaaggaggaactcaagtcaagaatatttcaaggatggtgaccattcggcctattttccaatgcaagtcgcccgccagcttatcaatggagggattggaaatctggtggatgcaaaattgcatggtgatgtgaatctcgaggaggctgaaagagtttgcaaaattgcatgttggtgtattcaagacagtgagtttgatcgcccaacaatgggcgaggtggtgcaattcctagagggtgtactagaactcaaaatgccaccattgccaagactactgaatgctatcacaggaggctcacattcaacaccactgtcatctttagatttaccgtaaatttgtatgctaatttgtaatttccagtagtttatgagaaaattatagtttctgtctcatttcaagaaaactaggcatagaaaataagaaacatcagtgttcataataagatccatatctctgtgtctgtacacagtaggacatgttatacataccgtagacctgtcattttgtcagttgagatgcttttaacaacacaggaagatttccttcccagttgagagtacattgttgagtccaatatagagaaatgtactgacaacctgcaagtcatactgatatatgcacagatgacatgcatgtgaagcagtaatggatatagactaacaaaaatatgcagcctaactgctgatccaaggaaataagcacattctacgggctaggatgaacactaacatagcaattgcaagtgaatgtgcacaacttcatatgacttactgtttttgcatattctgcaaagttcaatccagtgctgtaccctttctacaaggcccaaacaaaaccatttggagtagattggacctccttatatgggataactaacttttttatgttttccaacatatatactgacacaacctatcgcccctaagcaagtgaagggtttcatctttaatcatgatatgagtgaagtgatgattcgaaataactgtaggatgatatgattactcctgctacgatggatgatataactacataatggatcactcaaatcctgcactgctgagtattagtagaactctacagaggcaccatcaacgggaacactggccaattttaatgagaaaaattgccacataagacagtgagtacaaagtacaaagcaaatttcctggccagctttcattgtgcaggatctgatatgttatattatgattggtaattaacatagcagacaacttatgcaaaacaaactcaagatattttaattgaaaatgttactggctggccagatagcatgacgaatgccctctgtcagagcaatttggacataagatgtcttcataaagctaacaaaacaatcacacattacctaggactaggtgcaatttcctgtctgaaactctgaaccaagtagataacaccagcagtataaaagatttcgttcatttactcacattatggtcagcaatacctcttttatttccagaatctagaatccagaggctgctactgtccgtattggaatcgccattgccttgtgaagcagcgtggtttctctcggttgcctcaagtgaaactttgaagaattgaagccactcttcttttatccataccttcactcagctcaaagggatcaatccctttgccattgatgataataggatcggcggcattgtagtacggagagacgtgggggcaccctttgggcttatccagcctctcctcaccttttaatttagtgctgctggccatattcatagatccatgtcaaaatctatcaccaaagagcacaaaagaacacatcttagcgtccaaagtacgataagtagtagtaggacgcaccgtattaatttgaactcaattttgatatttgattccaaattgtgattctatccaaacagaatatttttaatttcgaccaatacaaatacccatttttgtggactcgtcgaaatttaaagtatctcgcaatccactctcaaaattaacattagcaaacaaccagcctcacctaattaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagggtgccgagctgaatatcagctcatt

SEQ ID NO: 3844 - DNA, 3899 bp, Oryza sativa
  unsure (1)..(3899): unsure at all n locations
ctcggtacccctacaagaaatacatcctgaagagactaacaccaaacttagacgtattcccaaagctaagggatcattgggaggagttcgttgcttacaagacagggcaacaagggcaagcgatgatggccatgaaacaaagaaaatgccgccaagaagaagtaccatcaccacttggggtcaggcgaatatagcgtcgcaatgccgaagtgggaggagatggaggcaagtttgattgagaggggtaacgaaccggccaccgctaaatggccggatcgatcgaagttctggtactatgctcacggtggaacgcttaacccagttgatggctcccttgtcttcagcgatcagatacgcgaggctgccagtcgactaacggacgcagtggaagcctcttctcagggcacattccgacccgacagagagaaggacgagctgttactcgccctacagactcccgagcatccaggacgaacacgagggaaaggcgtgattccctggaagattggatttaaggaggacatccacacgtacaggagtcggatgaggagcaagaaagataccgaggtgaagattgcagatcttgagtacagggtattgactacgagctcagcatgcaagaggaaggtggatgaacgtatggccgcacatctgtcccaggatccccaaccgtacattcctcctgcaatggtcagcccatcaggcaatcgtagtagctgcgcctcaacggggcaagtaggatcacagagcatagacgccatgcaaacccaggatgaaaccacctgccccattgatgagatcacgcagcggacaccatgtgagctgcatattcccttcaagaacttatcaatcaaggtatgctcgtagtttgatgatttttgacttgtacattccgcaagttactgcttaggttgattactaatagataacctctcatcacgtaaaggtggcgtcgggaatggccatcccaacggacccttctgggacttaccactgcaggccgattccagcaggatactcgagggtcgaagttgagctggtggaagccgcgtacgaggacctcgagttggactacccaggaggagacgttgagacgtatctacgagacacaagccacgccattatactatggcacaagcggtacatcatcctccctgggtgacaagcggcgtctcgtgcaccatctcctccggctccgccatctcctcctgcaccatctcctccagttcctccgccacgtcctcctgcaccatctcctccggctcctccgccacctcctcttgcaccatctcctccggctcctccagctcctccgcctcctccgcctccaccgtgtccgcctgcacctcccaagacaaggtctcgccaagctccaccgcctgcccgcacaagggcaacgaagaaggcgaaagttgacgccaccaaaaacaaggagccaccgtacgattgcagtcaagaggagcttgatgcttatgtggcaggagaagtgaagaggcaactcaagcctcggagtcctgaaaagaagatacctattgacccgagcgagaagaacttcttcaagtgaatgtccgcaacaaacaaggaggccttacagatatcggactatgaccgaacacttcagagagcctatcacaagaagtccaaaccagtccctcagcttggagaacaaccaaaccaagaggtcgagccgttggtgaccggcgaagattttggcataacagaattcatttcagacaccggtctaactgtggatcagctgattcgaggcgcacctatcccaaaggcggaagtggcatacaagtttgaactcggtaaaccgcttgtcacgcctgagcagctgcagtccctaccgacacagatgtacaaattccatgaacggtacatggaaatgagcgccaagggtagagagatgttcggagcgaggatcagaaaccctgacttcttgcaaggagaagatgttctctggatccatttcaaggatctcttcgatctgtaccatctggacgctctcgacgtctctcttctgagcgcatggattttgtgagtatctttgagttcaatttgtttcgttcaataattagctcctggcatatatgtaagcaataataatttcctttcaacgttgtagaatggagattcaaagggcccgacggcggagggtctacgatactgggttcatcgatccttggaaaatcaacaccgaaatgatcgacaagtacaagaaagacacagaggacaatctcgtccatctcctaacgcagcagcatttcaagacgtacatactactgccgtacaacatagagtgagtttttattgtcgttcaaacaaatttcgttcccatacatatagcatgtatattttcatatatatctcatctcacgcatattccagattccaccgggtcctgttattcttcaacttggacgcatgcagagccactatgtacgactcaatgaataaagaggagacgatttttgacaaggtcttccaactgatagacatgtaatataatgtcatctattccaaagtcgcggggaatctattgctattatattgatctcgggtaataattaattaatcatagcttacaactgcatatgtagggcttgggatcggttccgtcaattggtctgcgggacttagaaagaaaaacttggacggaggtttcattttccagtgagtacatgcatgatccaaaattatattgaattgaatctctaattacagttaatataaagagtatattaaatctctcatcgtttctcatgtagtgtgcaaagcaggaccagggaactaacttatgcggctactgagtatgcccactgcctatcaaaccaaatgtgcacaacacgagagctcgatgtacgtatacataaaccattcaaaatttcattgcgtatcgatttgttaagttgtttattaatttcatatattgatatgtcattatttttcgaatgatagcgtattcacatgagggataatctcccacacaaggattttatcacggctgttcaagaacaactgatgggattcatcaacgaagaagtccttaatcctgatggtgaattctactacgatggattgacaattcataacgccggtccttcctcttctgacataacgccggcgtcgaagtcgtagctatagctaccgagcaaatgaattgtactatatatgcatgtatatatatatttatatatgtacacatttactttagtgttaatatatattttggtaacatatatgcacataaaatgttaagtgctttaaattatacatatgtgtgtaatatatgatttatacatatacacatatgcatacacacacacatatatatatatataaatatatatatatatatatatatatatatatataaaatcaaccatgcagcaaacagggccatgcaaataaaaaaatggtgcaccgatctttagtcccggttggtaacacaaaccgggactaaagatggtttggccggccacgtggctgaccgatctttagtcccggttggtaatacgaaccgggactaaagatcaatctttagtcccggttatttttatctttagtcccggattcgtagtcccggttggacaaccgggactaaagggggttaccacccgggactacaaacggtttctcctccagtgatacaattacttcattgtcttctacatcatctcacagagtttcggactataatccattacgaaaagggattgtctatagatcatttgacagaaaacccccttacaaatcttgcaaattttggagcatccgattgctttaagattcgtgcaggcaaccaaaccctaaaaatcctctctcctctctccattnnnnnnnnnnnnnnnnnnnnnnnnnnnnnnnnnnnnnnnagaggtgttactaatngacgc

SEQ ID NO: 3845 - DNA, 4228 bp, Oryza sativa
  unsure (1)..(4228): unsure at all n locations
tgtggtaatcaggatntcgtgctcgaaccccctagtgcttccccccacctccgccaccgccgccgtcaccccagcgtgctgccgcccggcctcgccggctggccgaaaggtgtcaacagtgccggcgaggccaccccggccggccccctcccccttcccttccccctccttctcctctcctttgcctcaagccggcagcggcgagctgtccgtcgtcttccccgtcgccggcgggggggtgccaccaccggccgccttctcctaccactcttttcgctttgctcccgccgcctgctcctgaccctgcgggttcggcggcgccgccgccgcctcgccggccgcccgatgcgccgcccaccgccgggctgccgcctcccacggtcatttctttaaagccggcgaactcccccgcctttcttctccccctttccctttccagccccaccccaccccggaaccctaattcgtcggccctctaccggagtttgggttcgtcggtgccggagaagaagaggtggttgccggagttggagaagaagagcacgaatcgggaaccacatccagtgatccaaaatttgcaagatttgaggttggattttttggtgatagagctttagcaatttcggtacaaaaaaaaaaaccttgtcacagatgctcgatttgactatatttgggccattggacatttggacttgatttatgtgtcggtaatatagtaacttggatttcatctgaaggacttgccgtaactaatttgatttgtattggaagatattattcgttttaactttcttaaagagatgctgataaaactcagacgaagtggtgttctcaattagagttacgctccggtattctctacttacacagtagaaatcatgaaaaaggatatcgtgagaacgagcaaagtatttgacaacttcagcctcattgctgtacatatatccccacaaattgcgtagcaaaatcatcgtgcaggtgatgataaacccttaagacaaggccatacaaatgacaactcttgttcccagcgttgcagcttaaggcttccctgctccaagttcgttcgacacacgcgtgctaccaatgaaaatttaaaaaggaaatcaatcagactatgtacagaaaaatttggaacatatgtaaatggatattcagaattgattgagtgaaacatggaacatatatttaaatgaatattcagaactgagtgagaatttcataccttatggctgtgcagagaccaaatggcaccataaacatcagagaaccggtgttgagactacataattaacaagtgagaaagtagaaaagaggaagatgtatttcgataattagttcctttatggtatatgcaattaataatcttagggttcatcgcataccatattgacaacgctgaggtttcaagcttaggattgggaagaagcccagagagcagcacaactaattcaaatgaccaccactccatgctgcacacacaaaaaaaaagacttgttcataaatcaagtaaccaaagattgcattgtgaaaactcaacttatattattttctattcttttttttagaagggaatacacacttacacacaccacactcatacacacgcgtgcgtgtccctaacacacgctagaaatgagattggaggcactgggcctcagtgcatgggaaacgtgcagtcccactaaacgcgcacacgtgtgtgtaccctattacctagccgggtccaaccgaagttagacccggggaaagaggggaaaaattcccccgggcgagcacgagtgtcgaacctggtgttcgaagttcgaacgctcgcgggcagcgtgcccaccggcgacgcttgccacccgagcaagcgctcggtctctatatcattttctattcaagcccattgccatcgacatatatgggtttggaacttagttcacattcccggcccacacatgtgaatggatcgagattgaggcccatcgaaacaacacctggaataatccaaaccactccaaaccatcatggccgatggtatggcaagctcggtgaatcgccggagctccctgaacgcatccatggagaaccccgtccatgtctccctgcagctgggagcctgacatagagagcaagcatagcgaggttgatgcagacatgcagtacaagatggcaatgctcagcgcccgcggcgcccctgctccccatcccggccttgaacaccagtgcccagcacacggcgacgtggcagatcgccgtggcggcggagctggccatcaccggcacgacgacgctctgcacctgcaggaaccggatgtggtaggggacgtacgagcgataggatggtccagcgcgcgttggcgccggcctcggcggcgatgtccgcgtcctggtcgacgcgctggcggatctcgccgtcgttggcccagacgcgctggcggatcctttccaccagcgcgtccagcttgcattcttcctcagaacgaaagagttttctccactgcaaaagattagaaataatttgaaaaggaatagttagtggagaatagaccagtttctctctaaacaccatgttatttcttgtaatccagagattccaacaaatagcagctaacagactaaaaatgattctaagttgagtatggtctgaaaccccattgcaaagagaaaagaaatcatcaaagtttctaggaatggtattccaattgaggacatctcggcaaaaacactaaacaaatctagccatatcacagttaaaaagaatgtgattagttgtttccaaaacatcacagagctggcagaactctgatccatcccaacctctctttttcagttgctcagcagcctgaattctatctttgagagctaaccagaggaaatgtttaatcttcatagggcaagggcatctccaaatctcagtgtttacctctctaatacctctaaaagtcagggctctattgagggatttggtggtgtaggttttattagctgacaggccccaacctaaacaatctctggaatcagaagtttcaatatttcctatgacttctttcataggtcctttcaatctctgaaatctcctcaggacaaaaggacctcctacaagacaagcaatccagacccccctctttgacctgagacactaaaatctcctgttgattgcaaacagcaaaaattgcaggaaacaggatcctcagagggtattgccccaccagacatctctccagaagctgatgtgtgagccgtctcccacttgccacacagaccccaggctcagccatcttctaatatttagcaaacctttccagaattgggaagcatatctctctttacattggaagaaccccccatcatgcaggtatttccttctcaataactctatacagaggctatcatcttcaaattcaattttcatgatccacttggccaagagggcaatgttcattctcctagtctcagtgaaacccaggccaccataatcttaggggaaagccagatcctcccactttaccatatggtatttccccttcagtttgtttccagcccaataatatctccctctaatgctatcaaatttttggtggactccctcaggaagttggtagaaacccatggcataggaagggattgaagagagacaggcattaatttgaacagctcttccagcatgggacagattattcccccaagaattcaatctcttctcaagtttttggcccaggaaatcaaaaccaaggtttaggattttgtcagggccaataggtaaaccaaggtactttattgggaactgacccaccggacaattaaacatcatggcaactctgttagtatcattgtcagacagacccaaggtaaaaatctcactcttgtggtaattaacctttaggccagccatctcttcaaagcagtagagaatgaattttgtagccactatttgcttatcatcattagcaacaaagagaacagtatcatcggtatattggaggtgggtgatacccctaggaaaaatatcagaaactaagccactgaggaccccttcccttttggcactatccaacattgcagctagggcatcactaaccaaggggtaccgagctcgaattcgcctatagtgaatcgtgatctacaaanacctcttnnnngnannangaaaccatttatattaacaaaatatctgttctataccaaatatgtattcatatcagaaagtaaatatccattcagtgaaaatccaatctcatta

SEQ ID NO: 3846 - DNA, 9404 bp, Oryza sativa
  unsure (1)..(9404): unsure at all n locations
cttcatggagcacctcatgtataatcacacagccttcaaggtataaaagcagtatgggttgggaaaataacatctccagctatctcagtaagtctattacaaacacacttactgatgaatttaaacagtcattcagaacacatatgggcctgaattgtggagtgtggacaccaagaaggcaatgccgcccggcgccgaacgcctgcccgcacagcgcgtgtccagcgcgttcggcgcgtgtccagcgcgctcgccatacgccgaactgatgatcaaaatcgaccaagaaaattgcagagattagacacttcttgtacgcgagcaaggtgttcgaccaatacttacgagaaggcggaagccggtgaagttggtgagcgacgaggcgaggaggcgggccggccgacgaacatgacgggggcaccatctggatgatgttctacagcatgcagctcgccaccagcggcgccgccaggctcaccagtctcttggcctccgctgccgcggtgctctcgcgttgcttgtgattggcgagcgcgccgagcagcggcgcctccgcctcggcggctggcttagtggcttgtccatgcgtatcagcctatctgtatcaggctatatatcaactaagtttcctagaggctagacatgggaactgatccctctaatacgtaaaacggagtgactcaacgtataactaattaaatattagctatttttttaaaacaaatatattaatataattttttaagcaactttcgtgtacaaaatttttataaaatacaccgtttagcggtctaaaaaagagtgggtgtggaaaatgagagacgtgggttgggaaaagaaggaaacaaacacagcctaagtattccgctaagggcttgttcagttggaaaaaaatttgctcacacatgttacatcggatatacggacacacatttcaagtattgaacgtagtctaataacaaaacaaattataaattccaccatgaaactgcgaaacgaattttttaagcctaattaatccgtcattagcaaatgtttactgtagcaccatattatcaaattatgacgtaattaggcttaaaagatttctcacaatttcctgacgaactatataatttgttttttttgtctacatttaataattcatgcatgtgtcaaaacattcaatatgacactgtgaaaattttgtttcggaactaaataggccctaattctcaagtctaaagattgtgatgaaacagtgaagttgagaagatgacaggacgtccggaagtctgtttatagggttcagctgcagtgaaatgttttggaaagttccacgcaagcaggcagccggtcgcgagttctaaagatattttattctctttaaaaaaaatcaatttactgttttgcacgtggtggaacttgcttgccaagtatagaattataggccaactataatatctgatgtgatgtgatggtaatgtttttcttagagagatatggttgattttattgaaaatttcaggatttttcataaatactccgttatgccagcagacgagcatagccacgaacctagccaattttggctcgcgcaaaagtaaatgaaaagaaggatcagccacccatcttcgttccatttttgagaaatcatcaaagcggcatcaccaaacaaatcggtgactcggactataattaaatacggcaacacactgatcaataagatatacacaaactaccttcctttttattctttttaacccaaacaagtcttcttagatcatcattgaggacgaaatagccagcgatgatagaccgacaaacatgaagagcaaaataaactaaacgaatcaaacttcgtggaaaaatatgttgtaaaccatatttgtcagttagatccactactacaggaactgtccttgcagtcggccaaaacctgttttgtaaatggctgagcaactagcctatctttagatatctgtagaaatagttggtaattttttgtgacaagttgacaaccacgatcgcagcacttaacgccttgcggtaatcctagagtcgccaaccaccttaatctagcaaaaactagaccaagatgggttttgataactaaaccggctagcggagccgatttttagataactacccgtctcgtgggcaaaattgaagattttcaggacaaacctacaaagagatgtcgcactctcgcagcgccggcgaacgatttacagcgcaaatcgacaaagatggatgaactaaagcaaaaactaaaagcaatatgaaaaacgattcgattgattgattgtagattgatctgtaataattgaaccggccatgtcccttatataggggttggtcttgccctctataggctctcctccccgtccatctcgggatagaatccaaaggaaacctgaaacatgccttttcaagcaagaaaacttcgagacccggcgaaacacacactcggactcggacctgccggtcagaccatccacatgccgctggtctgaccggccctcaaccggcggtctgaccggccaacacacggcggtcagactggcctactcggaggaaaccggcagatttctaaaatttggcaatttttcctatcttactcctaggtgccaaatttgggtgtaaacaagattatcacaggcgtactaacgggatatcaaagccgcttgtatttgaaaacgaatggagagtgatgaaccctgagttcctctcgacactcaaggctgttgttggcctgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccttattcctgcaagcaaatcaaagaaacaagcaagaacaagataaaaacaatctgaattgcaaataggaatgaatacacccgataagttggggtttcgaatacaagcagacggacggtctagccgacacacgcgctgcaagcgaagtagcaatggctaaactttcatctaaacaaaacccaagaaactctaaaggggtacctaactatttaaggaggtgggaggacgacctaagggaaccctagggtcatgctccacctggttggggcgcaccccacttgggccggggtcccagacgaagttacaagcccataggcccattataggtgacgcagcaccttctttttgtgatttcggccgactaggatggaatttggcgatgaagctggatccattggaaagatgactccgagagctttccagcaagtactcatggacccaaaacggagctcgcatgcatttttggcggccgtttgaagtagacactgtagcaggtggccgaactggattgcagaacttggacggcttgattttgatgtgaacgacggttatatctatagtagccatggtcacatcagagaggggcatgatcacttatatatttaggatgtgatggaggtgataaaaaatcgcagtctagttttattcatttcacctttgaggttttgattttgctatatattattcgaaacaatatattttttagctaccacttgatttctggaccgtataatttgcgttgagatgtgtgcctctcagttgaggtcattgcgcatctgcaaaccagcgagtgatcttgttttaatttgcatacaactggttcaattatagtaaaattacattgttattacattgtaattatactcgtgatttctttttttttaaaaaaaaatctttggagtgatatatagacagttccgtgaggctacgaggctatgagccagttccctgggggctatgagcttcacatgtctactcacaacaacactatcggaataatcggtcatacgcaaaatatgttatgcaggtgctttctgttttgtcctgtttcattcccaagtcctactacaattttgctggagattcagacttgcaccccaagatagaaagtcaaactttcttttgagtcaaaattgcggactgatctaagaccaaacaacacacatgtcgtatttattataatgagacctacaaatgattaattagcatgcaaacgacatcagagcggtattgtgccttggcaaccacgatttgagcggtacaaacaaaacaagtcaacacgtcaactgagtgactaaacgcaagaatcttcagtagtgcgtttctaggtcccttccacggatcgaatcgaatccgtccaaacacattccgagttccactttaattaattaattaattaattaactccctataggttggacaaatatccactctcttcagtcttcagcctcagcttgcaaacatcagcccaaggaacatccccagtattttcccgctcattactaattaacactctgaccagtttttcggtttttagatatcacacaatgattaagttacattcaaaaccatcttggtcacttctgaagtgttctcacaaagtaatcccactgctctgtttctctcaaaataaaatttttcccctttgaatattctttcctgattttcagtaattttccatacactggatcgcgactaccttaattttccacacccaaaccctggcaccactgttccatcattgcccataaaatttgatgatttcacactatatatttgctgccattttgattatattagcactcctgaccatggtataagaaaccatattagtcaatgataatgcattatgatgttaaataaaatttactcttcaagagtataaatttcaaaaaaccgaatctatcatggtccaagctgcataaaaccataataattttgatatgtgacacaatgtcaagtattatgtttctaaagtttcacaaaaccacacagttagtcattttgataattaagtcacatacaaaaccatctttgtcacttttgaaaagcgctctcacaaagtaatcccactattctatttctctcaaactaaaacttttcccctttgaatattctttcctgatttctggtccacaaatactggactaccttttccacacacaaaccctggcagccactgttccattattgcccgtaaaatttgatgatttcacactatatttcttgccattttgattacattaacactcgtgaccatggtatatgagaccatcttagtcaacgataatgtattatgatgttaaataaaattttctcttcgagagtaaatttcataaaaccgaatctattatgatccaagctgtataaaaccacaatgattttgatatgtagcacatgataatacgtattatgtttctaaagtttcacataaatacacagttagtcatttttattttgatcaaacaaatgctacatctatttttaaaattttcatataggaatatgtctaaaatagttaacggtgtggtttactaaaattttatagtcacgtaccaaaattcgtataatttatgtaacttggactaaaaaaatcctataattaatttatgtaacttgcaccataaaataagtgtgataagatttactcttaaacaatgatggaatgcctgcatgtggagggtaaaaagaatcactcctctccgatttgaccgccacaaacgaaacatatcaaacccatgaacacactaacttatatgctcatccctataagttggacaacgattcaacgaatccaccattttcagcccaataaacgtctcacagttggtgattcgatcgacatggacgagtcaaccgtggaggagccactgctcgccgtccgacgcggcggagatggcgaggacggagccatggcgtcgacggcggcggaggtgaaaaggctgctgcgtctcgctgggcctctgatggccggcttcgtgctgcggaactcggtccagatggtgtccgtcatgttcgtcggccacctcggcgagctccagctcgccggttcctccctcgccgcgtcgctcgccagcgtcaccggcttcagcctcctcgtacgcacccgttgaacaccttgcttgcacgcaataactgcattgtctctccgatttcttggtcgaatttgtaactgatttcttggtgggatgatctgatcaatccggcatgtcgagcgcgcttgacacgctgtgcgggcaggcgtacggcgcggggaagcaccgcttgctcggcgtctacgcgcagcgcgccatgctggtgctcgcggcggccgccgtccccatcgcgctgtttggcccagcgccggcgagatcctcctcctcttcgggcaggacccggccatcgcggccgaggctggcgcgtacgcgcggtggatgatcccgtcgctcgcggcctacgtgccgctcgcctgcgccctccggttcctgcaggcgcagggcatcgtcgtgccggtgatggcgagctccggcgtggcggcggtcgcccacgttcccgtgtgctgggcgctggtgcacaaggccggcatggggagcaagggcgctgcgctgagcggtgccgtgacgtactggaccaacttccccgtcctcgccttctacgcgcggctgtccggcgcctgcaagacgacgtggaccgggttctccatgaacgccttcagggagctccgccggttcaccgagctcgccgtgccgtccgccatgatggtctggtcagtggcacgcctgacaccatttattgagttgtatgcactgactagttcaacctaaaagcttaagctgatgaagaatgatgggcaattcactttatattccaacactccccctcacgtaagggccccctcaagcctctggtgtggaatagaagtaggttgtaatttttatttaattgcatgccagccatttagaagtagttggaccaccggcttagagcggcgacggtggcaacttagagacacggtggctatgctcgaagtagacaaaaaagaacccgagtagctggcgatgaccagtgcgaacacgaaattgttgatgctcgaacggcaatgaagacgacgaaagcggtgaagctgttgtccaagaggacaacatatagctgcagctccatatcgatgcaacggcgagaagtccactggtgataaagccatgctaaaaagggcgtctcttagcactgtaacaaccagtacaggtagatcacggggcggtggcactgtagcccgagggggcaacgcagtggcaacccggagtttgatagcgtagtagacttgctcgtagatgatcggcagcaagatctcgtcgtagccaggcgtttgaacggatgatcaagccaaagttgcgtggggctagatgatgaagagaaagttggagtcgatgccgatgtcggagacgtgcagatgtcgataaggcggtgggcgatgcaaactcgttctttgaacgggaagaaacaaaaatgatgcacaacattagcaacagtagcaatacggcagcaccacgtccagcactctccgtggtggctttgacctggtcaaggagccctatgtacccatcaagtgtctctctgctttcttggatggagtttttagaagagattgtgagtttagagggatgaggctattaagtgttttgtttagttgagagacatgggaattttagtgggatggggatggagaattgaggaaggaactctctccttttcaatacccgcgtaggggcaggtaattgtgagagaattcctcctttactttctctaagcaaatctcagctatccgtttttattaatgacctaatctctaactaaactccctaccaattttcatcacctctaccaaacaagatattgggattaaaaatcaaatttccatcttaatctaatcatcaattctctcgtataaactcccaatccccttccctcgaattaccaaacaagccgaggaaatcttgtttgcttgcttgcagattgtttggaatctttcaacaccatcgctggtttcttgcttgcttgagcaaatcttggaacatgttttgtgatcgagagagcaaattaatcttgcttgaacaaattttgggaatatttttgtgaggattagctggttgatttggttgtgtgcagcttggagtggtcgtcgtttgagatacttgtgctgctctctggcattctgccgaatcctcagcttgaaactgctgttctgtcaatcaggtaatttgatcataagcaacacacatacaaatcagctctcctccttcccatgggtaatttgttaactccaatttaatttgcagcttgagcactgcttctctcctgatcatggtgccacgtggcattggctcatctttaaggtctgtatcgcctctaaactccattacttcattatcatcttttagaacagtgccctactgagttgttctcatacagggttcgcaattttgtcttgcactttttgtattttttttgtggggttgtgggactgagatttttgaaatcttctaaattccccaaaatttctgaacgacgatatttgaaatctatcaatctacctatctattatctattatatactaaaggttcattaaatttcctacaaacgctctcatgccgtcacgtgggattcctacaaacgttcctaaaccaccacatgtcattttaataaattacaaaaaaaaatactaattaaaaattctaagaagaagaaaaaaatcttaccattaattgtcacttatattggtggacctgttatttttaaccacttgatgttatccctaaaatatgaaaacaaattccgatcccctctatcttagagcttgtttagattcttacccaaaattttacaccctgtcacatcgaatgtttgaacacctgtatgaagtatcaaatataggctaaaaaaataactaattacacatattgcgactactttgcgagacgaatctattaagctttattgctccatgatttaaaaatgtggtgctacagtaaacatgtggtaccgacggattaattaggcttaataaattcgtctcgtggtttaatgacggatactgcaattatttttttattagggtccgaacaccccatatgacaccctatataatatctgatgtgacacaccaatactttatatcccctggatctaagggcctttcacagtgctccacctaggaccggtgctatggggtgccacggaggattttgtccgatgtgaaacgagtgcccgcgaccaagttaggctcttcgcgtccatactgagcgacgcagaacttgtttgctcgagtccacgcgcggccaaaaaaacgagaggagcctgcgctgtgggcttcggttctttgccgcgtcgtgacctcatgccgcatccagtgaagaaattcctgattcgcccacgaaaaaccccatcccgccccagcgatttcccctcccgccacaaccattcttcctcccgccaccgaatcaagaaaaagcaagaaaancgnngnncnntggcaggntgcaagacgaatatcagct

SEQ ID NO: 3847 - DNA, 2313 bp, Oryza sativa
  unsure (1)..(2313): unsure at all n locations
aggtaacaccttataactcgtttttaaacggaacaccggaagagggatggtaaaacatttataactccattatcccacagaaatgtaagcacgcgtaggcccccgtaactgaagtaagaacgccaggtctgatttatattgacagactccaaaacggttccaggcaaacggagacgcctcccgccgccaagaaccggcggccgctcgcgcggctgaacaagaaccgtcggccctaatcctcgccgctcgctggatctactcccccacctcctcatcctcctcctcccccttgcccttgccggtcggagaagcggcgcggacaaccgggaggcgaggcggcgtggtcgacgggagacgaggcggcgcggctgaccgggacgaggcggcgccgacgacgggagaagaggcggccggagcggagcgccacagtaactaagnagaagaaccggtgggtgtgncggattgggagaacaaggaacgncgggtcgccggattgggggaagggaaagggctggaaaggagtcgctgaaaggtagttaggaattaattcgttccgctcctcatgaccactcgcttcgggtaacgcccactgtgggctgggtttctttccatatatagtaccttcatcccatttagccacacatatatgggtacttgcactgtgggatgtgtgtctttgagctgtgactttgggctaggggtaagggccccatagcttatactgctattgccctaaacacccccttactatgggcacggccaccctgcatcctctcctcttatttctccgctttaagtaaaatcgaaaccatcgtgtataatgatgtgggcctgcaccggttgaccggcatggtgctcccatctgtacacgaggtatatcaggctatcagctagtactcacgttaattcagtgctggcaccacagcttctccaagtttccaaacaatctgcagttatatagttcacgatgggagcaaaattgcagtcctctagatgaatgtacgtatatatatagttcacgattaactgggttttattatctccgtagcgtcacagctgttcactttaccttttctcgttcatcagagaaatcagaactcatcggtatctttctactcctaaccttttgttctgtccgattagtgtatttctgttcgctcccttttgaaaggaacaagcgtcctacagaatgcaatttggccatgttccaatggtaataaaaatatattctaacacggataaaaaaaccttgtgctactgatccctaaaagtctatgagagaccctttagtagagagtctaaaaaaggagaaaaatatagaaaatttggaaaaaaaataacagtttaaatttatgggaagtatttttttcctatcaaaatccattttttaaggattataaaaaatagaatattctactataccataaatatttatcgaatatcctctactctttataattagttatattcttccgataaaaccattaatatgtagggctcagtctactatacccccaaatattagtgccatgtatatatccatatgtatggagcaactgagtcacaactgcccattagatgctaataggttaaggctgaaaaaaaggcatgtttaatattgttttggattcatgattttttttaactggatattcgtagctccacaaatctatccatctagattttttcaatgggtttgcttataaatccaaaacccatagatttttttaaaaaaaaactgaggtaaaaatatgaaaattaatgttggaattctgataaagggaaaaaaaaaccctcccataatttcatctttaatttggtcatcactacgtcatgtgcctaaataacgatgttctaattaatcgcaaaagaacaccgatatttcttactttgcacaaatttaacatcttatgcatcttgcatgtcatgtgtatagatactaagaaagtaggagtaagcataagtaccaattagttgataccctgcacgttgctgcgggatagctatatcgtgaatttgtaagatgtaattctagaacttttgattattggtatagtatcattacatagaagggaacatatagttgtaaatttatcataattgcatgatcaacatgcttgaacgttctatctgtacattgtattgctatatgaatagaaatgacatgattccaattaagatactcctattttgaagaaccataaatagtaagcaaacatgannnnnnnnnnnnnnnnnnnnnnnnnnnnnnnnnnnnnnnnnnnnnnnnnnnnnnnnnnnnnnnnnnngnggagcagtccacaaanngcgccc

SEQ ID NO: 3848 - DNA, 26523 bp, Oryza sativa
  unsure (1)..(26523): unsure at all n locations
ctactttggcacaaattgaacatcttatgcatctggcatgtcatgtgtatagaaactaagaaagtaggagtaagcataagtaccaattagaggatcccctgcacgttgctgcgggatagctatatcgtgaatttgtaagatgtaattctagaacttttgattattggtatagtatcattacatagaagggaacatatagttgtaaatttatcataattgcatgatcaacatgcttgaacgttctatctgtacattgtattgctatatgaatagaaatgacatgattccaattaagatactcctattttgaagaaccataaatagtaagcaaacatgacactatttttattatgtactaaattggcttaagatctcactcagatatattaaacaactaatgaaatatttcttttttgagaaaacaaagagaaaatatggataatgttgcatacatatgttggtatatgatcttaaaaaaacatattgggtgcatgaatctagtaatttcaagaaacagcatgttcacctatgagtaaatgggaggaattgtggagaaacaaattcagtgatcgcaagtctgaaaaacacaaagatttggcacagccttttaatcagccttttaacacaaagagtggaccaatccctcaatactttaagttaccatagttgtgatacattgacatatgaagcttggtgataaacgaagaaatcagatatgaaaagaagcaagatcatgatagaataccaaaaaccaatcaccataggagatagacatatatagatatccttgcaatttgtaaagatcatcgagtgttgtaatatgtcccaataaattttcgatgtcatctatgacagtggcaaaccaaaatttcattggaccattgacatttcctccttagatgactgaggaagcatgttcaagcataaatattccaagaaaatccattgcatcagcctagatatggctagtagatgcaatagaaaaattaaagggaataagaaagaggtagacacaaatgtagtggtgtaggctttctgtgggagatgtattgtttagtggttagtaataaagggagatataatgatatgcatgaggtaattaagaggaagacaaaaagcattggtcctctcacatgccattggctgagaagaacttgatttaacggttgatttgcatagacgcgagatgatataataatcaatataatcttgatgatgtggcctcacagaatttgagctttatagcatgaataacttgtagtgggtaccaactatataggaaaaaggattaaagagtaggctggtataaatgaaaacatccatccacacaaatgtttctagcatgactaatatatatgatgtatgtttgtacttatataatctatcttttatctaatagacgatgaaagttttttggtgtttgttgagaaagagaattacaggcatttatttaaaagagaaatcatccgaccttcaatttatccttaatttacatgtccaatttttaaaataattttgcaataacattcaaaaggatggtcatccaagtaagcggccaactccctagaatttcgagaaaatctcctcaatgtccattaaacacactctaatccctcctaagacatctagaacttctcttgatacttccaacaaaattggaaatcctataaattcttagtataagagaagaaaaacatctggcttccttttttttacataaatcggtatagaacaattattatacatggttatatatctaatgtcttttaaaaaaacttaacaaagttctctcttttaccatgaaattacacatagtcagttgacttcaatattgagatgccttatgcacgaattggttgtgccattatttttatgaatccgaccatgttccctcatccatccttttaaattcactatagtctttagtcaaataatgaataaaggatagatgatgatccgagcatcatatcggggtcgtacaaagcatgtcttgcctttggtatcatagaaatagcttatgtgtaacaccttaccaccgtttgtagcatatagtatggtgcattgtttaaggacactttcatttcaacaactcaggtgagattttccatggcacaaaatctacaaaggtcattagcgagtgattacgtaactactaaccattgtatatttgttttatctgtttaaagaaacttctatatagaaagatttttgcacgaaatgcattgtttagcagtttataaagcgtggcgatggagaatgagggacttgctcacccaagtgtcctagaagtggttgtggtaatggtgacaggatatgtgctatgcgtacccataagttcgtagcatgtagtagtggtaaaaattccataaaataaagatttcacagtttcaagtaattttagtttacaatccacgtgttcctacagtaattgcaatgcagtcataaccaatgttgaaagcaatcccaaatacctttttgagagatctctgaagtttaaaataaaataaaataaaatatcatctcaactaaaacccattcgaaattgaatattaactttactctaatatttgttttacagaacattaaaatggaaagcccgcacatatgcccgggctgccttcttagtttaaataagttttgaccaaattcagtttacccttgtactacttaagttttatttacatggcaaacatgcttttcttccttcagctttcatgtcattggattagacaatgaactgattagttccaccaattttgcactttcgcagcacacgcgtctcgaacgaactaggtggcgggcatcctcgagcagcaaggatggcagtgcgagtggccacagccatgacagtgcttgtatgcctcgtgctagtgatagccatgattctgctgcgcaatgtctggggatacgcctacagcaacgaggaggaagtggtggcatacattgcaagtatgctccccatcctcgcggtctccttcttcgtagatggcatcaatggtgctctttcaggtgcaaatccataccatatttctacttgcgatcaattatcaaaacattttagctgtacttttttttctcattatcgatcgatgagtttttcggatagttcatatcgttaagtcgatcagtagtaataaaattgcgtggacctcggaacatttcaggagttttgacaggatgtggtaagcaaaagattggcgctcatgtgaatcttggcgcgttttacttggttggtattccgacggctgtgcttcttgcatttgtcctccatctaaatggagaggtagcactactccctcaatcccttatgcaaaatatgcagtgcagattgtttttttgctgattcatagaaaagttccggtgtagctttgtatgatgatgatgcattgtgaaaccagatgattgaacctgctagctgtttccataaaacagggtctttggcttggcattgtgtgtggcagtatcagtaaagtagggatgctcctcttcatcacactgcatacagattggggaaaagaagtgcaaaaagcttcaccctgcaaacacttcggtttgtatcatgtattcagtggaacttcggtttaattttgtttcgtttgtccaattttcaggttatcatgccgaaagaaagggtcttcagttcaagtattccaactcgatgaagaattcgagaaatgtaggtgtagtattctgcaatgaagatgtactcaacgcggttctttaataagagtcagtgtgttgcaagcggttatctagcataaaaaagaattattagctctctcgctcgcgaacaaatttcctgcctcaaaatagctgaattgaggttcttcatcttaaaaatttcgaaatcaattctctattaatcgactattatagttgaattgtaaagtcatagatgtcactatactctatactatcaaacataatttcagtcatttgaattgaatttgaaaaaaagaaaatgtatacaaaaggacatccactcaatggatcttaattagggaatcccacttcggtttgtatcatgtattcagtggaacttcggtttaattttgtttcatttgtccaattttcaggttatcatggcgaaagaaagggtcttcggttcaagtattccaactcgatgaagaattcgagaaatgtaggtgtagatttctccaatgaagatgtactcaacgtagttctttaataagagtaagtgtgttgcaagcggttatctagcataaaaaagaattattagctctctcgctcgcgaacaaatttcctgcctcaaaatagctgaattgaggttcttcatcttcaaaatttcgaaatcaattctctattaatcgactattatagttgaattgtaaagtcacagatgtcactatactctatactatcaaacataatttcagtcatttgaattgaatttgaaaaaagagaaaatgtatacaaaagggcatccactcaatggatcttaatcagggaatccgtttccagggttttcaatttcctgttggattgaagtttctggaattttcatacttttttgcacaaaattattttaaattttaacaaaatgtaactgaatctgaataaactttaaccaaattcaacaaaaaaaggaaaaaaaaggggggaaattttccaccgagatatgcttgtgcgcagggggggagggggggttggaggatgcgttagtgatggacaatcattgtgccagagaaatgcatggagcaaccaaaggaggtaatttcgtgtggacaatcattattttcccaaacgatgtacatgagaagatggaggaggtgagagacagacaaccatagctagctaaagatggcaccatgtttgcggcagcatggaagagtgagaggaggagcaggcaaggcccaactccgcatgcacagcggcgacaaatcggtgctgaaatgactcgtccatgggttctatgctacggatatcatatgcatccctatagatgatacgccagcgctgctgcccgccatgctcaatggcggcctctactttgggcccctagatcccgtatccaacatcatcaccaatgccgttggccacctcccgccaccggccaacgtgatggtgcagtggtcactgaaagcccttgtcgggttcttgatatgctacttctactacatgcctagcctggaggcgctgtgctacctatgctccaccgaggcggatatcctcaccattgtccacctcatcgaggttgattgttgcacgcgaacatttggcgttggctctggcaccacgaagaccttccccagctgtgccacggggggaccgggccatgctaacatggacagcctcaccacggccatgcttacgctctccttgaggttacgcaagatcgccggtcttctgtccacagaaacgggtagtcattccctgaatacccagtgctgccacaagtctggcacgtcattgggatgtccaaggtttgggtagtaccattcatttctgccttgtcacgagcacattcgtccaagcgtttcatgaggaggtccatcttagcggcgagcatgtccatctccttgactgtatgcatgccccactaatgaggttggagtcgttctttgctccacccttggttagagaccatctactcaattagttctgatgtgcgagcaacaatgagtgacaagaaggctcctccagcagcagcatcaatatgatcttaggccaactgcgtcagctcgttgtagaggttctggatgatgagccatttatccatcccatggtgaggacaagccagttttgcgcgttattgacggtcgttatcgatcagtttcgaccatcaatattactaaaacaggagagaactagtgatgcttgcaatacatatattttttagaataataatattccactagtgttaggtttactaaccttttgcagagaatgatcataaaaaggaggagaatcgacatcaacaccaacgataaatcaattagacgatgttgagaaccagacttatgcatgaatgggccaagaactcagaattgacacgacaaactgggccaaaattgacaagtctgtgaagagaagcaacagacgaggccgccagccgaaattgggctggatcaagccgaacccttcttagcgccatccgatccagggcttcgcctggacggtgtggattagccccaaatggcaggtggagggcatttccgaccattccaaccgccacaaccgtcattgggaggctataaaaggagttgccattctcacttcactcacacacctcaagcaagagctctctcattcctctcaagtttagtttagtagtatctagctggtggaatagaattagaagaggaatcaggagttcggaagccttcggaagagttcgggtatggctctagcagctttcctttcctcttttgtaagctttgtacttttattagaatactcttctatatacatttatggtattgaaatactttccgagtatatgagtaccaactttacattatgtccttgttatactaaatatacggctagcttatctaggagatgctttgatgcgggtatagtgtttgcttatacaattactatatgtcatgacgatgatattagagtagtatctggtagtttagacgtggtgtctagattacaagatatcattatttggggttatatattgcggatgagagtagggccgctgaagatgacagctcagtacaggtattcctccacgcctatatataatcctaagttaatttcctggggagggtattcctccatatttagccccggttggatggtcatgacgggctgtcgtaaagagctcggcagtcagagttggcttctcgaagtaccaggagagcatcggatagagggtattagctagtatatcggttagctagaattatactagaagtataggaatagatttcttttctcttatttccacctagcttagataaattattatgaggatgagtagtaatgcttgtgtgtcactctacccttggattatcttaacccctgcttagaatatgattatcacaagtaatatataaattattagttgagttctctctacatgatcttcccacgggataaaataaatacgatacccttggaatactctcggttgaaatgctacaatggtatatccgtgcgcttgcggatgaaatgtgtaaccataatataccagaattatttctgcgccattgctgagaattatgttgctagtaatgtcattaagaaataccaacacgcgtcttgcttttgtgccacatggccggcttcttgcgcttagtcttcagacttggtatcggctccctcatagcctcttgaagtaagcaagatgtgggaggggcacctgcaccaagtcttgacgataccgataagggaacataatttatcggcagagcactaaagctggtcatgggagtgtcatcgtcttcctgcatataaatggacagatgatcagtgcttgaaatagaggaagaattgagtgcacaaagattttacctcagcatcatcaggaacgaatttaggatcaagtaaagcgaggaagttgtagactggaggttgaaaaggtgacgcttccattcaccccaccatttgatccatggtctactgccgatagtacggctgtcccagtcaatgaagggaccaagatttggaccattgaggtttgggagacaatcgcacttaagtgcacttgtgatcgttccccgagtttgtatctttttgatgaagtaaactttgatagggacttggccgaaaccaagttgatgggccaccactaatgggtgatagaattcatacgagatatgagagtggtgtcccatagaaatgccggtctgaagaatgcaaggggtgatagccgttataaatatctctcggcttgcttcatcagagttaatgttgttcagattgaagtccgatggaagttcatagccttcgaattcttcataagggaaccagtttctggtgcagccctagggaaaccagtgtagaacctattgaaccagagcatgacattttcaagcgtaaggttgctgctaagatagatgattgctgcttcgccaagtgacgtgcatctgggaagagatttttcatcaccttctgcgaaataagccagaaatcttgattcagtgacgtgcactccagtgattttgacggtgtagaacttaagccagagttgtacaagccaccatggactgcccaagtggccgatgggctgaccctccaatagtcgcactgcagaagacaaatctctccaagcagaaattaagaaaggccacatgctctctgtcggttactgctccagttctggcatgcttggtgatacaagctgaccagccgctgacacatttggtctctagcttgttaacacattttattctcagactacaaagattagccgatgaagtgatgttcaaaccagttagcatgacgatatcgagcaaggtgggactgatcggcccatggttgaacaagaaggtgtgttcagagtatcggaccaaaaatgtgtagccgatgcaatcagagactcaaccttttccggctcggccaaagatagagcgatgcactgagttatgcctatattggaccagactttgtgcttggcttccagcatactccgatactagtttctctagctgggaaccttggagggccaagatctgaatcttaaattccaatcggaaatgcaggggctagatagcttgaaaggaattcgattggtctccgcgttaataaattcaatgggatcctcattgccccatcagtccgagaaaataatataatggttgatcgactagaggaatcactatttgatctctcatttgctacagtgaaatgagtagtaaaaaagagatgacaacaaagaacacgaggcgaaaaccagagaatgagggatttatggatttagtgcggtaaataaagaggaaaaaggagagttttacggatattacctctaggatgtcgctagtcgtcgccatttgaatgaatggtggagttcgccagagggggtttgatagtttcgttttggttgccggagttgagaagagaggaaattagagcttgttggtgtaggaaacgaagaaataaagtggcagcacgatgatggcagaggtgaccgttgctatttataaattacggtgttaaaggctgagatgggctatttgggccattataaaccctaatgggctggtgttaaatgtcctgtgacggatgaattccgaagcatgtctatccatactccagaattaggggaatgtgttaatggtaaaatttggtatattccattgaaaaaggaataagggatgggaaaaattaacggcgtaattttgtttggccaaacagggattggatcgcctaacaagtatcgacaggaccatatcggctgagtgttgccgatagtagcaagttgtgttcctatcggattcggaggaaggggttggtaatattgccaagcaaagatcgagtccgccaaggagataattgcatctattaattaggataaaagtcagttttcctttaggtgttttaggagtctatgttagagtccgtaatgggctggtgtgtttttttttttcaaagtttgtgtcgtgcccgatatggataggttttgtactacgtgcataaatatatgcctagggtcttctaaaaaaacaacaaccattcatatactctcggcgcatcgccacccttttacttttctactttttcgacgagttcttgcttcgagttagggcatcggcttcgatcttctgacgagagcaatggcttgtcacagtggcttgcgttggtggattagggcgttgttttagatgttctaatctatcctattcgatcgctggttattatatgtcttagttaatctaacctgatgactcgattagctatatcggccatgtcttatttacggttttgccggcatcggctaatttgttttgtcggtttggattagctaacatatccaccaccctgaaaatcagtcaaggcatgattgtttagactttatgcttcttttcatactttgtgctgcatcagccttagtcatgcttagaattatagaaactaacctgcttcttgattgctaatagggatagaatcggggtttcaaccgatcttacatgatataattttttagctttgtttaaatcctttaatcatgtttttcatgttgtatctgtccctcatacaagtgtatcacactatttaaatatatcaagcttgctcttgaaatatttatttagattgatattcttgcataaggctatattggagtattagccgatacggtacctatcttaaccaaaagtatcatatcatcggctatgatataaactacatttaatctttaatttgtttgatctgatttacgagcaatctacactatctcattcaatctatactatttgcttacatctcatagaaaggttgaatcatggaacatgtctgattgtatctacagccgatggaacatattttagatttgtcttattttattcatcctacaccttacaaccaattcggacaaattgcatcggctaggtttacatgatacgttatcagctcataagccgaccggctatcgtaatttaacttgattttcttgtttattcttgtttggtgtagggtcaaaccaattggcacgtcctgaactcgaaagcgagatttggatctgcactggagctaagcataactcccagacccccatgtttttttcatcaacaggaagcgaacgacctccttggaggcatcgttcacgaggttttgtttccttgcctgatgagcttcgatcctttgggtaatcggcgttctctcgagtcattatcatcaggtttgtgtgagggacgagtagatcttctctctcgccctctccctcctcaggccttctacctgatgatgatcgggagcccatcgatgatctcctggtttggagccctactcggaggggcgtttgcaaccctgtgtaggattagcggtgatcggtctcgcatagcggcgccggcggtcaatttggtgctagtgcttctcttggggtgtgtaaggactaaggagtcgctagcacgtggtgatttttttttctttttcctgattatagccttcgaggacggtaatcttctattctttttcctcctataccgtgtgggtcgtaaaaaagggttgctttcagctttgtcctgtttcattccaaaccttacaattttgttggagatttagacttgcatcccaagttttagaaagtcatctttcttccgagtcaaaattgctgactgatctcggaccggacaacaccacgtcttactttttaaactgacgcctacaaataatgaattaggatgcaaatcacattaggtatttgtgccttggcatccaagaattgggcggtacaaacaaaacaagtcaacacgtcaactgagtaactaaacgaaagaattttcagtagtgagttgctagaggccccttccactgatcgaatcgaatccgtccaaacacattccaaattccactttaattaaattaacattaaattaactccctataagttgaacaactaatccactttcttcagccctagattgcaaacatcagcccaagaaacgtccccagtattttcccgctcattgctaaattaagtttttggttttcagtattattacacaatgattaagttacattcaaaaccatcattttcacttttcagaagtgccttcacaaagtaatcctactttttttatttctttccaactaaagcttgtttctcttttgaatattctttcgtgatttccagtgcacacacactggaatacattttccccacacaaaccttcgcagctactgttccattattgcccataaaatttgatgatttgacactatatttgttgccattttgattatgttgatactcgtgactacggtatatgtaccatcttagtcaacaataatgtattaggatgttacaaaatttactattttataaaaccctgtctattatatattgtggcacgtaatctcaagtattatgttcactagagttttagaaaaccaaacagttagccattttgattttgatcaagcaaatgttacttccgtttttcaaaattttcatataggagtaatggagtatgtctaaaatagttaacggcgtggttttgtgaaactttataaccataatattcgaggttatgtttcacgtgctaaaattcctataatttatataacttggaccatataataagtgtgatagaatttactcttaaataatggaagcccagcatgtggagggtaaaatgaatcacacctctccgatttgaccgtcacaaactcgtcaacacaccaacttattatgctccgtataagttggacaacgaatccaccattttcagcctagcatcagcccaagaaacgtctcacagttggtgattcgatcgacatggacgagccaaccgtggaggagccactgctcgccatccgacgcggcggagatggcgaggacgaagccatggcgtcgacggcggcggcggccgcggcggaggtgaagaggttgctgcgtctcgccgggcctctgatggccagcttcgtgctgcggaactcggtccagatggtgtccgtcatgttcgtcggccacctcggcgagctccagctcgccggctcctccctcgccgcgtcgctcgccaacgtcaccggcttcagctttctcgtacgcacctgtcgtcgaacaccttgctcgcatgcaagaactgcttcatctctccgatttcttggtcaaatttgtgactgatttctcggtgggatgatctgatcagttcggcatgtcgagcgcgctggacacgctgtgcgggcaggcgtacggcgcggggcagcaccggctgctcggcgtctacgcgcagcgcgccatgctggtgctcgcggcggccgccgtccccatcgcgctcgtctgggccagcgccggcgagatcctcctcctcttcgggcaggacccggccatcgccgccgaggccggcgcgtacgcgcggtggatgatcccgtcgctcgcggcatacgtgccgctcgcctgcgccctccggttcctgcaggcgcagggcatcgtcgtgccggtgatggcgagctccggcgtggcggcggtcggccacgtcgccgtgtgctgggcgctggtgcacaaggccggcatggggagcaagggcgccgcgctgagcggcgccgtcacgtactggaccaacctcgccgtcctcgctctctacgtgcggctgtccggcgcctgcgagacgacgtggaccgggttctccatagacgccttccgcgagctccgccggttcaccgagctcgccgtgccgtccgccatgatggtctggtcagtgacacgtcttagtcctgacaccattgctggtttcttgcttgcttgagcaaatcttggaacatgttttgtgatcgagagagcaaatcgagcttgcttgaacaaattttgggaaattttttatgtgaggattgattaactggttgatttggttgtgtgcagcttggagtggtggtcgtttgagatacttgtgctgctctcgggcattctgccgaatcctcagcttgaaacttctgttctgtcaatctggtaatttgatcacaagcaacacagatacaaatcagctctcctccttcccatgggtattttgttaactccaatttgatttgcagcttgagcacttcttctctcctgttcatggtgccacgtggcattggctcatctttaaggtttgtttcgactctaaagtctaaaatccatttcttcatacaagtgtcatcttttagaacagtgccctactgtgttgttctcttacagggtttgcaaattcgtttggaacattttctattctgcttcttctttttttttggggggaaattcccgaaaatttctgaacgacaatatatgaaatttaaataagttttgaccaaattcagtttacccttattttatttacatggcaagcatgctttcttccttcagtttacatgtcattggattagatatttagaactgattagttccaccaattttgcacttgcgcagcacgcgcgtctcgaacgaactaggtggcgggcatcctcgagcagcaaggatggcagcgcgagtcgccatagccatgaccgtgcttgtatgcctcgtgctagtgatagccatgatttttctgcgcaatgtctggggaaatgcctatagcagcgaggaggaagtggtggcatatattgcaagtatgctccccgtccttgcggtctccttcttcatagatggcatcaatggtgctctttcaggtacaaatccataccatatttctacttgtgatcaatcatcaaaatatttcagctgtacattttttttctcattgtcggcgagcttttcgggtgaactgattgattcatacaattaagtcgatcagtagtaataaaattacttggacctccaaatgtttcaggagttttgacaggatgtggtaagcagaacattggcgctcatgtgaatcttgctgcgttttacttggttggtattccgacggctgtgctgcttgcatttgtcctccatctcaatggagaggtagcactactctctcaatctcttttgaaaaaaatatgcagtgcagattgtttttttgttgattcatagaaatgttttggtgtacctttgtatgatgatgactgaaactgctagctgtttccataaaacagggtctttggcttggccttgtgtgtggcagtatcagtaaagtagggatgctcctcttcatcacactgcgtacagattggggaaaagaagtgcgaaaaccttcaccctacaaacacttcggttagtattatgtattcagtggaacttcagttaactgtgtttcgttgtccaattttcaggctatcatggcaaaagaaagggtcttcagttcaagtcttccaactcgatgaagaattcgagaaatgttggtgtagtattctccaatgaagatgtattcaacgtggttctttaataagggtcagcgtgttgcaagcggttatctagcataaaacagaactattagctctctcgctcgcgaaaaaatttcctgcctcaaaatagcttaattgaggttcatctcaaaaatttcgaaatcacttccctattaatcgacaactataactgaattgtaaagtcagagatgtcactatactctataccatcaatcaaaaattcagtcatttgactgaatttgataaagaaaatatatacaaagggacatccactgaatggatcttaatcagtgaatacatttccagggttttctatttcctgttggactgaaattttggaattttggtgtcactttttgcacaaagttatttgatttttttaacaaaatgtaactaaatatgaaaaaactttgaccgaattcataaaaaaaagaacaaaaaggaaaattgctgccgacatatttgcttgccggggagggtggggggtggtgaagggacaataattgtgcagggaaatgcatgaagcaaccagaggaggtgattttgcatggacgatcattaattttcgcaaccagcgatgtacgtaagaagacggaggaggtgaaagatagacaaccatagctagctaaagataggcgccatgtgtgcagcaacatggaagagtgagaggaggaccaggcaaggcccaactccgtatgcacaccgcggtgacaaatcgatgctgaaacgactcatccatgggttctacgctgcggctatcgtgcgcctccccatcgatgagatgccagcgctgctacccgccatcctcgacagcaacctctactttgggcccctggatcccgtatccaacattgtcaccaacgtcgtcagccgcctcccgcctgcggctaacgtgatggcgtcggcggttgctgaaagcccttgtggggttcttgatctgctacttctgctacatgcccaccctagaggtgttgcgctacctgcacaccaccgaggaggatcttgccaccgtccacctcatcgaggccgactgctgcacgcacacattcgacgtcggctcgggcaccaccaagaccaccctccgctgcactacggggggccacgggccacaccgacatggacagccttaccatggccatgcttacaccattgtagaaattctggatgatgaacaagttatccaccctgtggtgaggtgtcggcccccggttttgtacactggaaacctcatgtgattacaataccattccctggatcagtagatggtatacacatggcaacgttgtatatcacaaagccgatatcgttatacaggctttataatacattaataatacaagggttgctggagtggcacccaaatagaccaagcattgtcatctataagaccaaatatccaatgaagtagatacggtagcggaagcgaagcagcgacggtccatcttattccacaggcagcgactggtgaacctaggtccctactccaccgtattcgacatctcttcatcagcatggcacacgtacaaatcggctccaacttctccttctaaaatatttaattaagcaagggtgaataccaaccgtactcagcaagccaccactacataatgcatatagtgctcacagggatatttcaaggatgccttggttcgtttgcataaagctagatttcacaaatcatttcacaaacctatgacttagcagttttaactgaaaacaacattattgttgaagttgtcgttaatccatgagggttcatccaccttccccaatcctcgcttggtccggtttaccctcgcaaccagtttttcccacattctccttcactacatccttcccactcatcgggcaaggtcacacatcttttcctaatctaagcaagattaacaatctatgaggctagtcaagagtagtgtaagtcccgatgctctttaatcacgacaacgactattcgaatagattagttttcctcacactacagtggatgtacgcttttaatcccgcactccgtgacttgcccaacatatgagcctaatcccaacacatgaaactcgtcacgacccggtgtttcagtcaccctcgtattgtggcacctgccccaaggactatgggtccccattgcactcctaacaaaacataccacctcgagccggcagtgaggggagtcctggcattcccgggttcagggagatatataatatatatacttatagggggcgttttaggcttttgatgtcattaactgatcacaacacttcctcatcacaatcatcaagcatccagaacctaccatgactgaggtgccgccccacaaggatttcttaatccgtccagtctatacccatttaagaaatggggttgtactcggctcggttcctacatagctttttgactcggtccttaattaaccagggtcggtgacttgccgtttccagaaccacccatattctattcatgccgccccagtcaaaatcattttgttttattaggtttttggttttcacaaaggttttgtgttacgggtggcgctcatgtctccacccgtcttccgacgatcacttacacggagtgatcgccacatccacatccatattgttggtgatatagactcgggggtatcatgtttagagggaggaggccgccctcatacccacgtggcactcccccgaggagggttgggcccggggtggagtggcggcagccccctcctcgcccgagggtattaagacttgagggagggggctgcccccggtacccacgtggcactccccaaaagggatcgagccggggtagggtggcggctgccccttccatggctaggggtcggggtgccccgaccccctccgcaggacgccacgtgtgtggggttaggtgtgcgccccaacgcctacctaaccgcatttaaggcgacctaagcggcgcaccacgccgcatttaatgtggcatgcagtgcgcctgaccggtctgtgaccgatcagtgacaggtcgaatgactgatgggaccagggtaatgtgcctgcacactaccacgtgtgtcaggcggcgtgcagcctgccctatcccgtcaaatcgtgtcatggccggagtcggttcatccgctctagtcaatgcgaggctcctgtttcccggtgccaacgggatcccagaagtcatcacccattagatggcgactggcaggggcgccccccgtgtcaggcggcgtggtttgatgggccccatgaccaagacgacgtgcgtatggctttccaagtgaagaaacaagacttgcattttaatgcatagtttgtaatccatctcccctaagttaggtttttgggcccatgtggtaaccccttgaggtataaaaggaggtccaggcctactgcgaggggggacaagccctttttttttcctagagcaccttctgcccctcatcatcaacaccttctattccaacaaggagatcttataatctcttgcaagatcagctaagcacaggagtagggtattacgcttctcagcggcctgaacctgtataaaccccttatataggcacgcgatcttcgcaggcgggcagcccgccgatgaagatgataaaacataatcagttttgtcattgttgcaagcggacaccccgccggcaaaaatgatttcagaaggaaaataagaagttggaaaagtactaaaaatttgtaaaaaaaaatgtaaatgatgtttaaaaacatctaaaaaaagcatataaaaaatgtaattgatttaaaaaagtaaatgattttaaaaatcagtaaaaaaagtaaatgattttaaataaatgtaaatgattttaaaaaatataaaatcatttcaaaaaatgtgattaattttataaaacatatataaaatgtaaatggttttaaaaaacatttaaaaaatgtaaatgattttaaataaatgtaaattatttttaaaaaatgtaattgattttaaaaaacatatataaaatgtaaatgaattcaaaaaatgtaaattggactacataataaattgtttgtcaattaaaacatatcatcattacataccaaacaattacttaaaggcatagtaatcattgcaaacatgtacaaacgttactctttcacatttttccccacaccatccttgcgtatgtaaggcttcacggtcttctcagtagatgccgccaaaagcttaatcttttgtacaaattgagtatacagtgccatactatcgtactggttgtaatcttcgacatcaacgactccgtccactcccaagatcttttgttttcctgatggaactatttctttcttcaaatttgtagggtctgtcacatagaacacctgggccatgcgattggcgagtacccaagggtcatccttgtgacccacattctcaaggtcaacaacagtaagaccaaacttgtcactaatgacaccgtttgggtattttacccactggcacttaaatatggggaattgcactatgagtccatagtcaatttcccagatttcttcaataaacccaagtatgatagtttttctcctagggaatcaatttcctccacacgtacaccgctgttttgagtgacggtcttactatctcgagctcttgtactaaacgtgtatccattaatgtcatatccctcccaataattgactatacttgatggaccacatgccaaccttttcatagttatttcctcggtggttctccattctatgaagagacgcttgtgttctttcatgatccacttggttgtgcgtcccgtattgttagatcttagtagtttgatgttttgatcgatgtaaggctcaacaatagcaagctgatgaagaacgctgaagtgagcttctcgaagtgttttgtaatcatgggcgacgaatctcttctttcctttggtccccctaccagtcaattcaccctcgtgtcgaggtacatgtattccaattgtctttccattgttgaggtaatcgataaagcactcgacaacctcttctgtattgtaactctcaaccattgatccctttggatgggtgcaattccggacgtagcccttcaaaatagccatgtaacgctcatatgaccacatttgatggaggtacaacgggccaagcgcaattatctggggcactatgtgaacgatgaggtgctccatcgtatcaaaaaatgctagagggaaacatatctcaagttggcactgtgtctcatgtgcgaatgtacgaagaagtgataactcttcctaactgatgaccttctatgagactgcattgaaaaagtagcacaaccttgcgatagcaacctttaaatgttctggttttatgtcctgtattgcaatggcaagaaacacggtgagcaagacatgacaaacatgcgaattataaccagataccaacaaatctttcatggagactagtcgactgatgtttgatgagaaacctatgggcactttcacatcgtggagtgatttgcaaaatgcctttttctcctcgggtgttagtgtgaaacaagttggtggaagatatactttgccattcttctctccttcttgagggtgtaactcttccctaattcccatctcgactaggtcaagctacgcttgcagaccatccttagtcttctttgctatgtccaacaatgttccaattacgttgtcaaacacattcttttctagatgcatccactgacgagcattcaccgggtgtcagagcatcccatctttcttgtgcccttcttgatgccagcgcattagttccgcatcttgcggatttgagaacaaccgtttaatgcagcctttgacaagaagataccacatcacaagctgcaggatttttctcttagttccctcaaatgtgtcagactcttctagacaagtattggtatttgatgtgtaccggctagcaccacatgttgggcatttatccaatgaagcatactctttcctgtagagtatgtagtgatttacgcatgcatgaatcttttccacaccaagtgaaaggggacatatgtgtttcttcgcttgatatgtgttggatggtaatgagttagacctcggaatcattttcttcaatagttcaagcagaccgtcgaaactactatcagaccatccatatctcacctttaacctcataagttcaagaactgaccgtaatgttgagaactcactgtcacagccctttatctcatcgtacaaaacatccttcgctgccttctataaagcatcaaaattatctaaacctctagccgacccaatgagcacctcaggatctgcatgacgtaacatttcctccaaatcgattttgtcttcaccacaaccatcggcgtactccatgtcttcaacttctggcggaacttcttttttcgggccgatccacttgatgttcgccatgatgtgtccatatttcgtacttttctataaatccacaagttactaagtgctccgttacttttgcaacatcttcccacgctttttcattcatacaatcaacacatggacaaagaatccccgtcatattgttctgttcagcgtgttccttggcaataccaataaatttagacacttaatccatatatggagccaaaaacctcaacgaatgatatatccattggttcctatccatatatctacaaaaatttcatgtacaactatattacaaaaaatgaacaacaaatatttgaaaacatagtacatttaattttttacatagccataccaaatttcatttcactaaaaatgatagagaactattaataattattatatatttttcatggacaaattatatttatttttggtatatagagacataccaaattaatataataggaaagtccaacaaaagtgggaaaatgtacatgaaagaagagggaatagatgggagcaaaatccatttttaacatggaccatattaagagatggacatttttgttctctctcctatctaaatctagaagatggatgtgagggcaaaataaaaaattttgggactttatattagcacattaaatcactagaggatgagacatcaagtagtgtacacacatcaagcacaaacatatcaaaggaaagtaacaaaaaatgaaaagaaaaaagcgttgagcttttcttcacaattttgcatgcatagatccatcacaaagagaggtctgaaattattaaaagaaaatgcataacaagagtggaaaggtgtagatctaactaccatagaaaaatcccccgaagatttgaacttcaaaaccttctcccatatatttttggtgttagaggagaaagaaacctcgaatgaaatgaacaaggctcaaggaagaagaagactttatagggctatttttgcaggcggaccacataaggcgccgcctaaggagcccgcctgcatgtgaatattgccggcgggtccatatgtgtgccgcctgcaaagatgatttttgcatgcggctcccttatgtggtccgcttgcaataatctatcttcgttggcgaacggccaactcctccccggtactcattttcgctggtggggattttactctgattgtcatacccgtctgcgaaaaaaatacccaacatcagcgaaaatgctttttccagtggtgtctttgtgtagcagacggcggcccatagcaccggcgagctcctcttttttggatatgaaacagatgcaaattaaagcttggtggcagccatcaactacaatctaacaggcgcacggtgatgaatcggcaaagaggtgaagcttgacaggtggcgatggggggggtcatcgggcgccaacaagcgagaggacacgcggcggaggatcgatgggcgctgctgtgtagccccaatgggtgcagtaccataccgaaggattgatgggcaccggagtgtggccgagcagcggaggatcgacaggcgcgacagcggagggtgtcaatgattaaattcactgtggccctgtttagttcacaccaaactttccccaaactcccaactttccatcacatcacatcacatctaaaacttttctactcacataaactctcaactttttttccaaactaccaactttccccaaacttctctccgatttcagaaactaaacacaacctgtgtataccacatgtaggctgcatgtgccactagaaaacatcagcgtacattggtcgttctagccgtacccagcattcaacagttgacagcttgacctaactagatattaagtatcagcatatcaatggaaatccatcgaagtatctcttaaattatcagaacacagtggatcgattgacatagcaaagtgagttggtagattttcttttttttttttgagaaagagagcattgctcccccatttcattaacgaaatgcaaactaccacaggttcactacatagttcagaaggctaataaagaaactaaaagcagataaggagtccaaactgccccagggagggagcacatcccagcaaaatgcaaaacacagcgcacagatgtggtggcaattccatcacttttgccaaaccatcagtcgtcctgcactcctgcggtggcggctcaaaagttcggccgttcagtttattgtccatcttgccatttatacgagaagattaacaggagatcaaccagaaccgcagatcatctactcgccaaccctcctagcaatcccacggaagcagatcctctgacatgaacttcccccgacgtggtcactaacaggtggtgtggagattatgggtaccccatacccacacggcatggttatccgactagtcataggggataacttatatctatggaatatgtaacagatcatgacttgggtattacgtttccttttatattatggagcggcctaaagtcctgatttgataatattgtaaaatagatttaggaaaccgataccgtattggttaaggtttctatcttataatcctgctccccatcctatataaggtgggcaggaggccctctagggggcatgacacacctgatcatcagatctatactacacccggtggattcaaatccccaaacaggagtaggatattacctcccattgagagggcctgaacctgtctaaatccttgtctccgcatccatccacttttaggtctcgtgcgctacccgcttttattattgccgaattcatgtttcgacagttggcacgccaggtaggggtgcgtcgagtttcccgtcaacaagtgcgatggaaccaattttcgatatcaccaggtttgttgtttcaatctattattatttttagattgatttttaattccagaataactttctggtattttcttgtgttcatgggttggtcggctgagagggaggcgaagttttctgccgtgtcctcaagcgacgaaacttttctcgtgcttgtgtgaccctaaatgccaaccgagccgatggcatgtggtgcctattgatggacactgccgagcctaccagaaggaaacacatgctgacttgaagcacatcaaccaacagggagaagctttatatacactcatggcaaaagcagagatcaatcttcttcatatatgcacatacagctgntatatatatttatatatatgtatatgctctcgtctaatctgttggtcttcttttaaatgcatgaacttgtggcggcgagtcgatgtcgcgcgatttcacccaagttttgatcgtcatgcacatggtcgcccaagttctacggagttcctggttgcttgtgggcattaaactccgacatcaccaggatttttcccttccaacttattgttgttcattagattgatctctaaatatcatattaatcttttgatattttttgtttttgttacttgcatataattgcgcggcactactggggcgattgatgccggtcatggactcgaggcgtctcgctatgcggtcaatcggccacgagtctactccgccggcttgtcttcgccaccgccgttgctgatgacaacaacgtcttcaccgaccggcttgccttcgccgccgccaactggtgtctccgcctacacggctggcctattatgcctgccgttgttgggcatctactacttcactgccggcctgcctccgtcgccgccgactggtgtcctcgcctatacggttggttggtcacaccaccgtttatgggcatccacgtcttcaccaaccggcttgccttcaccgccgtcgactggtgtctccgcctacacggctggcctattatgccgccgttgttgggcgtctactacttcaccgccggcctgcctccgtcgccgccgactggtgtcctcgcctatacggttggttggtcacaccaccgtccatgggcatccacgtcttcaccgccggcctgcctccgtcgccgccgactggtgtccttgcttatacggttatttggtcacaccaccattgttgggcgtctacatcttcaccgccggctcgccttcattgccgccgactggtgtttctgcctatacagttggcggactttgccgctgttgatgggcgtcttcgttttcatcatcagtcgcctcaagctgcttctatggctggtgttttcattgccattgatggatgactttgttcctacattggccacctctgccatcaccaaggggaatattataaagctaagtcatcgttaattttctttagatgatattttccttttcctttgcctcactacatcaattggttcgccgttgactagtgagttgggggctacagatgttatattatattttcaacaattttcataatatttatcttgattgcttgtgatataatttgagtacaaaagtgcctatcgagttatggagttctatcttcctatgctttccgtttggtttgtcgatggataattgcctttaggccgattcctagcacctggaggctcgttggatagaccgagtaacgcaaggtgctaagtattacttgggaaaagtcaaaaacatagagataagataatttattttctgctcttaagaattgcaaaagtacccgagtagtcactaccaggacgggagacactcccgagtgtgagcaaaaagttacgtagtgtttcatttagcactctgtaaattaccgggtggattagagaaacactacgcaacaagttctatcacgtagcgttcagtccaaacactggggaacacagggaaaatacagagtgctataatattattacaccagggaacgtgggccccgcatccttcagcaccgacatatttcgttggcgcgcacggctgttccttttggcgcacatgcattttctgttgcgggaatggcgcgggaacgaaaaccttgggcgggaacagaacaatagcagaaaatatgacggcacctgatacttacggtgaactattgcataacacacacggtaaccgtaacgtagtataacggagcagatagtggtgggggccacatgtttagctggagggttataaaaaggcaaaattggttatatagcatcgaaagttcactttttcgttttatagcaccgaaagttaccggttcactttaatagcatccaaagttcaccctatttccatttttagcacttccgtcaatttttccgcccgtctttatcgttattgggtagcgagtcgactatcaaaanngtaccagg

SEQ ID NO: 3849 - DNA, 36983 bp, Oryza sativa
  unsure (1)..(36983): unsure at all n locations
cgccctctatataaccaagaggagggtacaaagaaggtttgagggggtccccaaggttggaggagctcgtatttttaagagaggcgcgaccacaacaaaaaaagtttccactgtatatgtggtttgcactacatattttctcaatttatctcactcatataaactccaaattggatgattcttttttctaaatgtttctaaaatcatgttctatcatgttattatattcttactgctattatttttttggctttttttttcttgtgactttgttttattaattaaaaatttgaatttctaaacttcaaataatattttgaagcagtaaatgatttcagctgaaaaagtcatcaacaacaaaattatataactcattaagatctataacttttatttttgttatttcttcatccgacaaagtgatagtaacatttttcaaaaaatttacatatctctctgatagtttataaaactatataagagatatgtacattttatgaacaatgttacaaatcgctttatcggatgaagaaatgatcaaaataaaagtcacagatcttgatgagttataccactttattgttgatgaccttttcagttgaaatcatttactatttgaaaacgttgtttgaagttgtcataatttgaaattcaaattcaaactattgaaacaaagtcatatagaaaaataaccaaaacaaaagttgtagatattgatgtgttttacaattttgatgttgacaatttttttcatttaaaatcatttactactcgaaaaattatttgaatttcttatattttaaaatttaaattttatatagtttaatcaaagtcggatggaaaaatgaccaaaagaaaaatggtagatttcaacgagttctacaactttatttttgacaacttttacacatgagttcatttagtataataaaattcgattcgaaattttaatattttaaaattaatatttttttccttcctcctggcttcaaatgttttcatctcatctcctcttctctctcccctcctgatattttcactttcactttgaccaacctaatcttccccttctatcctctcctctcctctccgttgacagccgtcgaccccttcttgccatggacccccgctacctccaggagctcggcgcgctcctcccccgcgcgcgcggtgtcacccttcctcaggtgttcgtcggcggccgccacctcggcggcgccgaggaggtccgccgcctccacgagtccggcgagctccgacgcgttgtagccggcgccggcgcaaccgccctcgccgcctgcagccggtgcggtggcgagcgctacgtgctctgcggcagctgcaacggcagtcacaagcggtacagcctcaaggaagcaacagtacgaggtcgtcttgcccctcccctccttcctcttcccctctcctaatgtttcctcttcttcttttgcatcttgctgataggggctaaggggatggggagaggggttgggatgggctcctggctgttctttgctgatggggcaaaggggatgtagtcttgtggggtggaggtagaggccaaatcttgtgtttgttcagatctgatgacagtgaatggatgtgatgtgagatttagtggctgattagttcgtgatgcagtgcatattctgaaaatagagaataataaaattgtagaatgtagatgcacatgatttttgcttagtgatgtttgtagcgggatttagtattttaaaattcgcttcttcagtggtgattctaatgacagattttgtctgcattggttccacaagaatctttttttcctagaggatgcttgcttatgcttcagctcatgtctttctgtaatcaaataccatatttttgccctaggcctttgtgtatgtatctcagtaattgaagtcttgcatctttggcctgtagggctgggtgtatgtatatcagtattaaagttatgcttctaagctttactactgactgagcagctacatcaagatatgcaaggatccttacagatattttagacaacctggaacaacatcgatccaattctaaagtcgatttggtatattatatttttcttctttgtgtagacatcaaccattggtcgtgaagacatccgagtctcagaggactgcaatatgataggtagcatacatggtgcaaccaatccataaattatctgcagttgctgatcagaattataagttcacaagtgtactaaccttttgtttaaaatatatgcaggtaaggaaattctgataggatgtaatggaggtcatatcacaattacttctgacaatgatgttgcaggaacgatttaagtgtaatctcttcgtccctttacatttttttccaggttagaaatcataattggtgatgtgcttacactaatgtttccgatattacagttcgtcaataccattacaaatagtagtttgcatagtacaattcttcattgaacaatacctaagatttttgtaaaggtagtgtttatgttatttgtttacatatagctagttagcactagatcattagcatttcactggttcaagccgaggttttctgaaattttttgaagttactctctggttgtcttagtaaattcatctatctaggctatgtctaattgctctctttagcatgaatactattgggtgtctttgtaagaactaatttgtacctttggaacaattaatgtgacctacactgctttagttctaggctcctggcaaaggtaagcactagaaagacataccagaactaagtaacaatgtatacttctttcttaatatcagaacatagtattgatgtatgggattttgatgttgaatttgttttgtgaatcatcagatccttcacctcctgatgctgcagtcatatggacttcattagttgagctaagcaattggcaatttcatggaaaactaggaagcacactatagctaatggtaaaagctggggttacatcatggctgatggcgatagtggcatccattttagagtgatgaagctatcccaggatgaaaaacagacaatgattgatggttattaagtccttttctttttccagactgccggcaatgctgttcgtctaagctttttttctggttgcacggccttttggttgcccatgcttatactggttgaagatagtgctcaatttcatctcagttgtagctgtttctgagatttgtattgttattatttcatatcagattgttgtcatattgattaattgaatgaacatgcatgtcaaatgcatttaaatccattattgtgttttatgtgtaactgcatgtgatgtgtatggatgctggaattctgctatagataattaatagaaatgaagctgtatattcctattaatttgcccctcaaatatcaaaatgctgaggcacccggtaacaacctaaaatgttacagagtgccactaatctgcacccgtaaccagggaaaacttacggtgtgtttgcgcacaccctgtaaagttaacgtgtgctatcatgtgcaaacgctccgtctcccgttccttgttgctgttcagttccggtggacggtgtgctgaaaaggttaccgagtttctacggcactacgtaactttcggatggttacggagtgtatgcataaaaacacaccgctacgatgcacgggaagacaacatcactccctggtgaaaattgcggagtgtggcactgagtaacctgattacggagtgttttttgtgtgttgcggtgtgtttttggcactacggagtgtttccctctccagtagtgagtaaattctgatccgtgaaactttgtttcattaatgacgaactcatgtcactcatttgcatctctggaaagtgccttggccgactctcgatgcttgggggctatgactagttaggcagagtgtttaaacgtacggagtcatctgctcggggaaatcaaaattgacaagaagagaaatacatattataaacattttaaaatacttgaattttcctcgagtattatatttacatcagatactactcatcttatatgtttgttctgtaagatccagatccagatatgcataaaagggattcatagctttaaacttatctcctacgattcaggaatggatcagtcagaatatcaccactggcttgtcttcgccgccgctgactgtcttcgcctgcacggctggcctattatgccgccgttgttgggcgtctacgtcttcaccaaccggcttaccttcgtcgccgccgactggtgttttcgcctatacggttggttggtcacaccaccgttgttgagcgtctggccagcgtgctttcgccgccgccgactgctatcaccgcctgcacggctggcctattatgccgctgttgttgggcgtctacgtcttcaccgaccggccgcctcgtccgccgccgactggtgtttccgcctgcacggctggcctattatgccgccgttgttgggcgtctacgtcttcaccgatcggtcgcctcgtccgccgccgactggtgtttccgcctgcacggctggcctattatgccgccgttgttgggcgtctacaccttcacaaaccagccgccttcgccgccgccgactggtgtctccgcctacacggctggcctattatgctgccgtcgttgacgcttacatcttcaccgaccggccgcttcgtatgacgctaattgatgctatcgtcttcatggctggccacgtcgccgccaccacaaatatgcgtcatcaccttcaactcaagttgtctatgtctacgactggtttcttcactttcatggctgcaggattctaatactgttgattggccttatcatcttcgccgccggtcgtttcgtctgctgctgactagtgccctcgcctctacggctggtatataccgctaccactattgatggacgtcatcgtcttcattgctggccgccttgtctgacgccgactggcttgttcgcctctatggctacgtgttttcgtcaacattgactggcatcatcatcatcatcggattgcctttgccgccgcccatggtgtcttcactttcatggctggcctattttgctgccgttcaaggacgtcttcgttttcgtcatcattctacttattccatcgccgactggttatgttgccgccgactcatgttcacttcatcacgactatgcaactttgtcatcatggtggagtgacttcatctttattatcttcggcaccggcaaactctattgctgctacttcgcgagttttgctacttcaccaaccacgacgtctacatgagcctcgacattttggcatgcgtcactaaatatgatgtcatgttattataacaagtggtgttcaaatcttcaatatttttactcggacatcttcaacatgcatcttcacttttgattgcaatgactactcgacgacaagaagctacagttctcgactctatgttcagttgttttccaactaaccaaagagtcgggggctacacaaatacaagactctgaaatcagccaacgagttctatggaatctacttcgggagttataagttttgtcttcgcttcagagcaagtgttctacttcagcagctccaatgatttcaccggcaattttggcttctccacgctgccacaatctactccaaaattttcaagtatcaagtttgagattctatctacatgtctgggagtttagagttatcaaccaatcagctcagtttcgatgagttggacaacagcatttactttcctttaagtgaagcatctgcaacagctacaactccaagttctactgccatctttacaaatcaaggggtgttgcatcaatcttcattatacacacatcaagaaaattacttaagcttcgatatcttctcaacagtttgatggattattgtcagtgacttcatcaccagcacctctacttcatcggccgtgacatctctgccgttgctaatggatgactacgtcctcgcctccggttacttccgtcattgtcggcttgttatttcgccttcacggttgatctactatgcaaacgctgatgagcgtcttcatcattaccattggttgctacattgctattgactggatcaccgacatcgtcatcttcatcaatatcctgtcaagcttcttcaacatagcctatgctactgctgtttgatgggcaacttcgtcatcatagtcgatcatctctgttgctgcttatcatcattattgtcgggtgcgtttgtcgtcaccgactattttcttcatcttcatgattggtggatttcgtcatcgtctttgatctgcctcgtctgtcaccgactgattatttcgctgccatggctacacaactttatctctgggcgccttcatcttcattattggctgacctgattgttgccgactggtttcttcatctccacggctgtgcaacttcatcacttttgattggtatcactatcttcactaccaccaatatttttgccacctctggtgggcaatattatctctatattggtcgtcttgtctctatgccaactgtgtcagctaccatcaatggacaattatgattacgacaaaaggacaagctatatactcaggggcttattagctcaaacacaagtatcataccttcaatttggacttgttccggatacatgcaacatgaattcatgatcatgggtctattttctatgctcaaagactggactatttattatttcccgtaagggttatcaaccgaatacttgcgccagtcgggattcaattgttatatctattttggagtatcctataagggataatcactcagatcagaagctattcatacgagctacacttggtctatataacccggaagatttattactcgggagcatgttacatgcgtcatcctttaaagggtttcgaaggcatattttttgtcctaggcttaatatgtctgcagcccatattttcaggtgtggcctgtcacgttcttttagggacttaggcactttttgcttaggccaaagtgcgcgtgatcaagtgcccaatgctttaaaatccttttataccgcagttactcaaatttttaggagttgttattatgcatcttaaaaggtgtcaaacagtaaagctttatacagctgccccgctgacttttttatataagtcaaggtgctgtttgggtttttaagcaattgattggatacaatatcattgctttttgccacgtaagtgtgcatttttattgaccaatattatggcttaggctgattatatatcttggtcattttccaggcggttggtaaatcctttatgagtttatttactcggattttacaccatatatgccgtatatttccgagtgtggtgaaaccatgtgtcttttagggacttaagcatatctgttaaagcagtgtgcgcatggcgtatgcctgatactttggaaatttctttattcatagcattcaagcttttttatagctattttgctatgtgaattttcaatgatgtagtcaactttaggttgctcgtatcaatttttacaaagaagtcggtatatcacttggattatattatttggggattcacaccgcatatgctacatattaatatcaagtcgcttggttgactacaattatcgaaaccactcggttggttggattatttattccttgactatatgcttggtttgtttaattaaccacatagtcgggggctacacctattaggtgcatctagtcgatgcacctgactttagttttcaaccctccacagtctttagatttggtaaaagtactcgggagaccatggcaaagatgattgaagcactcggctttggagtaattagtttgagagaatattatcttttcgactgtgaaggtctcaggggctactgtggagattatgggtaccctatacccacacggcatggttatccgactagtcataggggataacttatatctatggaatatgtaacagatcatgacttgggtattacgtttccttttatattatggagcggcctaaagtcttgatttgataatattgtaaaatagatttaggaaaccgataccgtattggttaagggtttctatcttgtaatcttaccccccatcctatataaggtgggcaggaggccctctagggggcatgacacacctgatcatcagatctatactacacccgggggattcaaatccccaaacaggagtagcgtattacctttcattgagagggcctgaacctgtctaaatccttgtctcagcatccatccacttttaggtctcgggcgctacccgcttttattattgccgaattcatgtttcgaccggtgggcccataaactaaggcccacatgtcagtcaccacgttcctctgacttcacatcagaggatcccaattccaatcccactggcagcgaccttcaccatgctagttggccttagccagttgtgtgttcctcttctgccgccataagtcaccagtggtagcatttcgtgcatatgctcctgcttggctgcttcccaattaatatgagcaaacaagacacaaggcctcttgcgtcgtcctcccctcgggcggcacgggaggcggaaacccagccggcccttttcttccccttcttccccttcggcttgccgccgcccaaacgggcggacggtagcggcgaggcctcttaccgacaacgcttcgggcgggcgggggagccgtcctcggcgggcgatggtggccgctagatccaggcgcttccagccgaatctggcggggtggcaactgcaagcgggaaggcgacgcgcaaagcaaggggcacgtggtgctggccgcggtggtgnaaagccggtgaaaatgncgatgncgacgggaatggcgtaagctaagggcgcgcagncgccggcggtgcctaagaacgtgaagccgccgccgggaatgccaatgccgccggtggtgcaaatgccgccaatgccgcgaatgtcccccagatccgcgcctctcggtcggtctggagggtggccggctggcgacggcggtcctactcgcggtggggctcgcggcagttggcgacggcgacggcgatcgtgctcgtggtggtcctcgcagcagtggtgctcgcggcggcatttggagacggcggcggcggttgtgctgctgacggtcggtatcgatcagtttctaccgtcaatattactaaaataggagagaactagtgatgcttgcaatgcaaaaatatgagagcaataatattccactagtattaggtatactaaccttttgcagagaataacaataaaatggaggagaatcaacatcaaatcaaatgataaatcaatcggacgatgtcgagaatcagacttgtgtatgaatgggccaagaactcagaattgacacgacaaactgggccaaaattcacaagtctgtggagaagagaagtccaggaggccaccagccaaattgtgggctcgttgagccagccccaggttcggccgaacctgatggttcggccgcacctggtggttcgtccgaacccatttctccaccgttggctgtggggtttggcagggacgctccagatcttctcctgatggcggttgcggggtacttcggacaattccccttccacaaccgtcataaccacctttatataaggagctcactctcttcacctcaacacacacctcaagcaagagctctctctttcctctcaagtttagtttagtagtatctaactggtggaatagaaatagaataggagtcaggagtctggaagccttcagaagagttcgtgtatagctctagcagctttcctttcctcttttgtaagctttgtacttttattagaatactcttatatatacatttatggtattgaaatactttccgagtatatgagtacctatttacattatgttcatgttatactgaatgtacgattagcttatctgggagatgctttggtgcgggtatagtgtttgcttatgcaattactctatgtcatgacgatgatattagagtagtatctggtagtttagacgtggtgtctagattacgggatatcattatttggggttatatattgcggatgagaggtgggctgctgatggtgacagctcagtacgggtattcctccacgcctatatgtaatcctaagttaatttcctggggagggtattcctccgtatttagccctggttggatagtcatgacgggctgtcgtaaggaactcggcaatcaggggtggcttctcaaagtaccaggagggcatcggatagagggtattagctagtaaatcagttaactagaatgtatgtatagcatgtatactagaagtataggagtagatttcttttctcttttctttccacttagcttagataaattattatgaggatgagtagtaatgcttgtgtgtcactctacccttggattatcttaacccctgtttagaatatgattatcacaagtaatatataaattattagttgagttctctctacatgatctttccacgggataaaataaatacgatacccttggaatactctcgggtgaaatgctacaatggtatattcgtgcgcttgcggatgaactctgtaaccataatataccaaaattatatttctagtgatgtcgttaaaaaataccaacacgtgctcaaggtggtgctagcggcagtggtgctcgcggcatttggtgcttgcagcggcagttggcgacagcggcggcggccgtgctcgcggcatttgctgctcgcggtgaggacggcggcagcgtcggctggcgacggcggcggagggcatggcggcgacgtcgagctggctgcttggtggcggagggtggcggcgcagcggtttgcagagccgatggctggcgtcggtggcagcggcgacagcggccgtggccgtggaggcggtggtgacgttggcggatgcggatcgctgacgatagcaatggaggcgggaaaggagtagggagcgaggtaaggatggtgacggcgaggtggctgggcgttcggcaacagtggctgcggtggtgatgaccgcgtctgcggtcaccggaggcatggcggactcggacggctagccgagggcatggcagacggctgcatctggccggcgcgacatcgtttggtggaggggttggattccggcttggcgcagagaggcgcagtcaatggcagcggaggccgactccgcgcgagaggcgcgggcggtggagatggaggccggcttggcacgagaggcatggccgatggagggaggccggattggcgcgagaggcgcgtccagtggaggaggccggcttggcgcgggaggtgcggctggcggtggaggaggcgacctaggtgtaaggaggagctgtcggtgggtgtggcgcggtcttcggtgctcgaaggctggccggcgggggacgccggtgcaggggccccacatgtcggtagagcttgtatggtggtggagcatcggtgcgttagccgtggattcgcaggtggtgagcggcaggtgaaaacccagtccggcctctgccagaccgacaacgatggttcattccccctcctgagggcgttgtcgttctgtctcacccctcaaagggtggttgccgggtgaaagcccagtcttgtctcctttgagtcccgatagactgcggcggcggtttctccgtcgcttctcttcttgaagacgtcgttttggcatcccctaggggtgataccgtctgtgtccccttgttggtctagtggcggtcggtcacgcttagcggcgtccggtccggtggtagtcttctcctgggctggtgtgttggcgatgtcgatgtgtgggtggtggtatattttttcttttttcctggttatgaccctccagggttgtagtcttgtaatttttttcctgctctatcaatagaacttcgcactgtctcgtgtgagtcgttcaaaaaaatataaactctttctgtcaatattatttacttttaatgtagatttaaaatattattaaattatactcctacatgaaatcttttcccaataatattaactccagctcaaattgtttctaaattatatttctatatggaccatttctattaattttatttattttcaaactgaatttgaaatatctctaaattgtacctctgccagaactcttttctctattacgtttattttttatttgaattatatatattttaaaattttacttctacgtggactctctataatatttatttttaacctatatttaagatattttaaagttatatttacatgtggattctttctcttaatattatttattttaacctggatttaagatatttcgaaattgtacttgcacatgaattcttttcgccataatatttttttaatgggagttttacttatttgtaaattgtatttttgagatggactatatctgttaatattatttatttttaatcttaattttagatgttcctaaattgtattttggctgtgttcactggaatgggtggtaacccatctcctgcgcacgaaaaatggagcagtccattgattaattaagtattagctatttttttaaaaatagatcaatatgattttttaagtaactttcgtatagaaatttttttaaaaaagacacatcgtttagcaattttgggaagcgtgcgcgtggaaaactaggcggagggagttgggaaccaggacttaggaacagagagacttagagatggactcttgtctcaatattacttattttttgaattttaatctgcatttcagatttttccctaaattatatctctacatggatttttatctcaatattcattgtttcttaatttttaatcacaatttcagtttttgctaaatagaatttctacatggactcttattttaattgttattcaaaatgtgagatattttaaattgcatatatagttggactttatttgttttctttttttattagtgagtagtttgcgtctacactatataaacttggtagatgagtacatatatagatatagatatatatatatagtgtaataacttatccagtacgtactttctggttaaaagatatctcttcggtaccatactttttaatccacgagtaaaaatgcccatgcattgcaacgggtgaagtctattttaatcttataattgttatatggtttagttaagatgaaattcactgtcgaagttcgcttggatttatatttcttttacaaaatcataagctgcagttcggagtccgatcgtcttaaattagcatacgagttttttaagcagattttttttatgtttccttctttattaccaaaagtaaacgatattaaaaaccgactccgactcaaatatggatatgtatttccaaaagcaaatgaacttaaaaaccgactcgtacacagatgacataccaaaataccggcaaaaatatctttaatttttataatagtggagaaaagatagagatagcgatagagaagagatatagattataaaattaaaatcgactcaaacacggatgacgaatcacggaaacatcttcaatttgtatttccaaaagcaaacaaacttaaaaacttacacagacgacgtactaaaataggcaaaaatattttcaatttttataataagagagagatagagaggacatatagattaaaaccaaaacataaaattaaaactgactcaaacacgtataacgaaccaaaaaacatcttcaatttttataaccgactcaaacatggattatggattatgtaccatggaaacattaaaactattcctatctaccgtaacaacctgatattgtcccgtctctaaacgtaactgtttgtaacggtttgcatccgatcggaacccaactaaaattaactgacctaatagctgtagtaacttgtgttgcatattaactgcttcgtacgtatatcccagtaacaactgctttatcgaagttgataaagatatactactaatataattaccaggcttaattttcttctatacatgatccgaaccaaactacaatacggatagggcatatagccgggcgtacgtacgtcaaacgtgtggttaattacctctcctataatctatttaaccaacgttaaccctgcatcgagttcttcgtccccgattgatctcgccgtcgaccaccaccaccaccactgttggaaataatacatacttagccattaattttattccaagcattattatttgaaagcacatacagcaagcataacctacttgcgacatgataggacaagaaaaactcataaattctatcatgctagatatcaaacaaggcataaataaccaagctaagtaggtcattaagctaatcacaatggtaatctagccacaatattttaatctagatgaacagtaccatgcatatataaaactcaggtacgatcaaaactagattcctttcctttgtaaacgaaagaattcactcactgaatggatcgacggagatcagcgagtcgaagcagtgcagtcaatcgatgatgtcgagcggccgcgtagaaatacgttgcccagaaacctttacaccgcccccgtgcaggtgcgaatgcggcgaaggctcggagacaccgctcaccgggatgctcattgcacgacgagcacaacggccggcttggaccgacggcgacgcaacacggcggcagtagaggaatttcagagtagatggctattgtgttctgtatccttcaaggacgtctccttgactcctatatagagctaacactgaacagcagcccacgctcaatccgttgctcctccgcgtcaaagccggatcggctccgtgagaaacgcagccgccaaacggccacaagcacacgttctctcttcacgtgagaactaagtcttcaggtgattgactcgatcagcagatgttgttgtatgcaagcatcttttcatccaacacatgctgatcgtgcggctaagcattaggcatttaaattgatgaaatgatcaatgtctccaagcatgttatttccatcacaccaccaggtagctgctagttagcttgccatgtcgtcgtcaccgacaaaggacgtcgtcaccgcgtcgacggccacctctacttcggcggccacctccggttgcaactttctcaagatcaaaatacgcaacgcgatcaagaaatctcaccaaggcagcaaatacgacatcgagtcgtccaagttccaggccgcaggtcacacctggagcttcttcttccaccccaactcgagcaaataaatattcgggcaacggctactccaccgtgtgcctcaagctccacgccgccgaccccggcaccgccaccgccgccggcggcggcatccgaaccaacgtccggttccgcatggtcagtctgcagccgtgcgtgcctccgacgaacgaggtgaggagctacgcgacgtcgttccacggcaccgggaaggcggagtactgctgcttcacgttcatccgccacgacgtcctggcgagccagtggtccagcaccgatgatgagttcgccatccactgcgacgtcgccgtcgtcgaggaggccgcggcggcggcgacgatgtccacggagctcgggccggatgacctgcatggcctgatgatgatctgcaaatgcagcgtcgacaatgacgatgagccatgcaagagcggcacccggcagaacctcaaggaggcgtttcgcaagcagttcttgggttgttttggaccaaagtagctattttagctatgaatttatatttaactatttagccctttctgcaattttcatttaggattaggatgttggtgcaatgttggtactattagaattaaaaatagtttgtgcactttgccatttttgatatctatctatttattactagaaaaaatacctgtgcgttgcaacggctaaaaacaattgtgtatagcatacattatactctttattttgggtctttcttcctcttttcagtcctagtcctgcccgttacctccctcctagtccagcccgttaccttcctctgtttggcctgtctctatttgacctagcccacaagtaaagcagttgcattgtctctatttgacctagcccacatgtaaagcggtaggcctagctcgcataaccgattgtcgtcttcaatatctggaaacagtctcgtatccgtactatgctaaaccaatcatcccatcaaatctgattgaatatccgtacgatgctaaaccaatcatcccataaaatctgattgaatatttctcgatcaacctaagaaaaagcggcgaaaaaaagaaaaaaatgcgaaaaaaagggacggacgaaaaatcctaccgaaaaccttacgttgatgtagaaaaagcagccacttaggctatctcgagttctcgacaagcgtctaaatgtattgcatttgcatggttataataatgaaacaacctatcgaattgaaactgaaaaaatataatgaccgtcaaaactaagtgcaaactaatataattttcaagcgatttgactaatcaaatattcattgtttccgatgatgagcactacgaaacatattcttataatacaaacaacaaaattaataggatgaatcatagatatgtaacagtgtttttatcaaaatgcacgtgattaccaaatttatacttttttttacattttacaagttgttccactaaatcatacccacctaccaagttattgttccactagtgtaatttaatcttgattaattgtgggaatttctaagtcgtgagaggacatggtggctaaattttctgttaatttattaagttaatagatttgtcaatatgttctttcgtagtaatattttacttatactttgttagtttgataactgatgcgttactacaacaagaaccccctctagcaatacatgcttggcaacgcattaaggatgcattgccaaaatgcgaccctagcaacgcttagtagtgggtgagcctaatttgtaatagataatatgtgttgcagaacatgggttgcagagctgaatttgcaatggtcttgatgccctgtaaaaacttttggaataagcgaacttattgtattttttaaaataatcgagtgagatatttatttttacatttcggacctctagcgaattgttttttaaaagaaattatcaagtgagttgctttttttttcctgttaaaacttttggactaagcatgctttttaaaaaataataataattgagcgagctgtttttttacattgtgtattgggcgtgttgtttttgttttctaaaaaatttatcaagcgagtttattgggaaaagtgttgtttttgttttctaaaaaatttatcaagcgagtttattttttaaaaaaattccacaagcgaagtggctgctgatacctgataggaataaattagtggggcaaagatgcaaacagaggattcgaacctgggtctctaggatagaatatgcgcaacccaaccaactgagctaatcacatttcttatcaaatgatttatttagttgtttatatcataacaactaaaatacgatctgtgaaattagcagtttagcaggcaaccttagtctcccaccttctctcctctcctctcgtgtctctcacctcacccaacacgcacgagagcgccgccccatcctgttcccacaccgcatctcattttcttctcacgctctcgcacatcactgccacggcgcacaccgacggcggcggcggcagcgcacatcggcggccagcggcgcgttctcagcagcggcggcggcgagcccgcgaggggatcggccgcggcaggccggcgacgggccgaggccgacgacagcgggtcaacggcaagcacggtccttttcttagccacttctcataggttgattccccatttggccccaaatccaggtcagtgtcagatccaggtcaatgtcaattttttttaattattcaggtttgttgcatcatgagtctatctgattgagtttaataacacctgcagatttttcttgttcatccgaacggatatttggaacataggttttaaacgcatgtgcttctggagtcatcatctgtagattaactagaggtaatttatagtaaggaatttaacttggagatgacagctttgacattagattgctggatgttttttctgtaaattgatttagctcttctctatttttgcagagtaaaagcttttgtttcagtgtataaaggaggtctattaggttgtgacaaaattagctgacactgattttatactggtacttttctaattgccctatttttgctacgtcatgatcataagagacaattccttgtcattgttattatctacaagaacctgaaatatcaaattttttatataggtcgaaatggatttagaaaccatcaagattcttttgcgctaccctagaggttctgttgagtacttagctggagtagatggatttcttgaatttgcatataaagataagttagaggatacaaagatttattgtccatgtgaaacatgcgtacatactatgctactttcaaaaaatgatgtctatgatcatttggtgtgcaatggaatgcttcagagttatgaccaatgggattttcatggtgagtcttcagaggagcaaattaggaaccaacaaccacagcctcacaatgaagacatgcgtgctaacatgcacgaattaattaatgatgcacttaggactgtgtatgacgacatgcctatgagtgattctgcagattcgccatgtacacacactgatggaccaaatttagaagctcaagcattttataagttggtgaaagattcagagaagcctttatgggatggatgtgaactatcacacttatctctgctagtgcttttgttcaatatgaaatccatgaacaaatgaagtgataaatcatttggagatctacttgatattcttcacatggcaattccaaatggaaaagaattgccaaaaaacttttatgaggctaagaaggtggtttcaaaatttggtctagattatcaacaaattcatgcatgtcccaataactgtcagctgttttggaaagagaaggttaatgatgatttttgttcaacttgtaaggcttctagatggaaagataaaaaaccagaaaccaagttaacgaagaaagaaagaaagaaagcaacgccaagcaaagtcttatgatattttccaataaaggagaggctgaaaagattgttcatgtgtagagaaacaacatcgctcccacgttggcatgatgaagagcgcttagtagaggatggtgtgcttcgacatccagctgattctccggcatggaagaactttgataaaaggttcaagcaatttgcatctgattctcgtaatatacgatttgggttagctacagatgggtttaacccatatggtatgttgagctctacctatagttgctggccagttgttttagtaatatataatcttccaccatggctctgcatgaaggaacctaatcttctaatgccattaataattcctgggctcaaaagtcctggagataacattcatgttttcctccagccgcttctagaagatttaagagacatatttgtcaatggcatttccatatatgatgcatttagaaatgaaacttttaatttgagggcagctgtactgtggactataaatgacttgccaactttaggaatgcttgcttcacatatggtgcatggagaatttgcatgcccgccttgtggtccaaatgtatggtccaaacgtttggcacatgggaagaaatcttgttttatgggtcatcgtcgatttttgccacctaatcatgaatttcgttttgatagaaattcttttgatggaaccacagagattagtacagagcctatgacttactatgggcgtccggtattggatgaaataaatgctatcggtgattttaagaagtcaaaaacttataaggcagtaagtagtttattcacactaccttactgggatggcaatcttcttcggcataatcttgatgtgatgcacatagaaaaaaatgtgtgcgacaatatttatggtatacttctaaatttagaaggaaagtcaaaggataatctccaagttcgtcttgatctcaaggaaatgaacattagaggggagctccatccacaacaaagaacttcaagcaagttctacttaccacctgccagctttactatgtccaaaagtgagaagcaattgttctgtaaagttcttagggatataaaagttcctgtggctattcttcaaacatatctagatgtgtgaactctgctgaaggaaaaattcatgggctcaaaacacatgattgccatgttctaatgcaacaattgatgccaattgctttgaggggtattcttcccgatgaagtcacatctgtcttgtttgacttatctgcttactttcgaggaatatgttcaaaagttctccatgttgatgagcttgaccgtttggaagaagcaattaaaatcacattgtgcagaatggaaatgatatttcctcctggattcttcactgttatggttcacttagtcgtccatttagctactgaatgtaagattgctgggccagtttgctatcgatggatgtactttattgaaaggtactaaaaatatattagcatacaatttataatatttctcatatgtcatatgatacaatactaacttattagttttgtgccttgtatgtatattacaggtacctgggtaaattgaagtcgtatgttcgcaacaaagcgcgtccagaaggttcaattgcagaatcatatttggcagatgagtgcatggcattttgttcgcgatacttggaaggtttctctaccaagcataacataccatcaaggaataatgacaaaccagatcaatttgagactcccatgagtaggcaagaatccactttgtttcctccagtaggaaaaccattgggaaaaccatcggcgtactccttaactgatagagagaaattgcaagcatatagatatgtgctatacaactgtgatgctatagtgccatatctgaagtacgtattgtcctaacatagcctttttttatgtgttgtaagtgttttgcttcaaatttatgtttatttgttttgcagagaacatgctgctgatttgcaaaggaagaaacgcaaaaggctaactccaaaaaacattgagaacatgcaaaatgaacaattccctgattggttcagagattatgtaagtctcaaaatttatgtttctctttttcaaatactaatacatcttttggtttggtgtagatcttgcagttggagaatcaaagaggtatcgatagtattgatgaggatattagatggctagcacgtggaccaattgaggtagcaaaacgacatagagcattcaatacccatgggtataggttcagatcaaagcgttatgccagggtgactcaaaacagtggagttgttgtgactgtaaaaacatcgagctacacgtccgccagtgatactaaccctatccttggtgatatcatgtattatggaagggtacttgatataattaagttagactactatggaaatttctcagttgtgttgtttaaatatgaatgggtcgatgtaactaaaggaaaatgagtgaaaatagataagtttggctgcaaacttgtgaatttctcaaataaaattcataccggtgaaaagattgagcatgagccctttgtatttgcaaatcaagtcaaccaagtgttttacattgaagaccatttaaatccagggtggtctattgtaaggaatatgaaacccagagatgtatttgaactgggcgaagaatggaatgatgtggaatgcgaaccataccatgtcaataatcttggggagctatttgacagtgcacatgatggtcagacatggattcgaagagatatagaaggaacaactgtcgataacatggtaactaattaaaggtgaggttatgaaggtttttcactatctatctgtccattatcaatgatttccttatattatttatatcttcacttggggagcactttatttttatggcagtaattttggattgagatttactgcgatgaaggcttcttcaccacaatagcttttctggatgaaaatgtcattcgtatatttccttggattgtctaagtgattgagccagatcgattcaactttttatttgcatacataagtcctgtaataatgttctacattagttatatacagaattggtggttagatcttatttttaaatatccaggatatcatattgtttatatgatgagaaaaaggaatgggcgtttataatctttgcatctattgtgttctgttattccatttccacctatataagaaaactatttacgttgtcaatggcacctaacgtgaataagtaagtcgaacggacaactccaacatgaagtggacatagcctggtggtacatggcttcttcagccgtatcgaagactgtagttcaaatcctaacaaatgcatttttttccatttcttctccagtggcgattcctaaatttttttccctctccttagctggctagataacgaggaaaacaaatatgccagcctagattttttttattttttttctaggggcgattcctaattttttttccctatccttcttagctggctagataacgagaatttttgaactttttatttttaattttaaaattaaactgatcgaaaacttattttttcaatataaatatttttggccacaccaactattattttaggacaaaatatgttacgtctggattttatcatgcgatcagtatggaccgagacgacaacgaaaaaacatgtggtttttcggtcgtgctaacataaattaaataacaattatttaaagaaaaattattttacatcttgattttatacggcttgtccagaccgggtcgacaacgaaaaaacaagtggtttatcggtcttgcaaatataatttaaataactattattttatgaccaaaaatattttacgtcttaatttcatgcgttctgtacagactgggtcgacaacgaaatagcatgtgccttttcggtcgtgctaacagaatttaaatttccatcttatataaatacctggagaagtctatttatattctgtctatttatattctcaattgcagctaacgtgaaaaaataaataaagggggacatagcctagtggtacttagcttcttctactgtattgacaactctagttcgagaactagcaaatgcataatttttttcatttctctagtggcaattcctaaaaactttttcctctccttgaacgggaaaaaaaattctgttgccccagaaattttttaattttttgaacttttttattttaaaattttaaaaataaaccatttgaaaacttattttcagaatatccggatttcatccagtctgtccggaccgggtcgacaatgaaaaaacacgtgtttttgtcgtgctatgataaattaactaactactattttaagacaaaaaaatattttatgtacagatttcatacgatctgtccggattgtgtcgacaatgaaaaaacacgtggttttttgttgtcctaaaaaattaaatcactgttatttaattatatatatttttcatgtggtctgtccggaacgggtcaacaatgaaataacacgtgattttttggttgtgctaacattttttaaataactatagtttaagaccaaaaatatattgcatctcttttccatgcggtctgtccggaccgggtcgacaatgaaataacatatgattttttttgtcgtgctaacatttttaattaactatattttaacacctaaaatatattatgccactttttcatgcaggctatccagaccagatcgacaatggaaaaacaagtgtcttttcagtcgttctaatataaattaaataactactattttaagacaaaaatatgttacgtccgaatttcatgccgtctgttcggactgggtcaacaacgaaaaaacacgtgtttttttggtcattctatgataaattaactaactactattttaacacaaattttacgtccagatttcatacaatctggccggccgggtcaacaacgaaaaaacatgtggttttttgttgtcctaaaatattaaatcactgttatttagttatatatattttttcatgcggcctgtccggaccgggtcgacaacgaaaaacacgtgtttttttatcgtgctaacattttttaaataactatattttaggaccaaaaatatattacatgtctttttcatgcggtctgtccggaccggattggccatggaaaaacacgtgtcttttcggtcatgcttagataaattaaacaactaaccaaaatatgttacgtccgaatttcatccagtcgtagggcatggatgacgtagggcatgcggcgggccggagacgcccccagccgatgtgctgggtgaccggggcactgcaattgatgcgggttatacctcccgacaccggctgtccacttcgctctgctccaccccgcgcggttggcggcaatgtttccaagccccggaatctctgcctccctctgcacatcttactacctctctgagtcgccaaattgcaatggaggctaattcccttccagtactacaatacttaccaatttgatgtgttctattttcaggtttggagtcagatgcactgaccgtccatagctgaaggagcctggtctacgtacggctaggcttcacacaactgtaagcaatacaatatgtgatctagttttaccttgcagccaattaaattttgttatttctacccattacttgtttcaaattgttggcctataaaatggacaaatgaattagtgagtatgacaaacagatccatattatagcattacttttgggacagcagtactctgttgttcttcaaaaacaaatccaaaatggctcagggtataatcaattctgaaattattctgtctgaaactatgtacagcacagtcctacttctgaaatgagaatgatatactttcgacgccataaatgacagataggtttttttgggtgcaagagatatggcaaggagtagaagaaggcgtattgttcagagcaatgaggaatatttgtcagaggaacagactgaagaagaaaatacccttccatagcttgccacaccatctgaacaagaaactgtatgtgatgattttggagaaggcaatgaagacactgatgacgattttgatatcaatgatggagaaagcaatgaagacactaatgacgatgttgatattgatgatgaaagcaatgaagatactgatgttgatattaatgttcgaggtaactgctaagtttaacagtcctaatggtaagaaataatgacattattactcgtatccctgattactaaggatcacttttgtctttgcaatttaacaccgaacagttgaaaatggagcacctgaaacacgtggcaagacaaaactgaaagatgtttggaacctttcgacaaaactgaaagatgtttggaaccttccgaaagggcttagaattgtggttcaatgcaatgatctcaatcaggcggtaggggaagaagctggaattttgggtaaatttcttggaatggtagctaggaatggtagtctgtgtagcttaggctacacagactggagatatgtaataggaaagagagagaaaaatacaaatgaactaaaagttaaaaaggacatacttaagcaagtaaggtaattccttttcagatcaacatttttgctaacttcttgtattatgttatgcatatccccatatggccatatgagtttctgtgttgctatatgtagatgagattcctttatgctcctcggatggaagagttcatattaaaaaaaattgtagaaagatggtggcaatataaagcaaaactaaaagatttgtattttgatgtgaatgagactaaggaagctaattgcaacaatgtcctagaaggtgtgctttctgaccagtggattgctcttgtcaatcattggatgaacgagaaatcgaaggtacatgtaccatattcatttctgtaatggtcttacaaattagaactctgtactaaacaaaacaatgcaatattcttttttgattgctaactctacgagaccataacagagaataagtgagcagaataagaaaaactgccaaaagaagaaggcaattcacacagcagggacaaagagttttgctcacacaagagaagagatggtaaaacatgtcttgaatagtattcatctatttccatttcaagcatgtatagctactgttaagactttactgatttggtcatgtgttccatagagacaaaaagatcctgcaaagaagaaaccacatagagctgttgtttatgtccacacacacaagcgcaaaagtgacaagaatataaatgggcatgtggtatactattaacactcaaccatagatatttttcagttattctcatatgttggtttattcgtattaatttttcatatgtttaggataatttgaagagacttatagctgaacaactagctttagcggatgctagtaaaggaaagactgcttggaaaggagatgcattgaaccaaatactaggagatgacaagcctgggcgtgtgcatggtcttggactagttccaaagcctaaacaagtgcttgatgtgccaacttcccgacgtttgcagaatataaatcttactacagtggaggataactccagtgaagatgtaatggctattagactgcagatggaaaagttagaacgccatgttgagaataatgatgctgaacttttacaattaaaagagaaggcaaccaagttggaaaaggcacaaaagaatcaggtgaatttaagggagttgagtcctaaaaaaattatatgagcttgtgtgtgacccaatgaatgcatctaacttacctaattgaagtaacagggaggtttagatggagcgtcaacaaacaaaaaagctatttgtgatgacgtacctaattcaaaaaggagggtatgtatctttatggaagaaatatcataacattttctgcattatctcataaactgtggtatagatctctgttcattttctgttatggacagagagtgtatggtgacaacccctcgcaagaaatttgtatgtttgaggagggaaacattatggatcagcaggacaacagtttgatggtaatgtgatatagcaccatcttataactgggaatagctgtgtttttttacttgggaatagcatttattttctctcttttacaatagaatacacaaagccatgtgcacgatgagaatttgcaaccaccaaccaagcattctactgtttacaaggtccttgcctttgcatttaaaatattattatatatatatatattcactattatttacatagcattcattataatcatatgccttcttttactctagaatacacagtctttgggccagaatcacagtgggaagcaaaggaagattacttcctgtgcaaacaaggttaatttcacttttttattaattggagtgcatgatgtcagagtaaacaaataattggaacattatagtttgtgccaattttatgagctattccattgcagcgcaaaggaaatttggaccagaatgagcttatgcaaccagggaagagtatttctagtgcatacaaggtaagttgattaagttctctctttatcctttcaaactcaatgccatagtcaataagtgtttgaaagtagcttaatttcgatatataaatgtatatatagatttgtaaaatttatttgttaccttccactgtagaacaataaacctaacaaccaggacaactatatggtgaatgcacacaaagttacaagtacacacaaggttattttttcatcactttaagtcaccatgtctacagatataagctctttgaaactataacacacatgtgtattgcagaacaaagagaaccttacccgcaagcttgttagaccaagcctaaacaagtatagtactgcttctaaggttagtctaattgtttcaagttcaaaatgctatttctatttattgaacactacacaacaactaaaatagcacacacagcatgttggtttttactgtaaattctctctattttttcagaaacgacaatgcaacacaatggactttttaactgacaattcaacagtggtaaaccttgctaacattttagtctaaatagtttaataaaatctggtcttaatgtccttttattttccactgtgatagaaagtgtatggtgacggtcccttgcaagaaatttgtcatgttgagcaggaaaacattgtgatggtaatatacataaatttcattgttttatacatgggaatagttgcactattttgtaactgggaatatatgctctctttgacaacagaattcacaaagccatgttcaagatgaggataagacaccaccaaccaagcatgctactgcacacaaggtccttgtctttcaatttatatttttattctgaactcaccatggttgcatcctattatatggttatcatggatacatagcattatattatttggtactgtttgtaactaactatgaatgtttactatagttcatgacaatgtgatgtattcttttattctagaacaaacgaacctttggcctaaatgaccatgggaaacagatggagattatttgtgccaaggttagttttcacttcttatttagttcaaaaattatttgatagaaaagtttgaaagtaaaatttcttaatatatataattttagcactgatttgttgccctcccctatagaacaagaaacctgacaatcaggaaagccatatggtacatgcacataaagttggtggtgcatacaaggttgtttttttattcaccatgtttacaaatatcagtccattcaaactataacatgcatgattcactagtattatgattcaattggagaacaataattggctctgtttggtctttctttctttctatcttgtggttaaattgcaaaccatgatccaaattttttttatagaaacaacagtgcaacaaaatggactttatcactgacaattcaatggaggtattttactgtgaaattatttatgatacttgaatttcttaaagtacattgataatattgatggatgtatttatgcacttcaggttggaactaaagtattcttaaaaagttggaaaaatcggaatacaaacgtggctcttgccactattgtaagctgtgatccaacacacagagttggaggtgttgagctaggaaatgaatttttaatggttcatgtcgatcttgcattggcaaaatccgaagatttgattaggccatacaaaggctacaaaattgttggtcatgttgtaggacttgaaattgcgtagcctgcaatttttgtatgttcctatctcttacttctttcttcggagatgtgcttttcgtcttcataatggtatattaatgcttatatattttttctattataggttgacaagataaatgggtgaagatgtgggggaaatttcgtgactgccagtacgcaactaggtcacctgtacatatcacggaatgatgatggctgcaaggtggagaatgggggcaacaagatgtgttttttttatatactttagattctattttctgcattaatgttctgaacaaaggtttaatgccatgaattatactgatgattgtctatgtaatgcaaaatactatatttaatatataatcgattatcatgattgattggactattgtcacttgtgcatgctttgagttcatgggtctcttgcctgacaaaataattggtcaaaggccacctacagtggatagctcaaattacaatatttgtacatgttgcagcaacttgattatatccattgctaagattatataaaactgttcatctctcaagggaacaacatatataagtattgctgaaacctattaaaattgttgctaagtagcaacgcttatttccacttgttatcaacggttgtctatgtgttgtaattgatcctagcaacggcagcataggcaacgcatattaaatacgttggtgcagaccctagcaatacttatagagacttttagcaatacatatatgtattactaaagggggttcctcttgtagtgcgggcatctcgtttgtttctgtcagcaagagtagtgatgatcagtggacggtgcgtaggaaggctcttccgtttcttgaatggaatatgtgtttgccaagtccagttgcatgtttggtggatgcaaagtggattctgcattagtacactttgagatgcaaagtggattctgcattagtacactttgagagttccatctgtttccatgcatcgatcgtcagcaagaaatgcattaaactaattacgcggatctacaactaacagcatgcatgattatatagtgtgcttgcttaccattaccaagtgaagagaacttgatacaacactacacacatatagctacaacccattaaaacttaacatgcaaacaagcctcatcattattcaataaaaaatatatcttaaaactcatacaaacatctcatatcatttataatttattataatcactactttatttttatattttttttcatatttattcatctatataggtcgtagtaaagctcgagacattctctattcagaataatatttgcaacatcttccatgctaggtgatgattctgggtgagtaccaacaccaacccaaaaaatacaaccatgtgggcccagcataccatctaagtcccacactctatttccctttcatatatctctctctcctgaagtatatttactttcatgagcacctttatttattgttatgtttatttcaatagtggatcacatgtcttatatgtcttatggagatgtgtacatacacattatacgagttaggacaaacatgacttatgttttatttccatctctccagatgttgctaaattagtctataaatttagttaaatatatataaagaagtttgacttatattaggacaaatcagagatgttttataatatgtaatcacagacagttctaagacccatctctaaggtattaccattgccctagacaggttactaaccatgtctatgagatagtggtgatcaatagagacggccaaaaccgtctttatatttattttttcatattttgtagaagaaacaatatttaagcatgcgagaccttttaattatctctaggggtgaaattatttgacaaggcgacaaaacacaattgtgccacctatacagactgttttggggaatatcagatatatacgtcacatttcatttatagctcttgactgtcctaaaaaggaatatttcatcataaatttctcttatataatttcgcttatatggttatgaaatcatagtaataactaagaagaattatattatcattcttttatggaaaaatctagatttattggattaatcgttagtcaaagatcaaaatgtttttaatggagtcaaagctcaaaattagacaatcatatactatatatacgcctatatttctagatgttccaaaggagacacctgacttctttcggttaaatttgggaaatatatcaacactaggctatgcttgtttaacattttgcatgacacaagaacctaaaagttgccgccacttaattagccaaagcaaaaggtaggatatgtttatgaataattaaaaaaacaacatgtacaggggataagtgtgcatgaatgcgtacgtgataacgcattatttttgcacgaatataaatcgctagctagccctatactgggactttcgaatgcattaggaatatatttgaagctagagagagcacatgccgccgtcagcaggcttggccactgagagcttgccggcggcgacatgcccggccaagaaggatgcctatgccgcggcggcgtcgccggagtccgagacgaagctggccgccggcgacgagagggcgccgctcgtccggacgactcgcatctcgacaactaccatcaagttatacaggtgagggtatatatacatatatgagtgtaccatcaagttgtaggtgccttaaatttgtagtagtgcacctacgacacacgaatgttgtgtttcagatcatcatgtttatggtgaaccaaaaacttatacatatttatacaacttaattatatcttagcaaagtgctacgaaaaccaacaaataattaaagtggttgttttcggttcatgaactttggcctcgtctaaaaagaagtcctttaaaaaactagagaaattatgttcgtcgttggctgttttgagtatgattttgtgtgatgtggcgtttgtggtgatttcgacactattaacatatatattgatccaatctttgaaggtgctcgtagagttagatatgtgtcgtgtgtatgtatatgtttataagggttattatatatgtatctatataacctatagaattgatctcttagtgttattattacaattttcctctcatgtggtgcttccacatcaccttaattatatatctatgtccattagatccaaacttaacgtataacaaatcatcccaaagtcactctactattgaccattggatttattttggttggctcaaatttctcttagtgatacatgactcatcccgtacatttatttctccccattatgcacaaccatgcaaccctcaattaaccaagcaaacaatagactaccaaatgccatgcatgaagctaaacggtatggtaccaaatcatattctttttaattttgtgtacatatattcttaattaatgaacatatatcatatatagactagcatatacatttatggttgtctctaaattatattaaagaaaaatgaactatgcctatatagggcatgtctgtttcgatcacaagacaagacagttcaataatcgattattcacgctatcaacatatatactatcataatatcatctttgtttttctatatgtcaagttttttttataaattataatcttgtgtatttctattttgacttaagttatagctagcatttttatatatacccaatgccttctaaatttcttatcatgaaatttgcaaacaaaagttttataccaattcccgcagcagcgtgggggaatcatctagtttatatgagtgtcttcatcacgattgtgtttcattaataaaaattcataggcccgtttgctcaagctttttggttgagctgatcaatgaaatggaaaaaagtcattagcatataattaattaaatattttttaaatgattttttattttctaagaacttttatatggaaagttttttaatgcattatttagctgcttgttggcatgttgactatcctgagtcatccatggaccagcctcaccgttattaaggcccacttgtcaccacctctttctcccccctctctttgtctctcgttcacgcatgctgaggatttgatgagggtggtcggcgaggccaaaacgttagtggtagtagtgatggaactcttgggacgcgccaatactagaggtgtgcttctggagagggagtgggtggatgaggcactagaggacgagaggaggaaggggccagagagagcgggtgtactaggaggacctcatcctcaaagacattgcagccgtcgcctcctcctcacttacttacagctttcatgttcgggtcagagagcacttttttagttgagaataaatcattcccttttatgtgaattccccagcggcgaattaacaatttgtgaggccctatctattcaatctctcgagccccaagaaaacccccctcttcctcagactcaatctctcttttgcagtagatgccgaacctgctactcagtgggcgggcgcagcaactacatggacccctttatttatgttgttgccaatgctttcctgggccgagccggaattctttattagaacgtcggcaggcaaagtctgaaggaaggcagctatccccttggccttcttccttttcgatgaaaaacaaatcaacatctcaatatctctaaaagtccccttcatcgagccggaaaatctcccacccacccccacccccttcgtcgagcctttcctttagtggtaagggatatgcactttatctgaacgttggcaggcattccggaattctcctttttgggccccgggtgaacataggctcaaacatgattggagaggtcctagctacaccatgcgttcaataaaaaaaagcctttgggaagctgcagggattacaaaaagagggtgctttcctatgttgcactgaaaaaggacaaaggagaagacactcttcgactttatttcttcctcccgcgcccgcctaagcctggctcggcccacgttagaggggaatattagcaaagcggaaaaagacagagggagagggagctgcatcttattctcttcgcgagaacttcaggatcgaagaagcattcggaaggggcgaggccttcatttcgttggcagaagcagaaacgatccaatccatttggggcttcggggaacccaaaaacgaactctgtttacttttttcatagatagatgatatatataggaatactatatacatccctttactttagatttagatgtctatgtatctattttttaatcatctcccgattatctttttttttctagttcgtactgctctttctctctaaattgcatcaaagaaaatagagagagagagagagcagatagatcctatcccctataacgaatactcatttctatctattgatagaaaagaaagatcttcgtcacggacattgcctttgttctattttttttttagatttgaggaattcctcatatccaaggcagctccccacaaacaccctacccatacgactatgccctctcttgaatcgagagtagattgggcttcatagctactttcattctaaagacgaatattagtcaatacgcaggcttcttcttcttcttctgcaaccatcctcgtcctcccgcggccacaaacgttgaaaactattgttgccgccattgatgccatcccatgctccaccctcgtcgatctctctgtagtgagttttctcgtaaaacctactgtgtcacaacttgttcctcctagcttgtgtccgttaccctccataatggcggtgatcaatgtagtggttcaccatgaacttgagcttcctctcatgtacaactgtttgcttcttaccgtcgcgttttgcaccaacaagagcacctccacaatcactgtcttccctgttggattcatgcggccacaatctacttccacgacattttgccctcactggattcaatcgagtcaccatcgcgctatacgcctgcccgacaccatcatctaattcgctgccaccggccacccctctctctctaccacagtgcaggtgccctcctttcccccgccgctcaccgaccgaatgacagagttaagcctaaacaacttgttgctgttgattccctcacctcgatgatgtgttcttgttgcacgcaaagtgtttctagacatgcttgacagagaaaaaaaaagaagaatggatcccctatgttactaacatgtgggacccactgtattctttgctttttttttctaattataatgtcatgcaagttaaaatgtctcagggaggcaaagtgcactgctattaaaaattgatggcaactccaattctgggagttttgacaaatgttggatccttgcatttcagatcaatgagcgggtcactgacggactaagggcaaccacagtgtacatgaaaactaatcttatcaaataaagtagtaatttttgttatacttttatacattgggagatgagctaagaagagaatagtgctaagggtaaccttaagcttaaagctagaccataagaattaaaaaaaaataaggctttgtagcatgcatgtacacttcaattctgagtggatgaaggtttttttttcttagtgggcccatcttatagttatgaagagaccatatacattgtaatatgcattataaactaaagaatatagaaacgtgggtttcatcttgttgctctattaaatataaagcattgaggatgccctaaggctatgtttcatacttctatttcccaactcctactctctttttcttgagcaaactcttttcgaatttttgaattgttaaattgtgcttcttttataaaagttttcaatacgattgtctatttaacaaataattttaatctattatttttaaaaaaataaactaatatttaattaatcatagtctaattagctactccctccgttttacaatgtaagtctttctagcattgcccacacatatatagatgttaataaatctacacacatacatatgtctagattcattaacatttaaatgaatatggacaatgataaaaagttttacattgtgaaacggaggaagtacatcgttttcatgcagaagaaatgatcagttccgaacttggagtacgaactcaccgtaatcacatctattgacaatgcacttgtaggctcaccatctttgttcgcatcgccatcttcgtgctcttcttcaagtggagaatcacctacgctgctcgcgccatcagctccaccgacgccggcggcatcggcatgagcaaggcggcgacattttggacggcgtccatcgccggcgagctctggttcgcgttcatgtgggtgctcgaccagctgcccaagacgatgcccgtccggcgcgccgtcgacgtcacggcgctgaacgacgacacgctgctcccggcgatggacgtgttcgtcaccaccgccgaccccgacaaggagccgccgctcgccacggcgaacaccgtgctgtccatcctcgccgcgggctaccccgccggcaaggtgacgtgctacgtctccgacgacgccggcgcggaggtgacacgcggggcggtcgtggaggcggcccggttcgcggcactgtgggtgcccttctgcaggaagcacggcgtcgagccgaggaacccggaggcgtacttcaacggcggcgagggggatcctctagagtcnncctgcaggcntgcnncnatgangtntacgcatggcaatcaaagnccac

SEQ ID NO: 3850 - DNA, 20894 bp, Oryza sativa
  unsure (1)..(20894): unsure at all n locations
ccgcggaacnattggaanttccgatnggcanatcgncatgccnnnnnnnnnnnnnnnnnnnnnnnnnnnnnnnncgacgcgcgccgccggcgctgcggcgcggccgatgaccacgccggagttgtgcaggtactgatcgattctgctgggagcgcgccacagctcggcgtcgcggacgggagcaagctcatcgacctcgcctccgtcgacgtgcgcctcccggcgcttgtgtacgtgtgccgcgagaagcgccgcggccgcgcacaccaccggaaggccggcgccatgaacgcgctgctgcgcgcatccgccgtgctctcgaacgcgcccttcatcctcaacctcgactgcgaccactatgtcaacaactcgcaggccctccgcgccggcatttgcttcatgatcgaacgccgcggcggcggcgccgaagacgccggcgatgtcgcgttcgtccagttcccgcagcggttcgacggcgtcgatcccggcgaccgctacgccaaccacaaccgcgtcttcttcgactgtaccgagcttggcctcgacggcctccagggccccatctacgtcggcaccggctgcttgttccgccgcgtcgcgctctacggcgtcgacccaccgcgctggagatcgcccggcggcggtgtcgccgcggaccctgccaagttcggcgagtcggcgccgttcctagcctccgttcgggcggagcagagtcacagtcgcgacgacggcgacgccattgccgaggcgagtgcgctcgtgtcgtgcgcgtacgaggacgggacggcgtggggcagggacgtcggctgggtgtacggcaccgtgacggaggacgtggccacgggcttctgcatgcaccggcgagggtggcgctccgcatactacgccgccgcgcccgacgcgttccgcggcacggcgccgatcaacctcgccgaccgcctccaccaggtgctccgctgggcggcgggctccctcgagatcttcttctcccgcaacaacgcactcctcgccggcggccgccgccgcctccacccgctgcagcgcgccgcctacctcaacacgacggtgtacccgttcacgtcgctcttcctcatggcctactgcctcttcccggcgatcccgctcatcgccggcggcggcggctggaacgccgcgccgacaccgacgtacgtcgcgttcctggcggcgctgatggtgacgctcgcggcggtggccgtgctgaagacaaggtggtcggggatcgcgctgggtgagtggtggcggaacgagcagttctggatggtgtccgcgacgagcgcgtacctcgccgcggtggcgcaggtggcgctcaaggtcgcgacggggaaggaaatatcgttcaagctgacctcgaagcatctcgcgtcgtcggcgacgccggtcgccggtaaggataggcagtacgcggagctgtacgccgtgaggtggacggcgctgatggcgccgacggcggcggctctggcagtgaacgtggcgtcaatggcggcggcgggtggtggtgaccggtggtggtggtgggacgctccgtcgacggcgacggcggcggcggcggcactcccggtggcgttcaacgtgtgggtggtggtgcatctctacccgttcgcgctcgggctgatgggtcgccggagcaaggcggtgcgccccattctgttcctgttcgccgtcgtcgcctacctcgccgtccgcttcctttgtctcttgttacaattccatacggcttaaaggcattcttaatttcgaccctacaattacagaattactacttttcactcactaggaattaagctggaattcacgaagctaaatggtatagatatttggggtgttacacttttaacccatgttgctcattgtttcttttctctatggtgttacaagatgttacgagcaagtttaatagtatagcaaactactagcttcaatttatttataatcaatttaatagctcattcatataatagttacatactacattattaatatatggtcccacatgtcatacacgcacagtgttttagagtccgtgctacagctgtctacaaatctgtagcccgctcctcttccctctccttatttatcttcttaaaatacctgctcttaactagcctatgtcgtcgagccttgaaaaagagaaattattttctgaaggctctttaccacacgatatgcaccaatgtttactacctactttgtgaataagggtgggccctacgtcagtgggtattagttattgttgtagccataatggtgaaataacaaaagtaggtagtaagctggaccccacaatcactagtcatgagagaaagatgagagaaatcatttgtttattccttatgactaggtagtaagcatattacctgatattagctacttactactcccataatgtatacaacctggtagtaggagtagtattttatttcttactatccactttagatgcacattgtgaatgccccaaggtttggacttatagctatgtgctccaatcgtatttccatctatatatgtcatttcgcgaatcgcgaggatcgatgatccaacggtgttcaagctaggtgcagctgtaactaagagtcctctagaaaaataagtgtgcatgagcttcgacattagttgctggctgcatgttagcgcgaaccaccactaacagagagttttgtgtactagtgcaaagcttatagtaagaggatggtgtataagttttgttgttagaaactactactctttcgtatgttttatgaaaaaaatacccgtacgttgtaacgggtaaaggctattttagttttattattgttgttattgttattatacagtttagatagggtgaaaattaccgtggaaatttgtttggatattacttttagaaaattatgatgcaattaggagtcggatatggattctaataactcaagtggacgtcctcccgtttattagatgtcaactagatggttacgaaaaattttcaaaaaaattgacaagatagatcaatatgtaatatatcactccacaaacatttaagttcaaattcaacttctacaagttgtaacaaaaataacaaatttaattgtaaatatacatatagtaatttgagttttgtttgttatttttgttacaatttgtagaagttgaattttaacttgcatgtttgtggattgatatattatatattgatctatcttgttcatatttttttaaattttttcataaccatttagatgatatgcaataaatagctggacgtccactcgagttgttaaaacagtttcccggtaggtgtctccctttcatctcaagttatcatgcgagttttttaaaagtatttcttatacgactccttctgtatttttaaaagaatcccaagttagcgtgagagttttttttaaaagagatttcttatacgactccttatgtatttttaaaagcgaaaaaaattaaaaacggactcaaacacgtatctatattttcaaaagcgaacgaactttgaaaccgactcaaatacaattgacctaccaaagtattggtaaaaacatcttcaatttttataatagtagagataagtcgctttggcttttttacaatcaaacttgtttaagtttaacaagtttagagatagaaaaacgtaatattatttttaataaaaataaacatgttatcaaaatatatatttggttttacatataataactaatctggtgttatatatagatgctataaattttctataacattttttcctaatcaataaaaaaatcatcaacatcatcaacaaattaatgtactgactttctcaaaagaaattaatcgttagttcgttacgtggcggtaaactttttgatcaagcaaacgtagtgttttttctacttcaaatcattttctgagagaaatattttagctgctagttccaggacgacgatgccaaatgtgtcacagattactcctaattaatgcttgtagcttatgtgatatccacatctttcgtgccaactgccagccaagggatgactataatcttggagatggtaattaagagcatatacaaatcacgacgaaacattacgcaccacgagtacacgatgtaccttagagctgcaagatcttcatccataattagttgctacggttgatgagctgacgtgcaccaaagcctcaaaagtcatgggccacatgcaccaaaatgaatttcctctccttaatttcctgtgaaaataataacttagttcaaaagcgaaagttccatggtaactaatttgttttcgatataaccctgtgataactataatttaaatttaaatagatacaatctcctataatttaaatttaaatagatacaataatctcctcgctcttttttatcgaacatctcctcattcgttaccgaatgtcaaattgcaaaacaccttttctaagcacaaacggaatgctatagtttttttattcgattacataaaaatcccaaatatgtatattatatccacacacccacaaagataaatccctagtcaccaaagtacactgttatagatcacttgcaaattattctaacatagtcatgcaaataaattagtgtccatacaccagaatatgttcactaggaaattgtgaacctccatataaactataaaagatttataataaagtagaaccatcttatcccaactaaaaatttagttagactttaccagtatagacattgagataaactaaatagagtttcatttttttcaaaagattgaaggaatcgttatgatcctctagatgttgaatgcaatttctatttctctccctctctcaaagtttctcaacctgaatagacaatccgctgttttgcttcaccaaaccgttctccaaacgaccaaacccatttagtaaaaaaaaagaaaaagccatcccccattgagttactgacaggtggggcccactctccacaatcccacctgtgggccccactgtccagccactgtagtgaccaactcttcctcatcctcccttccatgggaagccaaagaagaggagagaaggagagagagagagagagagacgccggccgtacgccctcctcctctaaatctcctccgattcgcacctcgcctcggcgagatcggatgccgctgaggaggaagaggaggcgctactaatcctttccgcccgccgcgccgaggggatcttggatcgacgaggagggggaggggagcagatgcgggcgagccggccggtggtgcacccggtggaggcgccgccgccggcagctttggcggtggcggcggcggcggtggcggtggaagccggggttggagcaagaggtggagcggcggcgcatggcggggagaacgcgcagccacgaggggtgcggatgaaggacccccccggggcgcccgggacgcccggcgggctcggcctccgcctcgtgcaggccttattcgccgccgccgcgctcgccgtcatggcctccaccgacgacttcccctccgtctccgccttctggtgcgcccgctcgagcttccttggattctgtttacccccctttgtctggtccccctctcctaccaaatctttgcccttttaggattgaaattggtgtgtgttgttagtttggtctttggaaccgaaatggtagtactactaatttagcatgttcttggctaggcggatccctcgaatcacgcggctcaattagtccaacaaatttagtcgcctactttgcacttaatttgttctgttcagttacatcctggtcttatatatatattacggagtacttacgaaacatgagaacaaaacatgtttatatgaagaaatggaacttaagaataccgtttgtaagttctaccacaacccactgcttaggtcaaactacctcagctgaatgcacacaaagatatgttggttctgatttttttttgtttatcttgcctatcgatcaactttaagcgagccccttgttggccgagcaaattaacatttactcttgtaatagcattgtagaatagctttttcttagagcatcaattctaatgtgtaaggtgcattcatgttattctgctgcgcatttgggtggcatataatcgagatatatgtggtgactgtccaactttacgtcaactaaactacaaccatgcatgttagaggttagtggttcaagacaacaattttcgccttcagtgggcactcaggcactgattggaggcagcggagatgataagaggttcaggcctgagacttgccgttaatcccgttatgctttagttagagggaaaatgacaactacatgagaacagggataatctaaacaatcgccaactattggataatccaactgatatggctctttaaatttgtcactagcgaccaaagtttgactccttgtcgatgcatgttatgcccaaagttagactctttgtcaccccatgctaggtgcctatgttgtggattttctgtggtattcccttgtggtttttgttcctggcatgacaatcaacgatttttgttgactctctattgatgatattggaattaattctagaagaaaccattattgttgcttgattacttatgatttatgttgagaagtgttatttttccaggaaaaaagggacaaagtgttgatatctttctatgggattaaatgttgtatgcctttttttacttaatttggcaacctgaaagaggaactcaaaattgtgcatgttatttcgcatttatttttgcctcctttccaattcagtcaagccattttccttgatgcattaactttaacttcatcttgtttgctggttgcatttcgctatttaaattgcgaactctgtttagcatctttgctatcataattcataatgtactgatcataatgaactaatataaaaccattacatgcttctgaagggagcatgttgaaactgttttttaacatcaggggtcatgtttagtcttaatagtatgttcatttatcttcattgtgacatacttcggtaccataaagatccaaagctttcttcagtaagtcactaaatttactaatgtggttctatttttggtccagttaccttgttgcagcagccatcttgcaatgcttgtggagcctttcactagccgttgttgatatttatgcacttcttgtgaagcgttctttgcggaatccacaggctgtgtgtatatttaccatcggagatggggttagtgttttatctttctataaataaggggccatttttgctaagatcccttttttactttttgcataaatagaatacctattgaacaacgttattgatttttgtagatcacagggacactaaccctaggtgcagcatgtgcatcagcaggcatcaccgtgctcattggcaatgacctgaacatatgcgcaaacaatcactgtgcaagtttcgaaactgcaaccgcgatggctttcatcagctggtttgcacttgcaccgtcctgcgtcttgaacttctggtcgatggcctccagatgaggacacagcttgtatttagacataattttgggctgtttgtcagccagatcactcggtgcaacagccaggagaaaacgtagtgcagctaattatactacgaccaagttgatgaatgcctgtgtaatgaaatttggtgtcgaattgtttgtacaaaataggggatagtttgttctgcaaaagggtggttgtgaagctctgcaatttttttttttttgaaaacggcatgtttcttgtaagaagctttttgtgatctgaaaacacagagctcaacgtgccgatttattatgtcattttattattctgatgtgatcttcatttccgagaaatatgcagttcacattttgcatcattagtgtcaggatagtagctcttccgagaactaggtaaccatgtgaatttaacgcaacatgaaccagtgcgttttatcagaagtatgttgaatttcaagctgttgacatgtgcttacttacaaaggttttttgtatgttgcagtgcagaccgacacccaacattatcaaatttgtaagaacaggtgctcatttgaagcagtagttatttacaggttacaagccaatcgtgtggtaaaagttactccaatgtctaagaacagaagaatttttctgttcttctaaactgcacctctagtgtacaaaacacaaccatctgtacaggctgcaagacctgtagtcctgcagctcttgcgatacttgtgttaatagatgaattttcagccttctccaagccaatctatagcatcaaaatataggtactcaaattcttccgcaaagttcatgccacctagcactatacttgagacatcagtaattggaatacagtacatggagatgccactcaattatccaggcaaaccccacagctgcgtgcacaaaactgttgtttgccagttgtagcatcagcattctagctctatgtactgctgaattgcacaggttaacaaggctgcagtactgcaccagactgtttaaaatgttgcagatgcagcatcagcaaaactggtatatgaagatgattgttcagttcctctgggcttaaggcacacgaaatgatctgccggtccatacaatcaatccttcactgattttgctatattgggttgctaaatgttgtgcttcccatgtcaggttgtttcttcatagccaagacaatcttgcgagttatgatagaatcccttcgaacatacaaaacagtgttcactgtcactggcattcaactagctagagaaacaataccacttccccttttagtttcatcagctatgaattgtcatacacctgcattataaggaaaagatgttcataaatctgctgaacagtgctagtcttagaaattcctcaatatgactgataagtataagcaactttcatcacaaaggactcagtagggctaacactatgaacatatttttgaattatagatttatcaaagcgtacacctagcttcgtattgccctactatatagtagtaacatgtttttcttatccaaagagtttagaaatttccgaatattttatgcgcagaaaaagatcaacttaagaaaacatatacaaaaaacaactgcagaaatttggcaagttaaaaaaaatatcagttgaacacagtaaaaaatctaattagcagtcattgtcttgcaaattacattaaacaaatcataagcataccttacagactgctgatgaagaagtgcaagtcaatcgtgagacactagttgatcaaaaaagtcacaaaattgccttcatggcataaattactgaaacaaacacaaaacaaatcatagtgagttcaatgagctcatcaatcatataacaaactcaaaatacttggttgaactaggaactgaaacatttgggacagatagaaaaatactacagtacataagatataaatgagataaaattgaaaaagtgatcaattaatggcataacaatttatgggtcaaaattcaacataatggaaacaaaatgtcaaaatccgtgtccttaataagtaggtgttgtcaattacagattcaatctggtgcaaaacaaaacttatgttatatagcaccatggcgacaagccctagcagaccaattaaattacgaaaacattagattagcaaattccatgaacaatacaatatgttaaagatactagcaaagtaaaggcattgtaatgtataatcagacgcttgaaacaatctgtatttcacctctatttgataaaggtcccatcaaattaacattatgaaggaaataggaaaagtaacttacagactagtaaaacaacaattgctaggataagtaactgaataggacgtccatattgaacttgatactgagacctctgaagtagccgacggaatgcaccaaggcaaccataaagtttcttattgcagttatcctcatcatcagaggtgctcaagcaacttttgcttctttgaaacaacccatcaaacccctaaaataataagccaacattggcttagaacattgctatgtacgtaattaatagtatacaaataatgcgttggaaaagaaaaatgcaattcagattttttttcccacacctggcacgagcgagaatttgtcagaggaagagtttccacaacatcctgttggtcagctccagccaacttcttggctccattctttgtcttcattcttgtctttgattggaaggcattcattaatacagaagagctagggctcttaaccaaaggtaccttgggcagatcatcaaatgattgttcatcgatgccattggcctcatcaggaattgtaatagtccatgatccaatatcagcataggcacttgccgttctcctatgacctggagctgtctcctccttagttgacactaaacctgactctgctgagcccgaagaatcattcgaactatcaattgaaacaccctttttcacccttcttgcattgctaccaacctcaatgtcaccagcagatgtaattgtaaccacctcatcacgtttttgataagttcctgctgaaaggaaatgagctaactcttcacgttcaccctcatccaagcgaacccagctaagagggccacgcccttcagtagtattggattctttcaagaacttctccacctctaggatacgatgcccaatggctgaaacaaagtcatcatgccgagctctagtatctttgccagctaacacaacactataatttgatttaatagcccgctgcaactcatcaagctgacaaaagaaaacaaaaccacaatcagcactaaaattcagacctcatattttcataggtcatctcaaatcaatggtttgttactggtactaggtgttcccctttagcagaaaatttcacaagtaaaatgacacctttatttgcaagaaagaaaagacccgattgtccgttttctacttatgcataagtaccaaaagcaagctttcaagtacgacagggatgccatggcataccgaattggtgtcaagcccatatctgaagtctaaacaaatcaacgcatagtccatcttgtcaacgaaaagcaagccatcgttatgaacaaatgctctaatagaagaaccaaaaaggtagaaagcaacgaagcacatgcatcaaagtcaaagctttagtacttttttcaagaataactggaaccttaagcttagaagacggacaaactatactttggtttattctcacatcctaattcctaaaccaaactacttcgaatctttccaattcttccgcgcaatccccctcatcccaagcaatccaagaaacctaaaacgagtcaaaccaaaatcccatcgtttcaccagccacctagtattaaatcggatgtagcccagctcaaacctgccacttggcggtgccgagcgccgtgtgcagctcgcggcggagatccccagcgggtcgcccccatccaccaccaccacgttccgccggcgtcttcaccgcgccgccacctacttttttcctctcctgcaaccaccttctgtacaccgactccatcctacacgagcaaaaaacccaaaccctcaaaactccaaaaagaacaccagaatcagaaaccggaggcgcaccgaaggaaaggcaagaagaggaaggaggcggcgcaccggtcggcggactcctgcacctcctcggcggccggaagaaggggtccttctcccagcggtcgaacgacgtggccatctcgctggggactcggggggagatagattcgtgggaaggcgaaatcgaatcgaaaatgcgtcggccggtggcggtggtggtggaaaagaggaggaagaaggcaaaaggcagcgaagcaacagcggaattattcgccttttttttctctctctctctcgttttttttttttttttgggtgggaggtttcggcggcagttgattttggtggatgatattaataaatgaagtaataataatgcggtccgagtccgagtggtgggcgaggggcgcacgcgtgggcgaggaggggccttgttgcgtggaagcgtcgtcgtgccgcgttgggtgtgttaacttgctacgtgtaccaaatcggaagtaccgaatttctactttctgatgaatcgggtctcatcggcagcacttgggaagtgggagtgtgggactcctggcaatggaaatacaggtgtataattttgtgcctaaaacgaccaatgaatcaaaataactgttctatccgtttcagattataagtcattttgactttggttaaagtcaaactctttcaaatttaactaagtttgtatataaatataatataataataatatttacaagaccaaattaggtaactacatctataattaaatatattttcataatatattagtcttaggttaaaaatattactccctccatttcatattataagactttctagcattgtccacattcatatagatgttaataaatatatatatagtagtctgtacatccacattcatatagatgttaataaatatatatatatagtagtctgtatatatatttattaacatctatatgaatatagacaatgctagaaagtcttataatacgaaacgggggaagtgctactttttctaaaaacttgatcaaatttaaaacagttttactttaatcaaaattaaaacgacttatagtctgaacagagggaatagtatttatttgcatatttgacggcgtcagcttatacatccatggtttgaaactaaggatacaaatatttatttcagcaaacatgcattttaggaatttaggtcttccaacgtggaacctcatcgtccttccgatattatcactggcacatttctctttgtcataggattttatgctaattaatgagacaaagtgagacttaagatccatgatgtaatcaagaggtaataatttatgaaatagatagtaatgatgctcgaagagtcgtagagccttcgagatgggattaacgtggtagagttaatttacacgttacatcttcgtaaataagtgtactcgattaaagagggtataaaattgcagagacatgatgtatgagtgagtgactataatacttatggtgccatcggttgtcctaatgttaattacaagtcatacggtttattagtaaaaaattataagtaaaatctttataatgtgttcttagctattttaaagtactagaaagcaaaactatgagaaaaaaacttacaatcaatttcaaaattaaattaattgaaattttgatggtggctataagctgtagggatgggagccttataatttgggttatagacccaaacataattttgtaccagactattttcattatttagtctctaggatagcagaagcaggtgtaatctgtcaaattatttgatcttacgtttttagttaatttacaaattatatcttcaaacaatgattgcattgagtcaaaaacctcaagcatgtataagggcactgtagacatgtaaaaagagctgctagtctttacagtattggttcatattcatttgattggggagaatgatatttttagatggaattttcatcaaaatggtcaattcttgatgctttctatgtttttagctttaattaataatggttatgttgagaagaataaattcatatggaaacttaatatgccacttaagattaagattttatgtgttacctacttaaaggggttgttttgacaaaggacaatttggctaagaggaactggcatggtagtatgaaatgttgctttcgcataaaaaatgagactattcaacatttatttttgagtgtcatgcaaaatttctttggagagctttatagttttattctggtttatatactccacataatatatctcatatttttgagaattggcttgtgggagtggataaaaaaactagtaacttattcttgttggagaatccgttatttgttgggtcatatggttgtgtagaaatgatatggtttttggcaagtcaccttctatatcttatatgcaagttcttttcatggcaacatattagcttcggtcatgggctcaactattaaagtgtgatgatgatatcaagctagtaaaagttgcatatcgtaatcttgagtcaacggttatgcagcttttcgccaactttggttggagattcacaaatataattcaataatcatatgttcttcttttaggttggagttttaaatttttgtgtgtgctcctattttgaaaggagtgtgtttttagaactttgtgtgtgctcctgttttgtgaggagtgtgtttttatgtctttgttttgttagtttgagtttggttgaactagtgtaataattggctgtaactctttgagcaaacgccaagatttaattctattatctaaaaaaaagcatattgggttgtaggaaacggccgggatggccggtgcagtcaataatattagagaatttggatcaatgtgtaaaatcccttatatcttagtatagaggaagtatgttattagcgcttctgtttacatggttttctgtctatctataagagttgttgcttcgggacagtcggaaaagaatcatctacgagaacttaagtcaaaacgaaaagagcagataaatagtcacggctgcttatgttatggtttaatttctcaccttctactttatggtaacctaattcttatctcataggtactcctactaattaataatacggttttgctagctagctgtccacagttttggaggctagaaacattcgattttatagccgttcgatctagcgccatgattcgtgcgagattttttttctattggatccaaacctgatgaccaatagatgtgctacccgttggcgtgtatagctgcacgttgcctttttccagaaatttcttggaggcgaggtggcctaggcggaggcggagaccccgccagatgcagctctcggcgatttttttcgccgccggccggtgggtttcttgctgcccgcttcctcaccgatttttccccttcagctgctcgtgttcctcgcggtcgcagcgatcttctctgcctcatgctctctactcaaaatttcatgtgatttttccactttttggtgcattcatgtgatgttttgtgttcagatcctgcatcatgtttgccctataaatcgtttgtatgtttggttggtgttcttctcctagatttctaggggaatcgattcgttgattttcgcacacatgtattgttgttcatcttgaggatggaggcgtcaatgtttttccatttagttacataaattccatcgttgatgtttttccatttagttacataaaaatgtttaattatattccagttaaatagagcttataagttagttatagtctagttacagtccagttacaacctagttacacactagttatagtccagttacaccctagttacacactagttacagtccagttataacctagttacagagtagttatagctcagttacagttacatttagttacagtgtgcctagttattcagggtttcttaatgggcccacacgttctaaacggattggtttcgtgctttcagttggttcagacccgtttcctgtggtccgttgattacatatcttgaggtgaaaaaaattgaaagttttgaccttaaaaactgtcgacagcccaatagctaatcccttaataatataaaaataatatgtgtagaaaaaacgatgtgggagtatatcccaccactcctaggttttagggcagatatgtggacaaaaatcttaattttcaaaaagataccagcttttaaattaacaacagaacacatttaccatgaggctgcaaaacctaactcctaactcatgataacttcctcactttggcaagccgcaatcctacggtaccactaacagaatgtaggaagtagggtatcttttctgattttgagagagtggatataacatgcatctgctttttacttgtcctgtcttgtcttttttttttttttagttttgggttgttatatgctgctttaccattactttgccgtagtgaaggatgacaacactttcatgatcaaaagcacagggcatggtggaggttaagagacggggatgtgattttcttttataatgggcatataaaaactcgatttttgcttcgtagtaaggtacgtacgaccacttattataaagttctgagctcaaaatctaagtgctacagaatagaacaaaggtgaacgaaaaaacgatacaatgacactgatcaaaaggaaaataagcaattcaatgttgaaaggtcaagtctctattgctaaatctccataaaaaaattgatgaaaatctgtatggtgaatgattctaaattctaacatgcagcgcatataccctccgtattctcttcacccctttaaagttgtccctagaatcaaagcaagtgataggatgtaatggagatcaagaagaaatatagtgccaattggatctcttgtagggcgtggtggaagttaccaaatggattgatagatttggatgtgtaactcaacctgcaccatcaccagtggtatgcttgctagcacaccgctcactgaaccttttcattcatcatcaatctgttggtgctatatgacgacacaatagcagaggatatcgactagtggggtcatcgtggtcatgaaattcacagtggtaactgaaagaaaaatattatgatttacctatgaatgactgtacatatgatttataccactaaactatattagtacataaaacacactctgagctttttaaatgagacaaattaccccattgatcaagatgaatttggtcctacatgtgcaaatccatggtttctacactaatgtgggactctacactaaacagaaggtacagaaaagtcaaagcttggaggggagaacattgagaagtgaggggatggagaacaaagcataggcatctaggaagtaaggggaagctagacagaaagaggatacgttcccagaaagaaacagatgaagaaaaaagaggtaggtctgataggtgggcctccctactttatgtgcaagccaccaccatatatgatggcacataaaaccacaaattttgtttctacttaactggtggaacaatttattctgtttcaacaacttagggtgtggtctatattatatttgtggtttgagggaataaattagatgaacataaatatagttttggaagtaaatcagacattttcctatttcaaaaataaacaatacatatatacatatactggagtggcatatatcaatatgatattttataaaggcaaatattgtaagtagcaaattttttttgtcgagaacatttcaatgtcatatatctaactaggatattactagaaaacacgcgtggcttttctacgcgcgagtgaatatataacatgaaaaatgggtttccattgaacattgagtccaatactcaatattcacggtagtaaacatcatattacaaataatctgaatatatgcataaaagaaaggtacaagagagaattatcacactgaaatggattctaaaactccctccatacaaaaaactgaattatgtagcctttagatagattcatacattgctaaagaccagtttaactaatgtcgttatattatcattttgaagcttgagaaacatatctcagattcatcccaatagttgataatatgaatgcaagcctcctccggtcctcctatcaccctggatcattacaaatgcgcacggaaatgtgttaacagttctctgaactaatagcgaaataaacaggtgttctgtaaacaaataaaagcagaaaatatacatatataccatctacatgatagtgcttcctagctcatctctgaagatatttgcaagtgcaaccagttagtattaagataatacaagattgctgctacccagccatgacaaccattgacagagtactttcgacgatcagcaaaggctgcaattttgtctggctattcagagaaccccaagttcccgactcagtgcagtgctgtcatcattcatcaagctagtgaaatactcatctccttccattctcattattacatggaaaaaaaacaagaagtttgacatgatcagtaagcaattacaacaaataaaaacctgatatttgacatgataagtatgcaacaacaaataaaaactctctttttctacttgttagcacaattcatagtcctgctgtcagatatatttggatggatatgctatatattttcatgaactacaaatcacattcaccagccaacaacaatctgattacttccaactgcttattcagttttagttgttcatacaatgaagaaaaaaattattggcttccaaaagtgaaacttagcaaatattcagatagtctgtccaagccagcaaatgaactcctgagaacacggaaaatgaagtatttgtttcacatatcatctaaccaacactaatctgcataccccagaagcaagaaccagtaacaaaaaccactcagctagactaagtgtatgtttttaactaattccacagacacttctctacaaggatgcaattttctattttaaaccacatgacactttcttgattcctcctacctaaaattaactatattgtgactccctaaaatgtaatatacgaaaacttgtaaaactctctcttctatgctcaattttttcccttaatctttgaccattacccaaactaataaacaacacaatctgttaattaagatgtgcattcctaccagcaaatttcatgcaagatccacggtaaggaagatcctactgaacaaatgcaatacgtagcaattaaagagcttaaatctccccaagatccatggtatcttgcccctgcatcaaaatccacatggcaggtagaggtagtatgcctgtgatggcgaggtggatttgcagtccaaatccggtggtgtcattcaaagtggtacagcaataaacgacgctgcggccggccgtgggcgtcgcggccgggcgacggcgaggacgaggccgtgcggcggctccgtgcgatgtggaggccgagacggcgtggtggggctgtgcggcggacacgaatcccctcggcttgccaccatcgagctcctcccccaatccagcaaccaggaggaggggacggcggcgggccggatttgagccgcagccgctcgaggagccccgtcgccatgctgccccgagcttgagaggggagaggcattgtcttcgtcggatctcgtcgctgccggcgtgcttgctccccaagtccctgcgcgccgtcaccgagcttcttgcccccatcaagcgacgatgagaaggagatgaagggtcgccggcgcgtgcgaggaaagggcctcgccctgctctcactggggacgtcatgggagaggcggcaacgaggacgagaggagaggtgggggtagggggaaaggcggccactaagcggagaaggtggcggctgcgagcctgtgacgacgagaggatgcaaagcggcggcggcggcaaggcccgtggagagagggcagagtgcgaactattttctttttttttttctttcctctcttttattaggtggggattggggagaggcggggccgcgaaagggggagcaagcgggcaaagccgccgaaggaagggacgtcacgtggcacgatttcaggagaggcaacctgaattctcgctgcgccacgtggaccaatcaaagaccagggtttggacccgaaaatcggtattagagatcgctagtccaagatataaacctaggatattattaatatatcatgcaaaacaaggtattgtacagtaaatgattaattcatgggggcactcttataaaaaatttcatcgggtacgaacattctccctcggaatatgtctgaatttatagtaacgtgttatatgatatatcaaagcggtagccgtacagaaatgcttctcgagcggcggagctcaaggtgggaatcgtcgtgtactgtacgaacattttaattaaaaacaaaattgagtatatcgaaggctgagttgtgaattcgtgacttgtgaaaaaatccaccacgagtgcaggacaaccatctcacgcaagttgtcaatatgaatttatatatggcgcaccacgcgtcatatgcagatcgtgaaaaagaagagaagcaagattaaggccaaagataaatataggaaaaagtatgaattctccccccccaaactattacagtcgtctgaattaccccctgaaccacaaaaccggacattcttcacacccaactatacaaactggacgaattacccccctcgacccaatccgcggtggttttggtttacgtggagctgagttagcattctattcattaaaaaaataatgggacctacatgtcatactcttcctctctctcacgggcgggaggcggtggacacggagctgcggcggcggcagccggcgggtgacgctaaggccgcggcggtgggggatgagggtgacccggaggcggcggctgtagcgcggcctcgccggagtcggacgtcgctgcggcggaagaggagaggtcacgcaatgaggaggcgaggcatgtcgcgtcgcagcggtggagcgcggtatgggcctcggcgaggagctgcttcagtgcttgagcaccaggggcagcgtagggggaccgaggacggcgatggccgggggcagactagttggggccgacggtgccgcgtgcgcacgaggaggcacacggcggcgtcgctttcttcccgcgctcgcacgagggggcaccggcggcggcgacagcgcacgagggagaaggctgggccagcgagcatgttcgcgcgggacaggcggcggacgggggtggaggccgcgcggatctggaaagatgatgcgggaccccgacggcccccgcgcgccgctgtccgccgcacgccccacgcgccgctgtcatccgcggctccacnccnccgtgcgcncgggtcncaagtgggcattacggacacgcg

SEQ ID NO: 3851 - DNA, 3166 bp, Oryza sativa
cgagtatcgaaaccagacgttgagttgttttggagaaaagtgctatttaatgcgaacaattattttttggtagttggcccaattttgcattgttctttaaagagtagaataatggtgcaaagttgatccttttaaaaaataccaaatgtgttgggcactatgcaatttattatatctttcctaatattgattataaagaaatacgtgtgcgatacaacggattaagacatatttgtggatagcaaccattagacacataattgtgagtccatatataaattttcagacataatcaaggccgggacccccctcctgatccagccgataactgtcgtctgtatggccggtctcaatttaccctagcccacaagtaaagcagttgcattgtctctatttaacctatcccacatgtaaaacggtagtcctacctcatataaccgatcgacgttttcaatatctggtaacagtctcgtacatgtagtatgctaagcctaatcatcccatcaaatatatattcaacatccgtagtatgctaaaccagtctattccttaaaatctgatttaatatttctcgatcaatcttaggaacaaccggtgaagtaaagagggaaatgcgcccaacagggtggtacccccccccccaccaccaattttgccaattaaattacgcaacctgactgtgtaaccattgacaattaatattctactggctagttgaacgataaataacatctggtgatattaaaatagcccaactgcgagaacaaaatatttcagttgatcttgactttgttcgtacttcgtagggtgaataatgaatgcgtaaacgtgtttgacatgcagccattctccatctaagcatttttgggcgacatgcagaccagagtgcagaagaatactccctccgtccctattgtgatattttgcttacactatttgactgttcatcttattcaaagaattttagaattattatttattttatttgtgacttattttattatccaaagtactttaagtataactttttattttttatatttgcacaattttttaataagacgagtggtcaaacagtgcaagcaaaatatcaaaatcccttagagcaaggttaatagtacaaccaactgctagctccaaatcatttatagccaatttatacaatagttgcttactatattattaatatctggcctcacatgtcatacacacattatgtcttggagtccgtgctacaggtggctacagatttatagtccgctgatcttctctctcctcttttatctctttaaaatatgtttgtagttgacttatagtctgctattgtacatgctcttatatcagggacggagggagtatagaataggaatccattgatgaactagacttcgcatatggtacaaagtactccctccgtcctagaatatagcaacctataaccggatgggacatatcctactactacgaatctggacagaagggtcttaggttgctatattctgggacggagcctctgtccgcaaccataagtttccgcgtctaattttgatcgtccgtcttatttaaaattgttttataattagtatttttattgtcatgagatgataaaacatgaatagtactttatacgtgacttatgtttttaattttttttcaaaatatttttaaataagatggatgattaaagttgttcatggaaaattatggctgcacttaaaataggatggagggagtagtcacatacccttgtaacgggacacgaggaacatcgtttaatttttttttcatgtatttttgtttttaatttctaatacgtaggatgggtgggaagcagttttgatggtgttggaatggaagaaagacaactgtgcttttatagagtagatacaagaagtgcaaaaaatttgtggccactaaccagttaccaaccaagttctctctgtacactcaccggcatacacacggatgcattctctatacacgcttgaatactgttggaacagacactcataattctagcatgctacgctacgctagatcggatcatctcagatagcttatctgtgacgagccaaaatacttcatcatagatgccctcatctgtgatggattagactagatgtcgttacagatgaggctacaggcgcaggcccatcacagataaggagttatccatggcgggtccatatatgcacccgaaacgtctgacgggctcacctgtcagcccgtcacaaacctaacacttatgacatatttataaatttagtacatcagaaaaaaggacgaaataacctaaaatgactctttattttacctgtcactggtaactagtgtaaccttatctattcgccccatccaactgaaccttatctcttcaacccgccccccctctctcgatccccccatcctctttctctctctcaatctctctctcgattcaccgctcgcgctcgcgctcgcgcccgcaaccacaaccctttcaccgccaccgctagttcgtgctggccgatgactccgtccgcatgccgaaggctgctttctccgccgtgagtgccgactgccaactcctcaacctcaggcaccagctatcgactctgcctccgccatgggccagccaccgcctctgcctctaatggcaggggagttcttctatttgggattatgtgattttgttttgtgcccagatgaatctgatagtgatgatttttgtgattctatcttatgcctagatgaatatgaatgtgatgctttttgtgtttcatgaatgcttaatgaaggttagtgattagctaggcggacggctaggcggacggcatttttatttttttgccctatttttcacgtttgtgataggtcccagttatgacctgtcatagacaaagatcaccaatgacaagttaaaataattccccgtcacagataaaggttacctgtgatggattttagttgcggtccgtcaaaggtaactttacctatcacatataactcaaagtcatcggtgaccatttatctgtgacgatggcttaacctgtcataggtaagggtacgagcccatcacatatgacctgatccagcatagtgctagaatatccataaatatgcacaagttttcaacgggtaccgagctagaattcgcctatagtagtggtgcatctacccgggccgg

SEQ ID NO: 3852 - DNA, 981 bp, Oryza sativa
  unsure (1)..(981): unsure at all n locations
ttcttcttgttgggtttnaaaaaattaaaattccccntcctcgcctaataaanaatattttnctttccgacaactaattttttctgnnnncaacaccannncncccgtttttgtgatctanctctgncccacatnacaanntaattaagatgttagagatttatataagaatgttagacttagcatatatatatgattattacaattttaatataagattagtggcgatttaatatgagattagtggagatttaatataaaattagtagcgatttaatataagattgtttacttagcatatatatatatgattattacaattttaatatgagattagtaccgatttagtataagattgttagacttagcatatatgattattacaattttaatataagattattagagatttaatataagattagtagagttttaatattacggttagcaaatatgacctatagatctaacaaatattttttgtatgcacagatggctgatagcgatgaggaacatatactgtatgatataatcgcagagggaagcagccagtactagaacgaagaagaggggaacgaggatccaaaccagtacttgaacgaggaggggaacgtggagagggatgcggaggggaacgaggaggggaacgatgaggaggccagtggaagtcatccctccgctggacagaagagggcacgcggacaacgaggtgctgcgaagaagatagagggtcggcacatcataactgaggtggacgaagatggccgacctagtggcccagcagaagcagccaagaattttgtacgccacagcggttgggttgtgagggacaacgtgcctgtcagcacggtgtactggcacagaacaagggcacgcggggataatgacagctttgtccccgactcaaagaaagagatgctggggaccacaatgcttgagacggtcacgctacccacaggtaccggagaacatagtgaaacn

SEQ ID NO: 3853 - DNA, 15357 bp, Oryza sativa
cacgccgtgctagatcgtccgactcgatgttgttcttgtgatatacgtgtcggacctcgatcccatcaaatcttttttccagcttcctgacttctgcgagatacttagacaactcaggctagagcatttgtaatctttgtgcacctggtttgcgactagttcggaatccccttttacgattagtcgcttgaccccaagtgcggctgcagctcttatcccaacgagtagcccttcgtactcggctgtgttgttggtcgccctaaagttaaggtgaattgcatgcttgaactgatctcccgaaggtgatgtcaagatgaaccccgcacttgctccttggctgttgagcacaccatcgaacgccattgtccatgtttcgttgtcggtctgactgtctaacctgttttcaggcatagtccaatcggctacgaaatcggcgagaacctgggacttgatggctgttcgtggtacaaagtggacgtcaaactggcttagctcgactacccatttcgcaatgcggacgacaacgtctttgtttctcacgacttcgccaagagggatggcggagataactatgaccctgttggcttggaagtagtggcgtagctttcttgacgtcatgattaccgtgtagagcagtttttggatctgtgggtaccttgtcttcgcgtcgtggagagcttcgctgacgtaatagactggtctctgcaccttttctctttcaacaacaatgacagtactcacagagtagggcgtggcggcaatatagagaaataactcttcattaggttggggagcaacatgtacagggggatttgacaggtagcgcttgagtgcgatgaacgcctcttcggctgcctgtgtccatacaaatttgtcttgcttttttagcagagcgaagaaatgttgtcctcgttctcccatcctagcgacgaacctacttagtgccgccatgcatctggttagcttctgtacctccttgagtcttgtgggcgacttcatgttctcgattgcattgatcttctcggggtttgcttctattcctctgccagagacgaggaacccgagcagtttgcctaacggtaccccgaacgtgcacttcttaggattgagcatgaggcgatatcgtctgaggttatcgaaggtttcccgtagatcatcaatgaatgagtcacctgtcttggtcttgacaacaatgtcatcgacgtaggcctcaacattgttacccagctgatcgctaagtgccccttggatcgtacgctggaaggtatttcctgcggttatcagtccaaacggcattttaacatagcagaatacaccgaacggcgtgatgaatgttgtcttcttctcgtcctcttttgccatgctgatttagtggtagccggagtaagcgtcaaggaagcttaacagctcgcaaccagctgttgagtccactagttggtttattcgagggagagggaagtgatccttggggcacgccttgttgaggtcggtgaagttgatgcacatcctctatttcccgttggccttccgcaccatgactgggttagctagccactctggatggagtacctctctgatgaaaccagctttgagaagtttatcgagctcttctcgtatggcttgttttcgatctggtgcaaatctccgcagtttttactttactggcttggcatcgggtcgcaccatgagtttgtgctcaatcacctccctggggacccccggcatgtcggacggctgccaagcgaatatgtctgcattgtcgtggaggaaggtgatgagcgcgagttcctatttctcgttcagtgatgctccgatcttgactgtcttgtcggggttggcactggagagtggaacgattttgattgtgccgtctgatttcgacgtcttagtcgttctgatcactttcttgggtggctcggctgtggcgggtgggctgggcgtgtgctcgaccatgtcgaggctccgcttgtcgcattggaccgccagctttgcgttcccttgaatagtgattgttcccttcggcccgggcatcttgagtacctgatacgcgtagtgagatgcggccatgaacttcgcgagtgcagttcttccgatgatggcgttgtatgctgtgtcaaactcagcaacatcaaatgttatctgctgtgttcgtaagttgctcgcttggcggaaagtcacaggaagcgtgatcttgcccaatggcttggacgaaaactgagtgattccatggaagggttgatcggtaggtgtcaacacgctttgtggaatccccattgcgtccaaggtgctggcgaagagaaggttgatggagctgccgccatcgacgaggactcgcactaccttgttattccgaatagtgggttcaaccacgatcggatatcgtcctgggataacagtagccttggggcggtcctcatctgagaactcgatcttctgttcagaccacttcatcttgggtgcaacccctgtcacaccctgaaaattcaaaatatataaattgttgtttaaatggaatttttagaaataattttaaaagtcttgaaaagaaaatctaagtttaattaataaattccaatataaaaaggggccagataaaatttcattaaatactttgcttaattctataattcctagatttttctgggatttatttgagctaagaaagtatttttaataaatggaattgcatttaaggaataatttaaattgaaaaaggttttaaaaagtctcttttggctttgggccgaaagtcggcccaaaaccgttctctctctcggcccagtccggcccagtccgcagccgcccgcgcgagcgcgctgtcgcagacaggtggggcccacccgtcagtcgtcgtctaccttcggccgccgccgcccgaaaccctagtttcgcgccgccgccgtttcctttccaaatccggccgctcctttccttctccggccgaatcaatagaggggaaatgatcctcgggatctcctctaccttttctcctttggaatctttggttaaatcgctttggaaagctttggaatcgagttcgattcggatcggttttccctctctccaagccgaaggtttccttcgccgttgccgtcgccgtgggccttcgccgccgcctctgagcccctttaaaaggacccccggtgtctcctctacccgtcgcagccctcgccttcgcctctcgtcgccggagtagccctagcgccgtgtgccctagctttgccttcgccgccgccgctccagccgtgcgccgccgtcgttccagccgtcgccgtcgctcgggaagaccgccgtcgtcatcgccaagtcgccgccgtcctcgtccgccccttcgcagccgtcggaacccgccggagcttcgtcgccgtcgacaacccgaaggtagccgccgcttcctcctcgtcgccgtcgccgtccgttgcttctccgtcgctcttttggtcgtcggtgagttcgccgtgccgcccgcttcgtcccggtgccttccgtttgcgttctcgcgccgccgttcgccggcaagcgtgcgccgcccgagccgacccagctgccgagccgccgccgccgtcggtgacgtcatcgttgacgtcatcgggatcctctcccgtgagccggtcgtggaccgatcgatcttggccgtccgttttggattggatcaatctcggccgtccgttcgtgtgaaccgccgcccgtgcgccggtccacccaaaccctagcccgctgacgcaataaatccccttttccttttcaaaaataattcattattgcgtcataattcaatttaaaccgatttaagtgttttaatccgatttaatctttaaaaaatcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattattacacttatgggataactaatgactcactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccgggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataatttcttttcatttcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatagtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgatgaagacgagccttcaatcgacctccgatgcttagaagaactagagtgacttgttaagtcgttgtcttagatcgttgtgttagtttgcttgcttaaagtttgcttgtgtgtgtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagttccccgttttcccttcttgtgccctgtccatgccagatggtgaatactcgcagcaacgggaatggtcccaacaaccccaataataacaacaatggagagaatcccactctggcccaagttcttgctcaacagacacagcttatgaacatgatgatgcagcaatttcagaatcagcaaaaccaaggaaataaccatgcacctcctcagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattaccctgatttccagaaattagtggataaggctattcgtcaggaggacaagtacaattgcatggagcagaggaaacgtcggattgctcacttcaaggcacaacaggggagtaatcagaagccgcgtcttactttaggaccccagtctatgccacagggaggttcttcgtctgttgttcgtccgcaacgtcagttcttcaacaacaatgttggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgacgcgtgaaggttgtccctgcccagaataactctgctgtatcagcatccaaggctcgtgtaaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggtcagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtaccaggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatggaaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatctaaaagatgcaattctgaaataagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcagaacggatatcctaagggaagcagaagaaaaggtaaagatcattcaagaaagattgcgtgtggctcagtctcgtcataagagttatgccgacaatcgccgcagagatttaagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaacaagctaatcttgaccagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttggaaagcgtcggagacgagttcgattcggatcggttttccctctctccaagccgaaggtttccttcgccgttgccgtcgccgtgggccttcgccgccgcctccgagcccctttaaaaggacccccggtgtctcctctacccgtcgcccccctcgccttcgcttctcgtcgccggaagagccctagcgccgtgtgccctagcttcgccgtcgccgccgccgcttcagccgtgctccgccgtcgctccagctgtcgccgtcgctcgggaagaccgccgtcatgctcgccaagtcgccgccgtcctcgtccgccccttcgcagccgtcggaacccgccggagctttgtcgccgtcgacaacccgaaggtagccgtcgcttccttctcatcgccgtcgccgtccgttgcttctccgccgtcgttttggtcaccggtgtgttcgccgcgttgtcctctacgtgctggtgccctctgttcgtgccgtagcgccgccgttcgccggtgagtgtccgccgcccgagccgtcttcttcgccgagccgccgccgtcgtcggtgatgtcattgttgacgtcatcgggatcctctcccgtgagccggtcgtggaccgatcgatctcggccatccgatttggatcggatcaatctcggccgtccgttcgcgtgaaccgccgcccgtgcgcccggtccacccaaaccctagcccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattaacctattgattgttataacccttttgtacttgattaccttattccttgataccttggggttatattaatttgactagttgagctttatttatattggttcaactagatattagatataattgcttagccctgcttagaaacattattacacttatgggataactaatgactcactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatgggtcactgccgggcaccagactgagaagtggcggagataagcccacgggggtcgctggggagtccatcccttgttttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccgggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacattgactcccagtccgacgtagtaatcttggaaatcggcgctgatgaactgggagccgttatccgttatgatgcggtgagccaatccatatctgcaaaatatccccttgatgaatttgatggcgttgtcagccttgatttcccccgtggatgttgcctcgatctatttgttgaatttgtcgattgccacgaataggaatttgtagctgccctgtcctcgtaggaatggaccgagtatgtcgagcccccagcatgagaacggccaagtgagagggatggtttgcagtgcttgcgctggtagctttgtgtgtttgctatgaaattgacaaccttcacaccgttgtaccatgtcgcaagcgtctttgagggcggttggccagaaaaatccttgtcgaaaggcttttccgaccaatgtacgaccgacggcatgtgacccacagacccctttgtgtatgtcgaggaggaggtgtttgccgtcgtcggacgagacgcatttgagaagtaccccatttggcgccttcttgtatagatcgttgccgatcatacagtagatttttgcttgacgggttattttctcggcttctgcatcatcctcgggtaactcgtcgctgcttatgaatttaatgagtggggtccgccagtcgtccgtggtctcgatgtcggcaacatcgcgctctgcctctgtagcccccgagctgatgtcgggggtgactgggctatcttcgtcgtttgcctctttcactgatggctttgtcaggatgtccagaaaggtgctgggttcgagtggctctcgtctggacgcacgccgtgctagatcgtccgactcgatgttgttcttgtgatagggtaccgagctcgaattcggccttatcgatcgatagtcatcaatgccgtcg

SEQ ID NO: 3854 - DNA, 741 bp, Oryza sativa
acggctttgaaatcgcttgcaccctgtcttgccttgctcgctttcccaaacgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattctgagttcaaatggccaagttatagccatttgaagtttatatgctctttaaatgaatatttgcgaatttcttcatttaaattttaatttaaaatcggatttattgcgtcagccgaagggagaaggcgcgcggaccgggtccacgggagcggggcccacgcggcagcctcacggcccacggtggaccgggtgcacgcggctcacgccgaccggcgccgtgggccccaggcgtcagccgcaccccagggcgcgggcggctgacggccgaaccccacgtggcaaccgctcggtgcgccccggggggcggtcattgcggcgcggccggcgggaggccgcgcccgtgccccgatggtcaccgccggcgaccaccggcacggctgaacagcgaccgagagaggggagggaaagggggaaacgaaacgggggtccaccgctcaccccgagtcgaaagcgacgacgaaaactgcggccggagctgagaaagcggcggcccggcctcgggtcgaccgggtccacggcg

SEQ ID NO: 3855 - DNA, 724 bp, Oryza sativa
  unsure (1)..(724): unsure at all n locations
gggcatcccaggtaacgacagctnnnnnnnnnnnnnnnnnnnnnnnnnnnnnnnnnnnnnnnnnnnnnnnnnnnnnnnnnnnnnncttccaactcgatgaagaattcgagaaatgttggtgtagtattctccaatgaagatgtattcaacgtggttctttaataagggtcagcgtgttgcaagcggttatctagcataaaacagaactattagctctctcgctcgcgaaaaaatttcctgcctcaaaatagcttaattgaggttcatctcaaaaatttcgaaatcacttccctattaatcgacaactataactgaattgtaaagtcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3856 - DNA, 4729 bp, Oryza sativa
  unsure (1)..(4729): unsure at all n locations
gccgcccnnnttggtggattgnnnnnnnnnnnnnnnnnnnnnnnnnnnnnnnnnnnnnnnnnnnnnnnnnnnnnnnnnnnnnnnnnnnnnnnnntgggattatgtgattttgttttgtgcccagatgaatctgatagtgatgatttttgtgattctatcttatgcctagatgaatatgaatgtgatgctttttgtgtttcatgaatgcttaatgaaggttagtgattagctaggcggacggctaggcggacggcatttttatttttttgccctatttttcacgtttgtgataggtcccagttatgacctgtcatagacaaagatcaccaatgacaagttaaaataattccccgtcacagataaaggttacctgtgatggattttagttgcggtccgtcaaaggtaactttacctatcacatataactcaaagtcatcggtgaccatttatctgtgacgatggcttaacctgtcataggtaagggtacgagcccatcacatatgacctgatccagcatagtgctagaatatccataaatctgcacaagttttcaactggtggacaaccaagatctagaggtgaatcttgaaaagggatttctggatgattgaattctcatgtgatcctttggaacaaagaaatttgatcctttggaacaaagaaatggagctcgcaaattcatttgaaattcctatgtactcccaccggattgttaatacttatcgttttggacaagggtacggtctccaaaaagtagctttgataactattttctattataaaatatatagaaaaatctttcaagactaatctgcacatatggtttgcatatttttaaaataaatattttagaaattatttatagtcaaatattttaaagtttgactttacatttattcaaaacgactaatattgtcagcccgagagagtagtgggtagttttctacgaattttggaggaagacatcatggtcgttagtcttctgcttaccaaatacaatttaggggaataattgaatcagcatcggtaaggccaatttgggagagttgagccccgacaaagtgcaagattttcggttggttgctgctacaaaacatggtatggactagagattgcctgcagcttagggaatggcaaaacgactactactctgccaactttgtttcatgaatttggaaacaatgaacaacctgatgttctaatgcccaatctcgaagcaaatctagacaggagttctaataaggctgcggcatggtcatattaattatcctcaattggagcatgagccaatccttattggacttgtggacacaacgaacaacaagcccggatgcaaccacaagaaaaggcccgaaataaatgttcatgctcatagcctggaaaattaggaaagaatgaagcgcaaagatcttcaataagaatgaagcaacatttcagcgagtaatcaaccgcatacactgttggtgcgcaaaacatattgcgagattattaccttaagatctctgggtgagctgaggtttgactggcgtttgaaaagaagtgttgtttgagtgttaaagttaggtttgactggcgaaagtttctatgttttttcctactgtgtgttactccctccttctctaaatgtttaacgccgttggcttttttaaacatgtttaaccattcgtcttattcaaaaacttttgtgaaatgtgtaaaattatatgtataaataaaagtatatttaacaataaatcaaatgatagagaaagaattaataattacttaaattttttgaataatttgaacggtcaaacattttttaaaaagtcaacggcgtcaaatattttaggatggagggagtactaaacaacatgttttatttccatatttcagcagatattcaacgctacgtgattctattcacgcgtttcgtttttttccctattttttagggatcatacgcgtcatcatatcagaaatcctcatctaactaatggttagggatgacttgaacgacatgttcgcaaggccatagtcaaggtcaaggtagtactaattatttttgtctcggttatatatcttgtgggatgattaagcctatctgtccatacgtccttatttcatttttacggcagctcatccgtagcttacgagtctaatcacttcaagagtccgcttcagatgagcatatataacatacaattaaaaaatatcattaaccattatttttgtatataccaatgtgttaacaattacatatatttgttactgatatatagaccttttaatccctcgttattctttttcctttaaaaataatagatagttggtaggagatgtttaacatatggatatgggcctgctagccccacctgtaattttttttctcacaagaaaatagaagtatgtggtgcacgcagcaataaaaccaacatcatcactactattttttttaaagaagtatagataacgttcttgactgacttttgataagctgtttgatagttcatatctctgctattataaaaattaaagatatttttaccgacactttggtacgtcatcctgttgacggttggtactcgtagaccggatatagagggtattggggtacgctggtacgaggatctacgtagtacgacatcaaggaaacaagagacaaagattatacttcaggccctttaataggtaatagccctaatccagttgatatgggattatatagagagaaccacaaattacaaaggaaataacagaactcgatgatactggcgagatcgtagttgagttgatttgactagatcacccagcgacttggctcctgcaaactccggcttcgtaggctgtggtcgctgtgttggctatgagattcgatcccttaggtcctcccggggggtcccttttatatcgcaggtcaggtggtctccaagtaggactcggaggtatcggaccctgcacgatatagtgacgacccagtcctatatgggtaggaacctttccattggtggactttgagatgaatttccttaacgtatacagagaacgtccgtacacgcgccgatgtaccgtattgccgtatagcgtacatccaagggtagagggtataccttattcgtaaccctgacagtagcccccgacttctgcttaaataaactcctataaccgatcacgacttctgatgtcggagttgttgtcgttctcgactggtcgatctcggtgtggggatcgtagagacaaggagtgatcgacaacaccaggcgaagttcaacggttatgagtgaatttaaattgaagtccgagaaaccgcctcgcgcaacggacccagaaatttccgacggccatctctctcctttccttggaattcgcaccgtcggtagtgcgcctatttaagggagttttgggaatccatttttgagtccggctggtgcgaaaactttctagcctctaaacgctcttcgtcttctccgcttccacgcaaaccctaattcgctcgcctcggcttcttctccggcgatctccaacggcgatggacctcgacaagtccacctccagcagtgcgtccttgaagaaattgcaggaggagggcgctctcctcggtcgcaggactatggagagggaaccgggaggtactgaacctgaacccgtcctgggccgcatggttgcggttgaggactacattctctgtggttttcttcctccgccttctgagtttttccttctcgtcttgaacttctacggtctttctctgcttcatctgaaccccaactccatagccttccttagcattttttctcatctctgtgaggcctacattggggtagagccgtttcttgacctcttccgtttttactacgagttgcgctggatggaacctaaaaaggtatccgggtgtgttggtttttgacttcgggatggcttgaagtcgcgatacatccctttccagtgcccctcttctcgtagcaaatggcgggcgaggtggttctatcttcagatagaagattcggatccagtcttcattgttcctgaggagcaaccagacatgattccgtcttggaccaccaaacccgccttgaccccatccctacagtctttcatcgatatcatcgatgacctccgagtacgagggttgtcggggtatgaagtcgctgccgacttcattggtagacggatccagccgctccaggcttgagcctatccagcctttgactactctgggccggaggacgcgacccgggtttctcctcggggtatttttcttgtattctgggtttctctcctttgatgcgcattcctcctgacttatcgaaatttggttctcgatctacaggtttgaacagcgcaatcgtggagcgccgtgttgcctaggtgatgatcagtgatcccacgatggtgagcaacgcccccacccctctttgcgagaaagaagcggctgaacgcgaagccacaatcaacgtgagtgtaatcgatgaccctttacattttaacttttagatctgcatcgtgatttcatgttgtgcaggctctccccttgactgacatcatcgggccgctcgcggaccaccaggtggcggattcgttgaaggagggcgttgcccaggaagcgtccgaccccgccattgccgtcgctgctgctaaaagcagcggcggcaaagttccaagaaaagggaggaagttttcctctgtgctcggcagccgccggaaggcgcccaccccctcntgangngcccntacntgtcctaacttccat

SEQ ID NO: 3857 - DNA, 3672 bp, Oryza sativa
cgtcttgcggccgttcgaggcttgctacttgctgtcctcacttggaggtgctccaagtcgagacagggcgcttctcagggctggtgctcgcggcataagtcgcgagatcgcggaggcgagggcggcggcggcgtcgtcaacgaacgagcgcgacgacaaacttgcgcgtgacttggcggaggtctgcgaggacctccagaaaatgagggaactggtggccggcaacgagcggcaacgacaggggctcgagaaccgcatgtcggaactcgagaacaacctgtcggagatccgaggttcgttgcgggtcacctacaccggcctacaccagctcgccagggaatgtggtgccaaaactaccatcccggcgaaccctgacgagttctcattgacgtcttcgctcgcagaactggcgacggcgatggaggcgatcccctccaagcacgcggccaggatcggggaagagacgtccaatgggatcaacaccggggcgtgccacgtcctcgcatgcgtgaggttggcgcaccctgaactcgatctccaaaagatcttggatcagggggcggctagcgacgcgcgcaaggatgtgatggaagaagttggcgatctgggggagtccgttctcccacttttcgaaaagtagggacgccacttgcctgtaccccttaaccaatcgcgctttgtaaaactttcattggttccaactgcctttctatatgcagttatcgcctcagtttcccttagcgtcttgatttcgagtactttgtgttgcttgtagagacgttgatgtcgaggatatccaccagcgtgggcagcctgagttgcctgtaatcgctccggtactcgcacttgagccgtacgcgccccaggacggtgtgaaccaggatatggcgacgattcctttaggttggttctttttgtctccatctcctttgctcttctatctggattggcttaaattgccgtgctctcggaaaaggagagcagcttaacttggttgtttgcttgccgagcagacctcgagagttcgctcgttgatcacgaccgtcgcatccaatactagaggacgaagttcgaggtcgccaaacttgagagggctatgttggaagtgaagaaggaccgggccgtggaggcactccgaggtcgcgaggtgtggttcaactcgtacctcaggagttgttgcacagcatggtcgtcgtctgccgggaactgcgagtacctcgcgggaatcccgaggagtcatgtcacgcccgaaatttctatccaaaattccaaacgcttacatgtgtgtgaaccctcgtccaggaatcagccgaggcacacaataacaaattgataatagagtacaattattactctaattaataagcgaataaaatgtcattatagaggtagatagttcctctcaatcaataaagatctaagcagcggaaagaaagataaacggcgcagacggctccacttcacaggcagcttgaccaaggctacacctaatcctccacaccttcagcatcattgtagaactcttcctctgatgaatgattgcaaggtgagtatatgacatactcagcaagccacgcagcaaatatgcaagtgcacaggataacaaaggatggcatagtagagtttcatttgcaaaagcagcatttagcaaacatttgagaatttaataaaacagttaagtattaaacaatattaatccaacgctatacaacataccctgttgtacaggcccaaccattctgaacaaccatcccggctgcacagttctatctccaaaccaggaatgtaccattccaaaccaggagctaatcaaattattaccaattatagcatcatttactatggtgagaagggtgagactaatcacgaaagacattgttagacccgcccataaccgctggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcttggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaatcaatcacgattgaccatcgtgaactatcattaggccatcattaaataatagtgagtcataagttatcccaatagtgagctaatgtttctaaacagggctaagcaattatatctaatatctagttgaaccaatataaataaagctcaactagttaaattataataacccaaggtatcaaggaataaagtaatcaagaacaaaagggctataacaatgaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaattcggattaaaacacttatattgattttaattgaattatgacgcaataatgaattatttttgaaaaggaaaaagggatttattgcgtcagcgggctagggtttgcggtggaccgggcgcacgggcgacggttcacgcgaacggacggccgagatcgatcggtccacgaccggctcacaacggacggggacgatgacgtcagcgatgacgtcaccaccggcggcggcggctcggcggctcggacggcgcacgctcgccggcgaacggcggcgctttggcacgaacggagagcaccaacgggtagcggacggcacggcgaactcaccggcgaccaaagcgacggcggaagaggaacggacggcgacggcgacgaagaagaaacggcggcggtcttcgggttgacggcgacggcgatgctccggcgttcttcggcgactacgaagaggcggacgaggacggtgacgacttggcgatcccgacggtggccttcccgagcgacggcgacgaccggaacggcggcggcgcacggctggagcgacggcggctacggcggcgctaggttgcacggcgctagagctcttccggcgactagaggcgaatgctagggtggcggcgggtagaggagacaccgaagagccttttaaaggggctaggaggccggcggcaaaggccaccgctgccggggaccagaacgaaagatcgtggtttgaagggaaaagaaccgatccgattcgtactctaaataaacacatttcataacccattttacccgatgtttcca

SEQ ID NO: 3858 - DNA, 3021 bp, Oryza sativa
  unsure (1)..(3021): unsure at all n locations
tccaggggccttcaaagcgggaacccggacggggcggccggttgaacacgcggccggggcgttagtttccgggtaaagttctcggccccaaagcaaagccaggtgcgcgggtaaagaacccaagaagcctttaaggggtagaggggcggcaaggccacgcgccggcgccaagagaaagatcgggtttaggaaaaagacgatcgattgaactgaatcaacacattcaaacgatttagccatgtttccaaaaaaaaaggtaagaagttcccgggatcatttcccctctatcaatacggccggagaaggaaagggacggccggatttgtaaaggaacggcggcggcccgaaactagggtttttggcggcggtggcgtgacgaagatgacgaccctgacaggggggccccacctgtcagcgggcggacgtgtgcgcgcccgccggcggactgggccggactgggccgaggagagagagagcggttttgggccgactttcggcccaaagccaaaagagatttttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaaattagatcttctcttctaggcttttaaaattatttctaaaaaattccatttaaacaacaatttatatattttgaattttcagggtgtgacaagtcagcggccggctatatctcgtggctgaacggggcatgcgctcagctcgaaggcatcggcaagcatatcgacgaggccctgaagcaggagtgccgtcgatcgagctggtttgccgaagggcacgtgctggcatgtatacgagatcatcgtccgcagttgcacctcgagttcttccacgagggattttctcgttctcggaggactcccgcggaggtagacaacctggcgaagtcgatggcgccgctggcggagaaagtcttccagtcgatggattggcgttggccttcctggtagtctttgtatatctgtgacaagcatcttagattaagtgtaatatattttggaattttttgcagcctgtaaggaatacttgtgaaatagaaaggaagtctatctaactaagctttcttactctggatgtggtgtgtacgagtgtcttctcacttcgcgacttcgatcattcacttgagttatacactcttcctagcccccagccttgtcgtcggagaattcttctcggaagataaggctcttagacctttgacttgccttagttgaataaacactgatcctagcccccagccgtgaagttggaaaatccatttccgattacacggcttggttaatacgcacggcgagaactcttacacgaccagatcttatatggtctttcgtctctgaagaatccgacaaggccttatcagctctgggcatccccagccgaagttcccttagattcctcggaggccttgtcaagacggcgtaaagggacatgtgaataggtttcaacactaggtatcatctgggtaagggatcatcgggaagggacactttgattgaaatttgcatcttaaaacaggctttattgaagttgtaaggtgtcttacaagtatggatactattgacttatacataaaatttacgcaattggtcaatcttccacgaatttgctaactcgcaaccgtcgccgtctgcaatcttgaatacgcctggccgcaagacttgtgtgatcgtatacggtccttcccatttgggtgagagtttgtttcgccctgcttggctttgaactcgccggaggacgtagtcgccgatcgaaagtatgcgtgctcggatgcgcttctcgtgatagcggtggagggcctgttggtagctagctgccctaacggcacccgttctcaatgttcctcgagttggttcacgtcatcgtttcgctattcctcctgatcctcgtcagagtacttctgtactcgtgtactctgatgtcgtaactcggtagggagcatggcttctgaaccgtacatgaggaagaagggtgtctccttgttggacattgtcggtgtggtgcgcacggcccatagtaccgaggggagttcttcgacccacttcttgtcatgtgacatgagcctgtcgtagatatgggtcttgatcccttgtagaactatgccgtttgccctctcgacctgtccgttactctgagggtgagaaaccgaggcgaagcagatattgactgtcacaccctgaaaatttaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttgcaaagcgtcgaagacgagttcgattcggatcggttatccctctctccaagcngaaggtttcataaaaaaaaaaagtcgccgtggcaaacaccgaannnnnnnnnnnnnnnnnnnnnnnnnnnnnnnnnnnnnnnnnnnnnnnnnnnnnnnnnnnagactggcgtntcattnnccatca

SEQ ID NO: 3859 - DNA, 722 bp, Oryza sativa
  unsure (1)..(722): unsure at all n locations
tggccccannnttggttgatcgnnnnnnnnnnnnnnnnnnnnnnnnnnnnnnnnnnnnnnnnnnnnnnnnnnnnnnnnnnnnnnnnnnnnnnnnnnntgatggaaataacatgcttggagacattgatcatttcatcaatttaaatgcctaatgcttagccgcacgatcagcatgtgttggatgaaaagatgcttgcatacaacaacatctgctgatcgagtcaatcacctgaagacttagttctcacgtgaagagagaacgtgtgcttgtggccgtttggcggctgcgtttctcacggagccgatccggctttgacgcggaggagcaacggattgagcgtgggctgctgttcagtgttagctctatataggagtcaaggagacgtccttgaaggatacagaacacaatagccatctactctgaaattcctctactgccgccgtgttgcgtcgccgtcggtccaagccggccgttgtgctcgtcgtgcaatgagcatcccggtgagcggtgtctccgagccttcgccgcattcgcacctgcacgggggcggtgtaaaggtttctgggcaacgtatttctacgcggccgctcgacatcatcgattgactgcactgcttcgactcgctgatctccgtcgatccattcagtgagtgaattctttcgtttacaaaggaaaggaatctagttttgatcgtacctgagttttatatatgcatggtact

SEQ ID NO: 3860 - DNA, 739 bp, Oryza sativa
  unsure (1)..(739): unsure at all n locations
cgctggttnaatganattgcacttcgtaccccaccgccatcctttccgcgctctcccgccacgggcgcccccgggaggccctctccctcttctccgccgccgcggtcgcccgccccgacgccgagctccttttctgcgtcgtctcctgctgccgccgggcattcgcctccctccccgctcgcgccgggcacgcctacgggtaaagaccgcgccactgctggccttctacgcctcgggcggcccggcgctcgtcgcgctgtattcgatgtgtgggagggtgagcgccgccaaaagaatctttgatcgtatggacggcgaggacgtggtgtcctggaacgcgatgattggggggttcgctggtgccgggatgaatggcaaggcgtgggattgcttccgggagatgcgcgcaagaggtgttcgagggaatgcccgtaccgcggttgctgtgctgggggcttgtaatttggagtctgaaagacaggtccatgggcacatggtaagaacccatggtgatagtggttcaaacgcaattttgtggaatgcgttgatgaacatgtattcacgtgttggatgtgtcgacaatgcagaacatgtgttcttcgagattgaacggaaggatgttgtgtcatggaatgtgatgataggtgctttcgcaaagaatgggcatggnnnnnnnnnnnnnnnnnnnnnnnnnnnnnnnnnnnnnnnnnnnnnnnnnnnnnnnnnnnnnnnnagctgg

SEQ ID NO: 3861 - DNA, 761 bp, Oryza sativa
  unsure (1)..(761): unsure at all n locations
gcgtttgganatcttcgtctcnnnnnnnnnnnnnnnnnnnnnnnnnnnnnnnnncatcattccttgcattggtactgcattcgcgcggcctggaatgctggatccaagggctttggggcaggcagtattttctcccgatccgggagcaagcactggtccgatcaaatttgagtttctcccacaccccaccacggagaaacccttgaatcccgttgccaagcaatcaattttgttcggtgattggtagaagttgctcaaacggaaagaaagccctccatatgagcttaatataattgcattgttgccgctcatctggtccacccttgacgaccatcattgtccaaggattccgattggccctgtcaaaagaaaaaagaaggacaaccattttattctttcagagttcaggtattttgtaacaaacgtcagataaaagagggcctgaactagtgaaattcatgtcaaaaatatcagagtagtgttgattgcatggcttaaagttatactccacgagcagagtaattatgtgtcttcactgcaccatgggcggattatattactatttcgacatgacagacatttcttgaacgattgcatgacaaattcagataaacaattaactgtacaagactaaacactttttactaagaaaaagaagctaatggcaataatttcaaggaagcatgcattctgtatgacagaatcatgagcccaacaattgcttcctgaaattaagaacacacacgatggttaaaagaaaa

SEQ ID NO: 3862 - DNA, 875 bp, Oryza sativa
atgtgctctagggtcatgtgtgtggcaattagtaattcttctgttctttccgaagaagtacattacgtattacatccttcttagtgtttcttgtctctgttgtttccaacgttgaggaaattcaaataattttcgcttagaggccttttaaaaaaaattatgcaaatgtgtagaagaagcatggttctaagatggcattcttggatggtaatcctcctgaaaggttatgcatgcctattgttgaccatgttcgctctttgggtggtgaggttcggctgaattctcgtattcagaaaatagaacttaatcctgatggaacagtgaaacactttgcacttactgatggaactcaaataactggagatgcttatgtttttgcaacaccaggtgattttctacaatctttgtttcttctgcagttcataaattatatatatgcggctactcattttaactgactagcctgtatttagttgatatcttgaagcttcttgtacctcaagagtggaaagaaatatcttatttcaagaagctggagaagttggtgggagttcctgttataaatgttcatatatggttggttggttgaattatttggttccaagtcggaaattactcatcatcgagtttgtggttctccttatgactcatattagtatttctgttggtttgaacatttcaggtttgatagaaaactgaagaacacatatgaccaccttcttttcagcaggtgtctcttctaattcctcatcagttttgctgtcctttcactgcctcatgcatttgctctgtgctatgactgggttatgaactaaaaccatttgtaattgcccaaatgggcacattctatcctgaatttggataccatcttgatg

SEQ ID NO: 3863 - DNA, 1109 bp, Oryza sativa
  unsure (1)..(1109): unsure at all n locations
gcgcgcccccattgaatttganattaagaaccacaacngcagcctgcggtcgactctagaggatcccctcggtttggcttggtgtaagaaatggcacttgagcatgcgcgttctgtgctatgattacaggtcaatgtgagaggactcgagaatgtgttgaaggctgctaagagaacaccgaccgtaaagaagataatttacacatcttcattctttgcaattggcccaactgatggttatgttgcagatgagacacaggtaaaacatgactttgaactgtgtaagctttttaccatttcatgtttgaaaagcttgaatagtaaataaaaggattgtattatgattgtctttagtagttctgcccataggttctgttctaagctcattccttgatatgtactccctccgtcccaaaatataagggattttgaacggatgggacatttcctattactacgaatctaggcatactctctttgtactttcgtagtactacaaaatgtctcattcatccaaaataccttatattttggtatggagggagtagtatagatagcacttggctgacccgacattcatgttaataggagcacataaggtgtccattagtagtatagatagtagatagtcgtttttcttgatttccattgaacttttaatgataaatttctataatgggcaactcactcttgaaacctagctgttcaatttaccccattccaaagtattttgatttacccctgacactctcttatttctaccacttgtataattctttttgataccgacttttagtaacaattatccaacttatgcatgtcctgttgaaatggagtaaccatttcatcaaattatcctctaattacaaaaaggccttttacaaattaaagtaattctataagctataaacagagttcaattgttctaaatttcagagacatcaagagaaaacattttgctcagagtacgagaaatccaaggttcttgcagaccgaattgcattgcaggcagcagcagaaggggtgccaatcaccattctctaccctggagttatctacgggcctggaaaactaactactggaaatattgtttccggattggagaaaaat

SEQ ID NO: 3864 - DNA, 782 bp, Oryza sativa
  unsure (1)..(782): unsure at all n locations
acggctttganattgttattctagctcggtacccatcaaagttataccattagatttgtaataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatatatatatatatatatatatatatatatatatatatatatatatatatatatatatatatatctctcacgcgagaaaaatatgtatatgtatagacatatatggtgctgatctctgaacgctgttataattaatttcagtatatatatgcatgcacaaactacatgcctttttttttgtgctgtaaagaaaaaaataatatgggtgagaataactataccccgatggtttttacgagttaaaatttcaacaaaaaactttgaacgatatatattctgttttcagaaaagcgcccagggtgttgtccacaagatctaatttattaaaatagtgatgtcaaaagctatattgtcacacacggggagagaacgggagtgttaagatattagcagagaagatactcggacgcccactgagcttgtagaaagagatggagaaagatgcttttttatgagaagatccacacacaagcaaaagtgtagatatgggtatctatatgtttaacacccacacatcaaattatgcgaagacggggtagttttcacgagtgtttcacacatgcttgcaaaactgtc

SEQ ID NO: 3865 - DNA, 942 bp, Oryza sativa
  unsure (1)..(942): unsure at all n locations
ttttgtcagatttgtatttgtagaactataattctaaatctaaatagttgcttgatcagatttatagtcgtaagatataacacatctcgcactaggtatatttatattgtaacaaaggaagtattgacttgctaattgatgagaatctaaaaatacacttagcttttttttctttacttttttttttagattttacaactcaagtatcttagaggcttccatcgtttgtcctataacttattagccgctgccacctaaaaattaatcttagagttcattttgattttctttttcattgtagttgtagtttatttttcaaagttgactttaaatttattaagaatatatatatatatatatatatatatatatatatatatatattaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccctatatatatatatatatatatatatatatatatatatatatatatatatacaccctcgccatatttttttttgggaatgaagtggtaaatagcatttatgtgagaagggtttaggagaaattaaaattttagaccaagcagttgtgtttnnnnnnntngtttttgncgaggtgtgtatgagtataagataagaag

SEQ ID NO: 3866 - DNA, 832 bp, Oryza sativa
  unsure (1)..(832): unsure at all n locations
tttacggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcgctaatctccgtggctgtcagcatcctaaacactgcaaaaacagaacgtaacaaaggtcgacatggacaatttcttttagtttcttttgttactcggttagcacttacgtacggttagtcgtccaccccctcctggacggaaacacgtccatgtccagctaacgtcgacgtctctattgcagatttgtaggtctaaccctcctgcttaactaaccaagcgccgtaacgaaaaccggcgagcttcttcctccaccgccgccggcctctgcaccggcggcgacgagccggagagagccagcgtctctcataaaaggagattaaaagttactacctccgttttaaattataagactttttaacattgctcacattcatataaatgttaataaatatctggattcattgacatatataaatgctagaaagttttataatataaaacggaggaagtactatataagacaacgatagtagcagctttaggttcgcgaatatttatatcaaaatctatggagaatttggcttctctagctatcctgttggatagattcgaggccgacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccgtta

SEQ ID NO: 3867 - DNA, 834 bp, Oryza sativa
  unsure (1)..(834): unsure at all n locations
ggtttcttatcgaatgagcctagtgtagtttttcttatctctttttaagtggtatttcgctacttttgtatctccccccccnnccccccagttgccatttagatcacatgctaccccacnnnccgaggaagcgnncgagaacaagcanncacgngccggangngncnacaacgcacaacatgnggnccccgagaaggaacggaagtttgttgtgtcatggaatgtgatgataggtgctttcgcaaagaatgggcatggagagagggcacttgaacttgtggatgcaatgttgcgttgtgggatgcaaccagattcaatgacattcacaactttgctcatggcatgctgccactgtggcttggttgatgaaggtcttgcgctttttgagcggtttgtggaaaattctgcccttatacctactatggagcaatgtgcttgtattggggatttgctttcacgagctgggaggttcaaagaggctgctggatttattgatcagatgccaatcagaccaaatgcagttgtatggggtgctttgttatcttgaagtaggatgcaccatgaatgtggatcatgcacagatcgcttttgagaaactggttcaattggagccaaataaccctggaaaatttgtgactatgtcaaatatatattcaaaggccggaatggttgaggatgcaaagagagttaggatgatgattgacagggaggagttagcgaaaccttttggacaaagttcgggttaaactttggaaagaaggtttttttttgggttattcttgcctggattttaactgatacataaatgataggttattgttggggctgggcaag

SEQ ID NO: 3868 - DNA, 761 bp, Oryza sativa
  unsure (1)..(761): unsure at all n locations
caaagccccgccaaagtaattttttagccttttgcaaaaaggccaaaaggggtaaagcgaccttttttttctatgtgaagggattaagagaccttatctccctttgcactcactggttgcttatgtcacacctgggagatatgcccactttgtttcagttaaaatgaatcaacaatccaccacctgtcttgttactgcctccctaaaaaaaaagaagatattttgtatttatccggattcttgattttttgaagtcaggtatttctaactctacaaatccatagatcttcaatctgttgataacattcaaatgtatcattttgctcctgttatagttgaaatataaagatttaaaccgttgtaatttagcattcaaactttaaatccagtgtggatctatggagctatatcaaatagggctcaagtcaaattatcctaaatttgattcagttttgtagagaagagtcttaacacctaccacacccaagaagtgaattctgaaaataataattttcataattgatctagtggtgtcgatcataaatattatttttcttttttataaagttgcttgaacttataatagtttggattagaacagacacacaatccttatattttgatactcagggaataacgcatagttgtactgttaagtaaacaatagtataaacatattcactgaaccaaaggtttagtcagaaagnnnnnnnnnnnnnnnnnnnnnnnnnnnnnnnnnnnnnnnnnntagcattcaagcg

SEQ ID NO: 3869 - DNA, 777 bp, Oryza sativa
  unsure (1)..(777): unsure at all n locations
gggttgttgattgggttaataactaagctaagacacacctggtgattcgtcgacagggtgtgatgatccttgtccttgttgacccgtaaagaagctgtctcaggacgtgtcaggaatcaagaatttcgtcaggttttacctgcagtggccggacaaaaactttgacaggatgtggtacaatattcttgcccatctttgtgacttttggtcgcactcctaggcgtgtttaacttccttaatctgtcttcctcgctgtctcagcttaactaagtaattaaaagggtcaatttggttctgtgcatctcactccactacaattttgcatgtgataagccagtattttgcttctccataattaatcattgttcttgtgacaatttttgtctagtgagagattcttatcccaaataatctttctactccaagggagaagcagaacattgttcaaaaatcaagaccttatcataatttatttactaccaccatgagatgatgattgaggtaaatagtaaagcatcgaactgtacggcggtggagttgtgagggcataataccaacgaccaaagttcacattctttgagcatgtgttaggttagtcaaaagatgccaagatggtgtccgtatgtgcttggtcaaacggttaattaaactataaccttcgaaaaacaattaaacttaagaaacaactatatgtctataagagtataagcaagttaannnnnnnnnnnnnnnnnnnnnnnnnnnnnnnnnnngatgaaggtacgtcaatcaaacgcg

SEQ ID NO: 3870 - DNA, 878 bp, Oryza sativa
  unsure (1)..(878): unsure at all n locations
tatttgaccttgtttttacaattttntaattagtgaatgctgtntctnaacactttttattttttgggatcannnanatcttntgtgttgtntntgtgttntnatannnnnnnnnnnnnnnaatggtttgatgacnttttgataacnnctgccngnagccnngcagncnactctagaggatcccctcgagagattgctggctggttgatacccgtgcgtaaccaaaaagtctcttattaaatgtatcctaaatcaaatatcggacgagcagggtctgttataacaaaaaatcgatttaatagacacattaacagcactgtttttatgtgtgcgataatttataatatttcggacggttgcaaaattgttaatgaataactgtcaggtagggagcctgatatgcctgtcgactttctaacctctgaccaaaaacagaattacggttgttatgctgcagaacctaatgacgtgcaactggcgcgctattttcatcttgatgaacgggatctggccttcattaaccaacgacggggcaaacataataggctgggcattgcgcttcagctcaccacagcccgttttctgggaacatttctgacggatttaactcaggttctgcctggtgttcaacattttgtcgcggtacagcttaatatccaccggccaaaaggttttttactgtctaggctaacgggagccttcctctaaaggaaattctggttttaataaaggaaattaccggtattatgaaattggggattgcccaggtctttcggctgaagggttgctttatcggcggaattggattggaactaaaacggaagggttggtttttaatattggccgggaatggatgttttaaaaatggattgccaacg

SEQ ID NO: 3871 - DNA, 740 bp, Oryza sativa
  unsure (1)..(740): unsure at all n locations
cgtgtcncatganatgcaacncagcttcgnacccataattaagnttgaaaatttaaaatttagcttttttttctgcttaatgggcaatccgatgggagccttaattaccccgactagacccctattaaggatccaaagaacttttaccaataaaggagctcgagcaccagccgctggtgtcaccattctcctcttgcaatttcaccaccaccgccacggcctctgcctctcgctctctctctctaggcggcgcaaatggcagcctgcgtcgataagtggccggcggcgtacccgtgccgcctgccggataagttctactgcgccttgccggactgcaccaccacggaccgtccggtggcgccggcgccggcggctagcgggagcagcggcgactacgtgtgggacgcgctgcgcgccgaggcgcaggacgacgcggacgacgagccgctcctccgcaagttctaccacgacctcgttctgtcgcggacgtcgctggagtccgcgctcggctcgctgttggcggccaagctttgcatccccggcgcgctggcggaggaccagctacgggaccttctcggtggcgcgactcgcaggcaaccccgtatgtccggcacggcgtgcgcaaccgaccttgctgagattatacacagcatccggcgctgaccaaatacggctacgtggtttctgtgctcaacgggttaaactgcttgaattacccatgacggagaacaccttttttt

SEQ ID NO: 3872 - DNA, 41696 bp, Oryza sativa
  unsure (1)..(41696): unsure at all n locations
caagccccgcgccgacattaggtcccctcgagcggtcggccgcttcgcgggatcagtggaccatcgctggcgtctgtccccctgtcggctgcctcctcaccgttgctgatgcctcctgagcagctgagctctatctcctccgccgattagggatggcaggtgtagaagcacaaatactaggttcgatgagatcttggatggaccacggaaatggcacagtcgctgccatattcacctgcaactcctccgttgcaattcgagatgaacagagaaattgcaatccccgatatggttccttcttgtcggtaagagatggccctctctgtcttagtgtcatggtttccattgattggtgtcaggcgcaatgcaaggtagccagatcagaatacattagatggcaaggcaaggcagccacatcagaatgcatactctgttttttctcctttttctgtgacagcaattcatgttgaatgtggacccaagttcaagaatgttatgtatcatgcttttagttcaataaatatcaataatccatctatgattttgcataatttccagtgaacaaagtactaatgatttaaactacatattaatagtagtgtcctgctgtaggtttaggattcaatgaataattggattgtgcttctgcaaggtaagcagagttagatgggagttgtcatttctctctgaatttnnnnnnnnnnnnnnnnnnnnnnnnnnnnnnnnnnnnnnngggctctccggtaattttggcgtacaatatgaataccatgggttcattgattgagatgtgagtatctgagattattcatatctgatcctgtcaagtgacaattcagttgataacagtcttaattgattttttaatgcagcgatatgagccaaaacaaccttggtggtggccaacagatacagtacaatcttcccactaataagcttgagaggctgtaagttcctcaaatgaagttgtggtttagaaagtacatcagcttttctggtgtctgtgtgctaagtggttattgtttgcagcaatctcgcaggaaaccagttcactggaaatttaccctactcgattttctcgatgtctaatcttaagtatttgtgagtatctttgcaaacatcaagttgattttgcttttaaatttgtataatttggtagagctaaatgttttctctttgtatgtgcagaaatctaaatcataaccaattgcaaggaaatataactgatgtattttccagcctctatagcttgacaacactgtgagtacttttgtgtgcgtggattgtagacgggtcttaacttgtgtattgtaaaatccttctttgttgttcatattcctaatgtctatattcactttccatttccctatgtgatgtgatgcagggatctttcctttaattctcttgctggtgacctaccacaagggttcacatcattgtcaagcctgaagaaattgtaagaaaatgattgtttttctctcatagatatgtctttttggagtgacatgcctgtaatcccatactcgttcttctcagatatctgcagaacaatcaatttactggttatatcaatgtccttgctaatctcccccttgatgatctgtaagaaatcaacctataagtaattaatattttatttgcacgtgcagtaccacatctcatatctttgctttcctataggaatgttgcaaacaatcatttcactggctggattcctagtcaacttaagaagataaacaatctacagtgagttctctttgcttataaacatgtaaaaatgtatgagagatgtaccctgaactaataagatccctgtgtacagaactgacggaaattcttggagtaatggaccagcaccaccacctccaccgtattcagctccacctccaccaaaccgtccaaacagcccaggtcaaaacaatggtggttcaagttctggtggaagctctgggataggtggtggaggtgtagcaggcattatcatatcattgctggtagttggagcagtcgttgcattctttgtgataagaagaagaaaacgcagagcggcattggaagaacattttgaacagcaccagccattcacttcgttcccttcaaacgaagttaaaggtctgtttgcctgatgccttgctgatcatcatactttagttttgttatatattttgtacaattatctgaaaatttgcttctgaaaatgtgcagacatgaagcctattgaagagtctactacaatagatgtagagtctttgccatcccctgcttcatttagtctgaagccaccccccaagattgaacgccacaagtctttcgatgatgatgatttatcaaacaagcctgtcttgaagaaaaccaatgtggcacctataaaggcaactgtttattcagttgcagatctacagatggcaacagaaagctttagcatggacaaccttgttggggaaggtacttttggacgtgtatacagggcacagtttactggtggaaaggtatgctacaattttttctattgctattcctgtatatttctcaaagtaaatgaaaggtagcatgtgtattcattatcacattagtcaaaaggtggaaatgcaaagctaagaaaaaaaagccttaaaatctgtcatgacctcatgaacagaaacaattgagcatagaagtattcctcataaattggaggccgtatagttcttaatgttagtttcagtttttatgttaccgtatttcccctttttgcttttgaagttatttcgagggtgatacaggttggacatttagatataggcaaaattctgagagcttacttttcttgtttacactattcaggttctggccgtgaagaaacttgatagtaccgtgatgccattccattcatctgatgattttgctgaactggtctcagacatttcaaaactgcatcatccgaatctcaatgagcttgtgggctattgcatggaacatgggcaacacttgcttgtttacgatttccacaggaatgggtcactccatgatctactccatctttcagacgaatacagcaagccacttagctggaactctcgtgtcaagatcgcactaggctctgcccgtgcactggagtaagtgaaaaatctctccatattatgttgatctgctgttttggcattatactacatgttattaattttgtacgattttagccatcatgtgtgtccagattgaactaaacaagggccttgtttcttttcattcattatccataaaagttacaaaccaactgatttattactagtttcacaaatttaattagcaatccttttgttcatggcaattgaagtaagaatactgctgtcaaccatatcgtaccatcagaatctcgctaaacttggaaatatcctttgcatgttgtgtttatgtgtagaatgacagttgctagtttcatgctttgtttgaatgtggatgacagttatacattatggaataatagtccttttatatagaattctatgctcattttgaaatatgatatgtgacatcttatcatttcctctgaaaatataatctgtagatatcttcatgaaatttgttctccatccatcatccataagaatttcaagtcatccaaccttctactggattcagaattcaatccacacctttcagatgctggacttgcaagctttatttctgatgcagaattccaggtatggctcttgctgatatatccaagcacccattttaagaggacaattgtttggacagttgtgtgttaattaaaaaaaaatagcactgagatgaaccttcgcttgctaaactaccaagaaaactgactactggacttacagaaattgttggcgaattgatgtagtcatgtagaggctgtattaattttcttaattgaaaagagaagtttatggcaatgatgtcacaccttttatacatcttgattcactagtgattgtattaatgttcgtcacggaaaaaaaaaactatgcaggcagcgcaacagagtgctgggtgcactgccccagaggtggacatgactggtcagtacacactgaagagcgatgtctacagctttggagtagtcatgctagagcttttgacgggacgcagacctttcgataggtaacttgatcttctcatcagtcgtaaccagtttccagcttgcgcataactataaatttagtgctaactgatgaacctcggtataatcgtgtgactttgcattacagcactagaccgaggtcagagcagtcacttgtgcggtgggcgactccacagctccatgacatcgatgcattggacagaatggtcgatcctgcgctgaagggtctgtaccctgccaagtctctctcccggtttgccgacgtgctcgctttgtgtgtccaggtaggatttcaccatcctatgcagatgagctatgcaatactaattacctaatacatggaacagaatgtctgaatcttatgaaacaaattcatgttacagcctgaaccagaattcaggccaccaatgtcagaggtggtgcaagcattggttcgtcttgtccagagggccaacatgacgaagagaatgctcgacggagatacttcgtcgcgccgaacagacgaccaagaacaagatttcatatgacaaaaactacacccctagcttttcctgttacatctcaaattgtatttattttgttcgcctatcgcctattggagagaagaatggaaggagaaatagaaaagaaagtcagtttcatcagtacataatcacaggtgttgcttgatatattgtaggaccaggtgtgccattgtatcctgtctacagaacagtattctgaattcctgattgttcattaatgccatcatggtagtagattatttggttatatcatctgaaagatccaaagaagcatagtgctgctaagtatagcatcaggttcactggttgttaacaagaccagtagtacaactacaaagcaaatgcttcaatggaggttacaagagactcaatcatcaggtacaagctcatatatcatcacttgtcatttaacaaaaattcgacctgttccgtacaagtttctgacattttgcatgcaaaaagctatggtaattttactctgaaatctgaagatacaacgtcatgatgctaaaacccaagcaaatcaaactgtctgagccgatcgaattacgtcagaatccacacgcttcagtctcatcacagattgcacatgcgctctcagcatatgtgcatctcccaatctgcaagccaaccaaaaaaaaaggaaagacgaaaaaaaacattagcacataattaattaagttttaatttttataaacttgacaaatggatatatttcatattttaaagtaacttctatatagaaagttttcgcacaaacacaccgtttagtagtttgaaaaatttactaccgaaaaccgaggtaaaatctgaatcttaataaggaaagaccggggaatcctccagtttttcaaacagttcttgtacctggcgatttctgcccgtcgcttggctcgctccgcgatccgcgtaggccgccatccgctgctgaggagatgatcggaaagcgccctccgttgttgatgatgatgatgatgggagcgcggccacctggtctccggccgccgctcgttgccgccgtagtctctcctactcgcaaatgcggcctgaagaacgaacagattcattattcatccatggccggcacagatctgaactgaagccatgggcgagctctgaatgaggaaggaatccaactacccaagaacagatcatgctgctactgtacccaccttcctgtcgaacagcaggttccaggcttcgccgctgagcgtgtagcggacggcgatcttgatcagatcgaggggggcgtagaacaccaggctgtacagccatatcacgcccgcccatccccacccgatcgcgctgatcgacgcgaagctgatcgttgcgtacacggcgatcagtgtagccacctgcagatcaagaaactcatcatccgttactgagaaaaattcagaaaccttctactagcagcagaagtttttttttgattgtttcagagttcagaaaatcttctgcagatttaccaattgtgctaggatgaaagcacaaatcagcagggctccaggtctctcgaggaaggacaagccctgactgcgtgtgacgaatatcagggcctggctgatgatgctgacttgcaggtacatcgctgacgagatctcgtcggaattttgcttcagagatctcaccttgaagtgagactgcaattcatacacacaaaagcttcggctgttgatttaccaacaagatgttctcatgttcaggttcagattcttcagaggttgcaagattttacctcaaagaaggttgttcttgtgactgtccagtagaacagcacggttaccaatgcaaggtaggttcctatgacaactccagctgcgaatatctcattcagtttccagctatctgggcttggtgatggcttcacgcgatcctttgatattgtcatgatagttcctgatcaaagtagatgcccaaccatcaagtactgaataaatcgagtgtctattcctgcttttgatgcagtaaaattcagagaaaaatgatcatcaccgtcatttagtatggctatgatcagaaccataaacggagggaagtcgtactcccaaattgatgccagaagaacaaatccaatctgcatccaaacaagacgatcaatgacgagatttttgggagaattttgtgatgatgaattccagtttcgcttaccactatccttatagtgatggacactgcataaatctgcagcgaagaagaactctgtgagaatgtgaatcaagcaaaagagaggtgaatttttacaggtgatgaggtgagagtgtccaagaactagctcaccgtgtagttcttcatccgctggaaaatggcgcggctggtgagaacggcgctgacaatgacgctgaggccgggctcggtgagcacgatgtcggcggcgcccctcgcggcgtccgtcgcgtcggagacggcgatgccgatgtcggccttcttcagcgccggcgcgtcgttcacgccgtcgccggtcatcccgcacacgtggccgccccccccttgaatcatcctcacgatctcgtacttgtgctccgggaacacgccggcgaacccgtccgccttctccacgagctcctccaccggaacagccgcgccgccgccgtcgccgtggcggccgaacagcgacgccgacgggtacatgttggtgcccatcccaagacggcggccggtctccttcgcgatggccaggtgatcgcctgcaatgatcaagaagcttcttggcgttgctccattgacgatcaagaagcagtacgatcatcgcgtgattataccggtgatcatcttcacgcagacgccaagatcaagcgctcggcggatggtgtcggcgctgtcgtgccgcggcgggtcgaacagcggcaggaggccgcagaacacccatggtccgccatggccgtgcttcgatttctctggcacctccttcactcaagccatcagatcagatgaactcaaccatcagacagatattcattagcaacaagtaaactgaactgaactgaacttgatggtgctacgactacctggtaagcgacggcgagtgaacggaggcctctctctgcaaatctgtcgatgattagctgcaccttttcagagatatcatccttgttgtagcataggctgaggatctgaagatgagagacatcagatgttcttcctatctgatcaaggtctgtattactattttctgaattctgatggtaacagcagtgagatttacagtgatggattgaaaagttcctacctgctcaggagcacctttgctgactctgaaccagttaccatcagaatcaacgtatgttatagccgtcctcttatcgacaggattgaatggaaggaagtgaacttcagtgatgctagagcgtgcctggcaatgcaaagatgatatccatgaaccattctgaaatatatgtaggatggtcaaatcaagcaaagatgagttcagaacctctttggggtcagctagcatgtttattatggccatatcaattgcatcttgattctccactcttgatgctcttgcagccagcaggataatcatttccctgtccatttctctgctgaaaaccttaaattacccaaggatggatcataagttgtatagctagtcaataattatgaattcaatacgttgcatttttttaattaatttttctacctcaattaggtttttgtcaacagtgagatggttgagggtgagagttccggttttgtcacagcagagaacatccattcctgccatttcctctatggctgtcatccttttagtgatagcaccctgccaaaaatcaattactacatatttttttccgggaatacgcaaggagcgtattttttccattaagagaaataaaagttatttacaatgcgaaaagaaaaacaagcacgggaccggtattggaggctggggatctaatggggatatctcgtgctagatttggctaccacgacctcgcagaggtaacggaagggacccctgcatttgccgacttccaaagcatggcttcctccgccatcgctttcgccaaattactacgtatttttgtaacaatgatatgtgatatgctgtctgttaattgcagaaacatgataacaatatcttggcacacctgttgagacaggtgatgagaacctattgcaagtgtgactgacagaacagtaggcattgcgatcggtatccctccgatcagaagaacaagaacattgttgatcccatcccggtatgaccggtgctggattgggaacatgattataacctcaacaatcgcaccgatggcgattgaacagatacagaagttgcctatggaggtaagaacctgaaaattcagtagtcagaaatagcttacagcacatccacttgtgagattcttattacagtctgaagatcgatgaatcaccttctgaaaatgcccaacaacctcagtggaatccactagatgagctgccttgccaaagaaagagtgtatcccagttgcaatgacaacagcttcaatctcaccatgcttgcatgttgagccagtgaacactatgtcccctgttctttttgtgacaggaagggattcaccggtgagagctgactacaagatggaggagaaacaaaatgtaatcaaattatctacacagatcaactaaatcagtcattccaattatcgatatcttccacatgaacggtgcgcggcaatttgagtcacctgatcaatcttcagaggatctccctcaagtaggcgcgcatctgcagggacaatatcaccaagcctgatgctgataatatccccaggtaccaatgtagaagcatcaagctcttgccattgctcatctctaagaacctggaggtaaatccatgaatatatgaacacaacaagatcagactaacacaatagattcacctgtatttttaaaatttctgttcagaaaaaaaaaacctttgtttttagcgccaaccgggccatgagtgcagcagcagcatcgcctgcattgttctcctcaatgaagctgattgttgaattgataatcaggaggcagacaattcccaggaaatcttcccagtcagtaccttggctctgaccaaagacagtaaatgagtgaataataaagaaaatccattgagttgcttgcacaaattttcgacgatttgatgtcaatatttcaataacacaaagcaagcacttacaccaccatttgctagaaccaatgccatcactgctgctgcctccatcacccaggacaaaggattccacataaagctgaggaacttgatgatcttgttctcctgacaaaaaagatttttttaaaaaaaaaaattcaggagttcagaaaaggaatatgtttcagtttcaggtaaacgatgatcagaaagaaaacagtcaacttacacgcttctcctccaatctgtttgcaccaaacaacttcaagcgttctgcagcatctgctgatgagagcccactctgagacgtattcagctgctcaaaaacgtcttccaggggcagattctcctgtcacatatccacaagaatcacggcatttttcaaagaatgcttcaaatccacgacatcctaacaaatgtacttaccaaatcaacatcttcgtcgaagaaattctctagcccaagcaaaggttcacctggttcatccatgccttcagctaaaatctgtcgcccggaacagaatgtgaaataatgaacacggctacagcatcgtcattttcattccaaatgttgcagtgaagatctcaccacgcattagacaatctgatggacaagatcacaggagatttaagtggcgttagcgaggtgggttttggttggttcttcttgaagtgttaagaagatggcagcttggactgaactggtacagtgagaagacctgaatttgggctgatccaaccaccgttcaaacctccagttagtgagcggacggtcacctgaaaccaaacagtcgcctccgattaccgtgagaactgagaaactgcatgctctcgtgtgcagatgcacgcacagtttctgtctctgctatggcaaacgcgaacatttgataaacattacttatacagtgattatactgttcatcagataattacttcgtagcagcacatcttttcattacttcatgactgttacacttattcccccaggaaagaatttttcatgcatctgaaattttcatgaatcagggatatgttggtttccatctcttaaaatatatgttaggaggcgtattcatagagtgagtgtagtgttacgtgtgcacgtatacatctcccgtgtaatcggaaaaggaaaatactcctatgatttcccttcagaaatatgagtttttttgagggtgatggactgattggctgatggtggtatataccacgtagaacgtagagagcagcaggcgccaaaaggcatctcccccaccacatcttccacaatcctcacccccgcctcccctttgtccctttcccaccgccccaaaaacccaccccctccctgactcctccccccgcagcttccgccgtccgcctccgctcccacgtcgccgcccgctcgtcgtcgccgccggtgagtctcctccactccgtgctcgccccctccgtacccagcagcaggatcggatcggtcgcgcgggcggcgggggtacgtatctgtattccgtagaattgggggaattcattccgggttgcggggttgctaaggtgttggattgactgcggtgacgggagggcggtagtttcctggtaaataggtagtaggagagatgctgagatgactgctggctttgagcatgcggcatatgatgatttagtgcttagtttgggggcttatctttagatactagcgggcgcatggttgtgagttcagtttgcgctaaccaccacttttgcatgaggaggcaaacgaggtcctctccagctgccctgccctagtgtgatatcatttgagcctttcatgctttttgtgccatgcttgatctgttccaatccatttacttcactaaccaaattatgcgggtcatatgcagttttcctttcatgtttctctccaactataaaagtttgattggccgcagccacatagagaaactcggaagattagggagtaaaccaatattaccactgtccacatagctttaacaactaacagctggtcctgctctttttttccttttggcatcagtttgttattgtcatgctatgtttccatttgacgactggactagaatagaatctgtttctttggctcgttttttttttttcatcaaatagtgatgacaaacttgataaatttacatactgatacagtgatacttggctgactttcataacaaacggttttgtgtattgtgtgtttaatggttcctcttgtttttgcagacgctcttgcgtgcttatttgtcaaatcagatctgaatataattttaggagttgcttcagcatggatactggctgcctgtcatctatgaacataactggaaccagccaagcaagatcttttgcgggacaacttcctactcataggtgcttcgcaagtagcagcatccaagcactgaaaagtagtcagcatgtgagctttggagtgaaatctcttgtcttaaggaataaaggaaaaagattccgtcggaggctcggtgctctacaggttcaacctttgtactctattattgcctcacattccatctcttgtgaaaatatatttgattggcttttctgcaggttgtttgccaggactttccaagacctccactagaaaacacaataaactttttggaagctggacaactatcttcatttttcagaaacagtgaacaacccactaaaccattacaggtcgtgattgctggagcaggtatgatataattctaggatttgacagatgaataatttacatatatatctaactttgatagcagtcacatcgtggtcttagcattgtagtttttagctttgatttttttttcaggattagctggtttatcaacggcaaaatatctggcagatgctggtcataaacccatattgcttgaggcaagggatgttttgggtggaaaggttttactcttatgcttttatgttgcatttaattttttttgttattcattctttttttttttggttgcctttatcttaatagctcatattcactgttagtagcatttgtggattattgtttttttttttggggaaatgccttgaacagatagctgcttggaaggatgaagatggagattggtatgaaactgggcttcatatcttttgtaagtaataactctggatttttaaggttctcgttgtgctatattttatttaggttattaccgccagcactgatagatatctctaagggttttgaacaaaaaaacatgtatcaaactctttcatcgataaggtagaaatgccatgcgggaagtatgaagtgatgtctgaggattaacacacatggtagttttattttgtaagaaacttttagattggtttttttcacagtactaaaaagtaactttttactagcttatatggttgataaattttaacgtcacataaatatcatgagctaattgaatataaatcctcctgttcatacatagtcttctttcaacctactattcccttccaaacatatatgaatatgacagatactgtttttccttccatgctcacactgttttgtcgtccacaacagtacatatgtgacattgttcattttgtgcctgtatgtaaccatatacctttttggtttaagttggagcttatcccaacatacagaacttgtttggcgagcttggtattaatgatcggttgcaatggaaggaacactccatgatatttgccatgccaaacaagccaggagaattcagccggtttgattttcctgaaacattgcctgcacccttaaatggtgagatcatatgcagcgctggagttgtttaattaaaccaagattcccagaagtacatcgtattggtggttacttttgttttactaacacatgactgtaattagggggtatattactagcaacgttaatgatagatcaatagatcatgccatggagcttttatgttgtcaattgatgcctatttattatttatcattgatcatgcgtgcatttaacaggaatatgggccatactaagaaacaatgaaatgctaacttggccagagaaggtgaagtttgctcttggacttttgccagcaatggttggtggccaagcttatgttgaagctcaagatggttttactgtttctgagtggatgaaaaagcaggtataagttcacaatatcagtttgtcaagtctctgtgtacaagacacatttctacctcattaatttggaatggatataggagaaggtgttgtaagctagaaaaccttttattttctaataaaaaaactgatgccctttattgttgcattcacattgggaagaactggcagttctgaggatgaaatgcttcatgtactcaagtttatgccctttattttgcccagatccttttgcacaggtttaagcttgagctatgcttttagtttaagaccactgtttcagttaaaggtcaacaaccttgcatgatttcttcctccacctagaaaagccattgcacatattgacaaagcacacaatcctgttgactatattctttatgagctaatatacagaactgttttatacagaaaacacaatacatatgctatagttatcaatctctttccctttttttgggataacggattaatatggtgcctgatacagttgtttgatcagcacagggtgttcctgatcgagtgaacgatgaggttttcattgcaatgtcaaaggcacttaatttcataaatcctgatgagttatccatgcagtgcattctgattgctttaaaccgatttcttcaggtatttattatgttgctctatggtcatgtgtgttgcatatgagtaattcttctgttctttccggagtagtaccttacgtattacatccttcttagtgtttcttgtctctgttgtttcctaccttgaggaaactcaaatgaattttcgcttagaggccttttaaaaaaaattatgcaaatgtgtaggagaagcatggttctaagatggcattcttggatggtaatcctcctgaaaggttatgcatgcctattgttgaccatgttcgctctttgggtggtgaggttcggctgaattctcgtattcagaaaatagaacttaatcctgatggaacagtgaaacactttgcacttactgatggaactcaaataactggagatgcttatgtttttgcaacaccaggtgattttctacaatctttgtttcttctgcagttcataaattatatatatgcggctactcattttaactgactagcctgtatttagttgatatcttgaagcttcttgtacctcaagagtggaaagaaatatcttatttcaagaagctggagaagttggtgggagttcctgttataaatgttcatatatggttggttggttgaattatttggttccaagtcggaaattactcatcatcgagtttgtggttctccttatgactcatattagtatttctgttggtttgaacatttcaggtttgatagaaaactgaagaacacatatgaccaccttcttttcagcaggtgtctcttctaattcctcatcagttttgctgtcctttcactgcctcatgcatttgctctgtgctatgactggtttatgaactaaaacgatttgtattgcccaaattgggcacattctatcctgattttgtatacattcttgattaataccaaatatcatatgtcccatgtattgatcttgttcccttttctttcaggagttcacttttaagtgtttatgcggacatgtcagtaacttgcaaggtactaactaggagacattatatgttacgaaatagtaactatctgtcatgtattattgctcttgtgtatttgttcttgggtttaccatcttcaagcatcacatgatatttattttagtagctgtaacaaaaggcccaaaagtgcatgtgttacagaaggaatccagtattaattattaaacttggaaagtagatatattttatttcagattcatttaggcaacatgtcacttggctctagagtctagattttatggaccataatagctcaggaaattaaagacatggatgcctactgaacggttttctttccttttgttttgaactctttacaggaatactatgatccaaaccgttcaatgctggagttggtctttgctcctgcagaggaatgggttggacggagtgacactgaaatcatcgaagcaactatgcaagagctagccaagctatttcctgatgaaattgctgctgatcagagtaaagcaaagattctgaagtatcatgttgtgaagacaccaaggtgaggacattttgcaagagcgccccctatctgatatatcataggtaggtctaatagttggatgcacacttctctcacgttcctttcttttctgtctcactgttacagatctgtttacaagactatcccggactgtgaaccttgccgacctctgcaaagatcaccgattgaagggttctatctagctggtgactacacaaagcagaaatatttggcttcgatggagggtgcagttctatctgggaagctttgtgctcagtctgtagtggaggtaaacgctgctctccatggttctgtttgtacatagatgcatcagacttgtattgttgtcttggtgcagttcacaatgattcagttttgtaggctaatgagttatcacttgctgatttcaggattataaaatgctatctcgtaggagcctgaaaagtctgcagtctgaagttcctgttgcctcctagttgtagtcaggactattcccaatggtgtgtgtgtcatcatcccctagtcagtttttttctatttagtgggtgcccaactctccaccaatttacacatgatggaacttgaaagatgcctattttgggcttatcatatttctgtaaagttgatttgtgactgagagctgatgccgatatgccatgctggagaaaaagacattatgtaaaacgacctgcatagtaattcttagacttttgcaaaaggcaaaaggggtaaagcgaccttttttttctatgtgaagggattaagagaccttatctccctttgcactcactggttgcttatgtcacacctgggaaatatgcccactttgtttcagttaaaatgaatcaacaatccaccacctgtcttgttactgcctccctaaaaaaaaaaagatattttgtatttatccggattcttgattttttgaagtcaggtatttctaactctacaaatccatagatcttcaatctgttgataacattcaaatgtatcattttgctcctgttatagttgaaatataaagatttaaaccgttgtaatttagcattcaaactttaaatccagtgtggatctatggagctatatcaaatagggctcaagtcaaattatcctaaatttgattcagttttgtagagaagagtcttaacacctaccacacccaagaagtgaattctgaaaataataattttcataattgatctagtggtgtcgatcataaatattatttttcttttttataaagttgcttgaacttataatagtttggattagaacagacacacaatccttatattttgatactcagggaataacgcatagttgtactgttaagtaaacaatagtataaacatattcactgaaccaaaggtttagtcagaaagggtcagagaagaaaacatgggcagtctaaaaacagtttgcctgtccttgcgtcaacatgggtcatactgtactattatattcagttcaccaagttgcaattagaaaaacaggggcacctgctggattatccctcagatatttctctcctccctgagatatttcttagctgattcaataattgtacttttgagactagcataacaaactatgggtcacaacttccaagccatatctcctggatatatcttgcagatattatgtacagatgcctgtgataaaagtgtataaatcccttgcccctgaagactctctttggaggtaacgaatgactgaagtaagcatcagaagaaaaagaaaaatctcggacagtagtagtagtagatttgttcactgcagaatcacctgaaaaacacttttgcttatcctaactgaatataaaaggcgtcgccgtggagataactacgagcggacaagcccatgcctgcttgctcgtggtttcgcaggtagatggtcttcttcctgtctggtagataaaagattactttaagaaacaaaatacaaaaatatactatccctatctttttgagcatcttaaaaagattagtccatatcgatacagttaaaataataattaatcgtaaatacgagcactcatatcaaatctagaaattaaaagttagtggactggttccattaaaaaaaagttaaccagttaactcatgttcatttcacaaaaggagataaaagattttaagatgtggataatagtagttagttagtgaaaattttaaaaagtagttctttttatttttggggcttctaattcttttctagattttatagctatcgactctcaaaatctagatttaaaaaaagctatttcaagaattataaattttatgagaaattgaagctcaaaaatctactcctgtttgttttcctagcctctcttacgcacagggaggtggggcccagcttcagagatctttttggcaacgccacgcccacgccagagcggccacgaaatatctgagaggcggcccggcacgtgtgcgcgcgcgagatattttctttcccccccgcgccacgtttcgcctcgccacgtggaaaagcgctggcacacgtaggcggtaaaagcggtaaagccaccgcgccttcttctttttcttttctttttttttttttgctcgctctctcgcaccgcatttatttgctccttaaacaggaggggattcttcttcgtctccctttgcttcttccgttgcaattccattctcctctctctcctgcttctctctctcctcctcttcttcacctcctcttgtctgtccatagatcgagccgctcagaccaaatcttggatgcgttctctcttctttctcgctgcgagggaggcgggttgttcgatctgcgggtgaaatcgagcgagaggtgtgatttttgtttctcttgtttgtttcttgaagttgaaatcttgtccgtgtttgtttgtttttttttgttttccctcttcgtaatcatccggtcgcgaggagatttactttggtttgttcgccgatttgcttccagatccctagacctccccctacttctctgtagctgtacatatttcaagagaggaaattttgggctggtttctgatacggttcgagaagatttttggcaatttcttcggattttcctccccttgtgggttccttggttcattgagaagaatcaaatgggtgatgtgtcagtcaatcgaccgatcaaggcggagccagctgcaggcggcattgctcaggtattagaacagaaagttttttctttttaccatcgtgtttgttcttaatttcaggtagcaattgttgggctcatgattctgtcatacagaatgcatgcttccttgaattattgccattagcttctttttcttagtaaaaagtgtttagtcttgtacagttaattgtttatctgaatttgtcatgcaatcgttcaagaaatgtctgtcatgtcgaaatagtaatataatccgcccatggtgcagtgaagacacataattactctgctcgtggagtataactttaagccatgcaatcaacactactctgatatttttgacatgaatttcactagttcaggccctcttttatctgacgttgttacaaatacctgaactctgaagaataaaatggttgtctctttttctttgacagggcaatcgaatcctggacatgatgtcgtcagggtggacagatgagcggcacatgcattatataagctcaatggaggcttctttcgttgagcaactctacaatcacgaacaaaatgatgctggcaacggattcaaggttctccgtggtggggtgtgggagaaactcaaatttgatcggaccagtgcttgctcacggatcgggagaaaatactgcctgcccgcaagcccctggatccagcatttcaggccgcgcgaatgcagtagcaatgcaaggaatgatgcggcggaggctttagtgggtgatcatgaatctggtattcagactatccaagggaggactccgttgtcacatggaagggagtgggaggcttgcaaggaagaaaaagctgttggtgaaagtacaggtggttaactcaattacctcattagttcacattgaagaatgcttaaaagtctgaattccttgtttcatcatctttttctgactatcagcggtcacattataactatataaggtgttctgaatagccatgcacttcataggttatgatttaatgcggtttatctaaaatagctttcaatggcttttcctgggatcaaatggtggtgcgtcatatttcatacaaatgttttatcaacactactgatttttatgcggcatgccaaatccattgttcttaagcccgggagcttgtatagtttttattttttgggtgatgtctcttgtcataagaacagaaagaacagaaaaaagttaaagttctactaaggttgctccaaaacagcgtaatgtgatgaacctagtctctaacgcctttcttccattttccttttatacagaggtctctgatcagaattttgctgatgatgaggcggaggttgatgcagaatcaagcaaagcatgcaagagaaggaagttaagaagtgctcttacacggaattaccaagtaatttctcaggattttaattagcttattctgttgcaaatattgagatgaagacagcacactaaaaaaaaaatcagagtatcagtagcactgacatggtttgttctatatatgcaggttgttccatctgacaaactgtttgcttccacaaaagctgatggaaggaaagatgctccagagtaaggcatgcaagagtggatctggttgaatatgcagtcaatgagaactggatgagttagtattggcgatttagtagtatagttctgaactctgtagagtctgtcttggtagaagaataataggatcgatcactcacaacatggtagatttattgtttgatcatattgttgtaatggttttttttgtgtgtgttgctgtgttctggcaactgtttgtttgcaatgtgagtaatatgtttatgtttgccacaagatgagaatgatgcaaagcccatcattccttttgccataattccattgtacatacatgtactcccatcatgatattgagaatgaaagatcaccaattttgcagaatgatatccaacatctgtaaaatgaccatatataattgtgttcatggtgtgtaaagtgcaaattttgagaagtactgaattactgatgatacatgttcttacttccctgtgcaaaccaacattcagcgctgtgtacaggtatgatggtacgcatatttgccactcctggccaccgtcctcgcaagagtttaccaaagaccccgactgaggggaaaccaaagaggcaaagaggaggaaaaccggagaaagaaaacgagagttgagtggaggttcgctatgaagagggggggccatcgccggtggcggcgagctcgtggtgctattcgtcacttgtagaagaggaggggaaggaactgctgcccgggaaggaagttagaggagaggaagacgaagaagaatggatgctgatatgtgggtctcgtatgaaacgagttacttcctccgtttcacaatgtaggtcattctagcatttttcacattcatatttatgtgaatgaatctagatagatatatatatctagactcattgacatcaatatgaatatggaaaatgctagaatgacttacattgtgaaacggagagagtacgttaggaaaccacatttaaaatcgctaagggagttaaattacaatggttttaacagttgagatgtcaaaatattacctggtattatgtggtattgttgttgaggaatatgaattagattgagcctatacataaagggagtcaaatcggacttattcctttgtagaaagcccttgattgggctgatcccctgggtcggcccagcatggcgccttgaactagcaccttctttgtctttacgggcataagcttctagcagctacagtttctcacataatctccaactctcttaagggtgtgttcgctgctgatggataggaacatatcacctaagcacgaaaaatgaagcagtccattagcgcgtgattaattagatactccctccgtataggaaaaaaacgtcgttctagccataacctcgtttgcgattttaacgacattctgaaccgcagcaggctatgtggacggaattacccttgtctgttcgatagccgctcccgcaattaatccgcagcacgcccgcgcttgcctcgtttaattccttaagcgtcgcatgcaggcatgcagcacgccgctcaacctcggcgttcacgctcgcccgcgccggttgcgtcgcgctcgccggccctgctcttgtcgctctcgccgctgccgccgccgcttgcgtcgcgctcgccggccgcgctcttgtcacgctcgccgccggtgctctggtcgcactcgccaccgccgccgcttgcattgtgctcgccggccccgctctcgtcgcttgcgtcgcgctcaccggccgtgctctctcacgcttgacgccgccgccgccgctcgcattgtgctcaagatgcttgacgagaagcgcgaacgtgagctcactcccaggaaggatgatgccaaagaaatggtaagataacacaacttaataatcgcattacaaggatgtctctattaattgagtgcggaacctaactagcttcattctaaatgttcaatgcagcaagagtagccttggcttcatctaggaaagatggttgacaaactgatctgcaacaactcttgtatctttcttgcctagtttcccattcttgcttctagccaacaaagcttgataaacttgttttctcacttcttcggtcatgtctttccttccttcgatggtttacttcaacgagagccatgacatgttctagcaaaaggaagaaaatcaagttcattgatagtacaaatagccatggcatgttctagcaaaatctaattgtatcaaaaagaagttggcttaccagcaaggtgttgtacataatcgaaatcgactgcaccaaattcatttagtggcaagttcaaatcaaaaccagttaaaaaaaatggaaaacaatgatatgagaaacgatatagagaagaagagatagcacagttgccgtacaaacatgcacaagagaagaaaaatcctgtcaaacagagaagaaaagtaccattgccgtgctccaacggaggctcgttcagatcaaaggcaaactcgccatcgccatcttcggccatgtgtactgcaatagtgagaggaagctagctagaagcctagaactagaagatgagatggctcagtactccaaacgtgaaagcaagttagcgtataaatatgggcaagcagtaacctaagcgtcggcattctcagcacgcccacgcgaaaaaattaccacgggataggcgcgcgaatagcggtaacgagcgccatgcaaaaaaatttcagcatcacgcgcggtagtgaacccaaactaaaaaagcgaaacaaaaaacgcgcctaaacgccacctgcacgagcgccatgcagccaaccaagtatccaagcctgcccaaaacagtgccatgcaaaacctagaacccaacttgtccctgccaagattcttacgcgcaaccatatttaataggggtagacagggaaaaatacccataattaatcacttcttggtatgctaaatgctgttctaaacgtcatttttactagtatagagagagtattagctattttttttttcaaaaatagatcaatataatttttttaagcaaatttcgtataaaaactttttaaaaaagcgcaccgtttaacagtttgaaaagcgtgcgcgcggaatacgatggagagggtgaggaatcattgggtccgaacacaccctatacagtccaaattatcacccaaattttgaatacagaaaataaactaagaaaccataaaccagattttcaaaagttagctaccaagcagtagattatcgtaattttaagcactccaaacaaggctagtacagcgttccgtctgccgccttcgtctccccatcggcggagaagtaggagccccgaccgagatggtcgcgtcgacggggaatctcttgccggcggcggcggcagacatggaggctatgcgttcggagaaaatcctatccgccgggggcgcaggattttcgttggttgcggtctgatgggcgaagcggaacgcgcggacgacggcatcttgttcgttcttgctgcgctggatacgtaaaaatctacgatgacgaataagctcgcctccgcgcggtggccggagacacgggacgtcgcaacggcaagcacagcgtactcacaccggtggctgattgacagcaagatctgcaaagctatcaagctctagccagtagccactactccgtcagtcagatcgccggtcacactgctcgcggtttcccgtgcgatcagatcacgccaactcaatcatgattaaggggagcaaaaaaaaaaaaaaaacgtgatcagatcagatcggcaggtgcgccgtcgacggcgacgagacgagaacgagacaggacgcgcctcagctcgctccgctccacccaacattctgacaggtcgatctctactctgaacgagcagttgaagctggcggctagccggccactcgccggacgccgatttgttaacttaattgcgtcgatccgccgccggcccaggcgaaaagatgccgaaagcaacccggcaatcgcaccaagattctcgtcgccgtcgaccagaaccgcgtgtatcaccgatttcgacatgcactcgaatctcctgaagatgattaaaattgagtgtttcatacaaaataaggtggtaataacatgtgattaattgagttttaattattataaacttaaaaaataaattaatctgatgttttagagaaactttcacatagaaagtttccgcacgaaacacaccgtttaacagtttgaaagcgtgccacgaatatctaaaatttcattcaactcttgttggagaaatgaacgcagcataatgcactgtaaagaggtacgtggtttgaactccaaagtcacctgttcaatccccaacacacaatttctttggttttgcgtttactctgtatttctcttttacattgcatactgtaatgacgagacaggaagaggattccatttagcaatcacatagcagtaggtaaatcgtctaaattgcgtagtagtacaggatttggtttgacttgagctaaactgtaccagcattctcgatcttgtttgagctaccactttggctctcgtcgtctcttatcagctacggccaaagtttaaacttttaaaaaggagtaaattacattcatgatgcataaactacctaagttgagtgcaatttggtaaatgagtatcctagtacaacaacttacaggtatttagtgtaagaattttataagtgattgtacgagtgcaataacttacaatgtaggtgtgattttgatacaataaataaaaaagtggtgcaacaatttaattataccgagtatttttttaaataaggattctagtcaattaaactttactatgtagaagatattatatttctgttgagatttgagaaggtaagaaaaaaaattcaaaccggtggtgcaaattagatctccaatgtaattcttaaatattatattcaagattataatataatatcaataggattgctacgtgatggtatattagattattaacatcgtgaaaaaaaattcacctagcactcattaactaaaacatcacatacttagccaagttgttacaccaaaatactaaaatttttaagttctcgtattagaacgcaccaacttaccaagtcgttacactcgaacgtcaattctcaagttcttctatatcacatccacttgtcaagttgtcataccatagatgcaatttacattttaaaaagttaactttaaggcttggtttttaaaccactaataaaagttaaaagagttaaaaggtaaattgtccatcgaagtctattttacagccttgatttttaaaccgttgataatacacataaagttttaccaataattatttttttaatgcttcgattatttttctacggcttatcaattatagctcaatcgatcatcagagccttttcgtataaatttttccagacaaataaatatactgaatgtatcgtcttcttcaagagaaatgaatatatgaggcaaaaaaaatccacaaccatatttccactacgaaataaagcctttagagccctccaagcatccaggtcaaatcatccatcaacctatcaccctttttttttttgtgctctcctggaggatgttggaagaacaaagaacttttcatccccaaactttcttaactgaaagacaaagaaatccaacaggatttggtgagaaaaaaaattgagacaactattgttcaagtgatcatccatccatgggcacaagaggaataagaatgcagggggtaggttaggtttgggcatggagttgccttcaaggctttgtaaccagcaatcctactactctcatctgaatctcatttcactctcacctttttatcaaacttttgctgttaaatcttgtgtgctgtagtagagggacctagactatgcaaccaaccatgcatgtttaatcaccttcatggtatgtgccagccaaaaaacattttgtgactatagcctaataattccaaatacatgccacctgcattcaaaaccatatgattaaagaatggaacattgcctttgcctttcttcagctactactgccaataattagtaaaggtacatgtgtaatcgacctcttagatttgatcaagcactaccctgaaaattcatccagtagaggtttcttttctttaaaacttttgtaaagatattgtcggccattaattaagattgattgcaagtaacagtatatcaagaccaaaagagagtagggaaccagcagtagtagaagtagaacatgcacataaagtgcaaataataaaggagaacacattttcacctaatagtaccatgtgtagcatttctttggttaaaagattagaatataattggtgtgtaagcaaatttttacatgacttagctggcacttaggaatgctttcttatgcctcaaatcaccagttaaacagtcattctaggtgagatgtaacttcactaatcccctcaaacggctctctccaacgtcacatacatagatttgtctgaaatttattcctcttacattacagtggagtaaagtttctgaaagtatcactgataccgaaaggagaaggaaaaagataaaaaggaaatgagaagaacaacaccaaagagaaaagaaaccaaaggagacgtactgcagcctcgaagcattggttccaactaattagctgctttttttatgatcgctgctaaatgtggattacttccagctttgtgcgtcgtcgtctttccacgtgtgaaaaccacgcagtgtttaagcctgagcacgacgtgtatgtacgaccagaaccaattcgatcatctctgcccctctgtaacttggatggaagcatctgatcagatggcaatgaaaacaaaagggaacacatggcttataatgcatatcaggaagcacttttaaatccagaaagcttttgtgttcatcacacctgatctccattctcaagtagtatattatatatttcttctcattcattgcatcatgaaagatcactagaaaacaagaacagaagaaaaaggaagattctgatcaggtcatcaggatggttaaaacttctttatcttttgctgcagtaaggaccgaagtgcagagaagagattgttggcaccatcatcagcttagcatttcagaagatcgaatcagcaacagtgtggctagtatgcttgtagcttatccatccatctgaccatcttctattgggattcttgaaggtgaagggaaagggataaaccaaagcttacatgtcagtttggtacgagagatgaaacgttgtgtactgataatagctggatagatggatgcatatcagcattaatcgggatgtggcacatcagggcaccggtgatattttttctccttaattatgatagttacggatggctgctcactagattagacacttaattttggccttaaatcaactgtacttatttaaggtactccaggaaatgagtaatacttaattttcatgtatttggcattaaaccaatcatgctagctttgttgagttggaatattcaaattccttggaagttcttgtcagagaggtatgttgttcctaccaaatattccagtgaaatgatatactgtttgcaacggaaaatgaccatttttgggccaatttcgatcctatttttcctccattaattacaaaatatttcattccacgaagctgatcgaggaagccttaggatcacttctcctaggtgtggcgtcattgtacttgtacatgttcttggcgcccaaaaaacattttctctggttttttgtcggtcatctaatccagcgacgtcggatcagaatcggacggccaagattgcgtcggattcagagtgaagctgttcttgttcctgtccctgaacagtttgaatggtctcttgattgacccaaggcaaccgaaccgtaccttgctgtacaagggcttgttaataaaaacgacaccacatcagcaatcatatattccaaatccgacaggttattgtcacgaatactagtagaagcactagcactgaagaaagagaaaaaaaactgtaccgatcgaatcattaaaatcacgcataattaaatcgttggatgagaaaaattgattaatcaaatcgcaattaggctcgacatagctgcttcaggggggattgatgcaccaacctcaacaaacggatcagatatataaatcaatatatggatcgcctgtatgtggttgtggctgccttgaactggcacgaacctaatttaattagtatgcagattacacatatctgggttaattcactgtgcttgtttaattaatggcagtgtctacttatgtttcaagcttactgcagaaattataaaagagaggagtatccaccagaaggtaggaaaggtggtatgtcgtgcttgaagctactatatatgaattttgattagggcacagccagagctaattaacttgatcaactaagcaaccggagctaattaactgcagtagcaacagatcaacaaaagcaaccagagccaattaactgcagtagcaacagaccaactagattcactatatactgaactgtttttgaacagctgtaataagactgatctagtactatattatgtacctacagtgctttttctttgtttatatatacccctccgtccaaaaaaacgtgtttaggtttgtagcttggaattcgtttttttaacggagtagcacacatggattgactgtaggaatgagatcctctgctgacactgacatgctggcccaaagagagtagggcccacatgtcagtagcagtgactgcagagaagtagagaacatgtgtgttctagatcagtatgtgcagaggcagcagagtgatagacaaccagagctagtactaatactaacaataaagttaaaatatgtgctctagctaggcctaattttttctagagaagggtattttttacccatcctctatatttaaccggatatatacggccattgaaataggaaacttagccccgcaaacaatccaatctaaaattcgctccataggagatttgaactcagaaccttggggtactactcaagtcactataaccactaggctacataccctttcatagctaggcttaattaccacataaacaaagttgattgctggctcctgtcaactaacagtgcaatatgctagcaggaacctagctggtacggagtaataatgttttcactcttgttattctgcatagcgattcgtgcctttttgaccatgggaattaaggttcgatctgcttttatttagaccaggtatcaacgtccgcacgttcaaggatcatcggttagaaatttctaaaattttggctttaccaaatgctcctcttgtatataaaaaagagccccacaatccatgtgagtttcaaaaaaatgtttgtatagagcgagataatttgtttaagccaattttttaattcatgatatgctcttgtattccgaggtcgtgagccatgatcctaggtagagatcgagatagaggggatgggatcaccgcgatgcaaaattaactcaaatattgttgttaaggatctattttgtaaattccaacttctaaatttagttttaggtgttatatatagagtggagctgtggagtattttttttaaacgaaagtcagtgcgagttttatatgttaatatagctggagaaaaatataaatctatggttctgaagggaaaaaaataaaacaaaactcagcaccacctatctagttcatttaatgaaaatgctacacccaatttcgctcctatttcagacgatgaagaaactgtttagttgcatttcagctcgatcagctaaacagatcctaattactcctgcacacaacgcgcacgtcatgattggcactagtacacgcaatttgtagagcttgatcatcatcagggagggggactgaagtggcaagtgtcctcgagattcgagaaggcatggattgaatggaactctcgccacgtggcatctcagttcgttgcacccccatcctttctcaccgtacccaaccacttgcccccaatcttgcctctcacgtactgacactgttgcgcacacgcacgcacgcacgcacagcgcacaccgggtccttcgcgcgcgcctcgccgcgccatgccgcgcgcgttgatctatataaccccgcgccatgcaacgccgccccggcttaggcaaaacagcgcgcaccttagctcgcgacgcgcgccaacctcgccgccgaagcacgacacgaggacaagctagcccggcgcggtgtgccattggcatgggggtgacggccggcgccggggaggccgtcaagccgtcgtcgtcgtcgtcgttgtcgccggtggcggggctgagggcggcggccatcgtgaagctgaacgcggcgttcctcgccttcttcttcctggcgtacatggcgctcctcctccaccccaagtactcctacctcctggaccgcggcgccgcctcctccctcgtccgttgcaccgccttccgcgacgcctgcaccccggcgacgacgaccaccgcccagctctctcggaaggtaaggtgagtcccccattcgtgcgtgcgaccgacgtccgtcaaaaagctaagcttcgatttccgacccaccatgtgttcgagagattgcttacgaggaattggctacacctgtgttttgcagctgggaggcgtggcggcgaacaagccggtgccggcggcgccgaagaggatcgtgaacgccgggagggcgccggcgatgttcgacgagctccgtgggcgcctgcggatgggcctggtgaacatcggccgcgacgagctgctggcgctcggcgtggagggctaccccgtcggcgtcgacttcgagcgcgtctccgacatgttccggtggtcggacctcttcccggagtggatcgacgaggaggaggacgacgagggcccgtcctgcccggagctccccatgccggacttctcccggtacggcgacgtcgacgtggtggtggcgtcgctgccgtgcaaccgttcggacgccgcgtggaaccgcgacgtgttcaggctgcaggtgcacctcgtgacggcgcacatggcggcgcgcaaggggctgcggcacgacgccggcggcggcggcggcggcgggcgggtgcgcgtggtggtgcgcaacgagtgcgagcccatgatggacttgttccggtgcgacgaggcggtggggagggacggcgagtggtggatgtacatggtcgacgtcgagcggctggaggagaagctccggcttcctgtcggctcatgcaacctcgccctacctctgtggggacccggaggtaagctaagcacaatactccatctctttcatattattagtcgtttgattttttttaagtttatttttaatacaaaataaacatattatcaaaatatatttaatgttgaatttagtgagactggtttagtgtcggtgtttctatcttttctataaatttaattaaaactaaagaagtttcactaagaaaaaaagtcaaacaacttataatatgaaacaaagggataataactatttagatgatattgttctttgagggatcaaaatgttttcttgtttttttttttttgctcgcaccctggttaattggttttcttctccgtgagatgcacgcgctcacgccatgcatgcatgttagtcaagcatgaaaacaaagtaggggaaatatgacaggtgataaaggggaaaaaagagaaaaattggtggcacatatgtggttcagcttctagaaactaaaagagagaatatatcatgatcacactgagacaggatacacatgtgagaaattttaaagaaatgcagaatagctaaagaagtttcagagatcaatagcttaggtttattttcagtctgttccgttagtatctgtggagaactggccactgaatgattaattattactccaaccatcaattaatggtttacagtaacctttagccaataggatatgcgaattataaaaaaggtagtaaacacctagtttaaaggggacatttttttccattacaagtttttatgcaaaacaaaaatctattgtggattttactactttttgtgtttgaaaaaaaaatacttcaatatgccaaggccatgcatgcacataagaacaaaaaaaaaacggatgcaggaaaatagaacattagcatcagactaaggaaaatagaacattagcatcagactaagacatgattcaattcagagaagtgttcccaactgctggttagacgcataacatgtcacctaatgaaaaccgatcagcatcaatacagcacacccacacaattaatcaagcaagcacagcataattaaccaatcagcttttgtcccataatcacttgtagggatgtatgcgcttggaatgtgaatatatgcatgatcagtgtgtgaggacgatttaacgagggtgtgtgtgggacaaagccacccaaagagcgtaggaatctggtcgggaaatgttgccaaaggccacgagctgataatggacaaggttctcatcatcaattcatcatcatcactcgactttctctttagcaaaacatacactaggatcgagtagtccccattattcctaccaaacctgaagaatctgatcccttgctagctatagcttgatcgatcgatcgatcgaggtgacgattcgttgattcaggttgaaactgaagcctccaatcaatcaacttgaattgtgtttagtcctgttcgatcgtcgacgctctattatattcataggagtactgacgatcgatccggttggtgcaacagtaaatctgttcctttttcgtaactgcatttgcaaccgttggtcttcagattatacggttcatcaggtgttgattaattgctctaggttgattagagtgtgtaccagcagaaactagctagctagcctatcgttgatcagcacagtggcatcccacctgagtggaagcttctactggtaatcatggatctatcactgtcagtgttatccacaagctagctagcgagagctaattaagctaaaacctgtccttgcaagagcagatagatctagccatctagggcctaggtctactgcctaaaccaatcgatcaacacacattattcacagttgataaaaaaaatatactagcactaaatattaattacttaagggattgatctgatgataagtactcctagcacactactcaattgctcataggatgccacacgcacagtacggtttgtacatgttaatagatcaggatgcacatggagatcgatggatgagcattgacagattaatcaagaaaagattaattaattagaagaggatgacgaccactcatagattaattagaagaagatgataaatgggcagagactggggcctctttcacctaacttgtgataggcatgcagctaagctggttggaagcctttcacctccaaccgtccgatcagtcgaacactatgatggcaacaaatgcatactacatcgatcggtcgacagggctgattaaactagattcggttggtggccagccggccggacagctgcgtgtagctaaatggatactactctagatggatagatagagatagcttgtgcatgaaccaattaatacttgcattgcatgctactacattcgtctccatggcggatgaccagatatctataccaaccgtacgcaatatcgtcgcaaattaagtttattgcttgatcttaccttgtgcaattcgatttgattctttggtggttttgacttgtctgacacttctagtttgttttaagctaagattatacagtatattcatactattcagttggaatagttctttttttttagcttagttggaatagttcaagaagtgcatgaatgatgcatgtgccacgcactacggatcgagtacatatactatatagttaagaaatagatttattgatctgctaaaagattaggaaaaattcttcgtcgtacgcactagtttttgagttcagatcaccttggacttttttctttttttttagaactgatcaccttggacttggagtaaatttgttttcatggataggtaaattgtcagatcaggcacagtgcagtttcgcaagaatctagcacgtgttcttctctggcgtaagctgcagtcaactaatcaagcaattaattaatgaattaacgcaggtatccaggaagtgttcaacgtgtcggagctgacggcggcggcggcaacggcggggcggccgcggcgggaggcgtacgcgacggtgctccactcgtcggacacgtacctgtgcggcgcgatcgtgctggcgcagagcatccggcgcgccgggtcgacgcgcgacctcgtcctcctccacgaccacaccgtgtcgaagccggcgctggcggcgctggtcgccgccggctggaccccgcgcaagatcaagcgcatccgcaacccgcgcgcggagcgcggcacctacaacgagtacaactacagcaagttccggctgtggcagctcaccgactacgaccgcgtggtgttcgtcgacgccgacatcctcgtcctccgcgacctcgacgccctcttcggcttcccgcagctgacggcggtgggcaacgacggctcgctcttcaactccggggtgatggtgatcgagccgtcgcagtgcacgttccagtcgctgatcccgcagcggcggaccatccggtcctacaacggcggcgatcaggggttcctgaacgaggtgttcgtctggtggcaccggctgccgcggcgggtgaactacctcaagaacttctgggcgaacactacggcggagcgggcgctcaaggagcggctgttccgggcggatcccgcgaaggtgtggtcgatccactacctggggctgaagccgtggacgtgctaccgcgactacgacgcactggaacatcggcgaccagcgggtgtacgccagcgacgccgcgcacgcgcggtggtggcaggtgtacgacgacatggggaaggccatgcgctcgccgtgccgcctgtcggagcggaggaagatcgagatcgcctgggaccgacacctcgccgaggaggccggcttctccgaccaccactggaagatcaacatcaccgacccccgcaagtgggagtagattgcctcgccggcgatcgccgccgtcccgtccccgtacgacgtggcagcttgctagcttagctgggctgggctgggatgggctggctgcccgcatttagaattttgggcctccgttaattctctcttctttaacctctgttcatatatacacgcacagggactatagatttactaagccctcggtgaataattcaatcacaagtaaataattgagtaaaatgaagtcacctttttattgtcaaagttttactttggatcacacttaaaccaatcttttcattttagaccggataactttgcctatagtatttggcttggatcaccccactctctttactattcatgtatagatatgagcagcatataaaaggggaagttcaccattataccgaaaccgatttgattgaggttatttatgggtgtttgaagaagttaaggatgatccaaacttaaaaaaaattgataaaattttctgatcatccaaactaaaaaatatacaaaactatctgattctaaagtgaaaagattgatttgagggtggtccaaagtaaaacttaggcccaaatcacaatccactcgcaataatttgatccagtgatcacttgggcctcatttctctcatgggccgtgaaagaggtttcaaggcccatgacgcacacctaagattgaccagttcaactaacgtttgctaaatttaagcggaagccgttgaaaagccaaggaagcaaaaaccacccgtttgtggcgcgcggtgatccataaacagtagtggcctcccttcgtgagcccccttttctcgcgtcgtcccctttgcggagcctccccttcgtgggcgcgctccattgctctctcccctcccacccaatcctattatgacattacgatgcctatccccattgccttcctctttctcctccccctcctcctcgccgcctcctcccatgccaccgcctcttcccatgccaccgcctccgtcgtcccacaacctcgaggtaattcatggtactccctccattttatattataataaattttatcttttttattaaataatcaattttgttaaacttataaaagaatataaaaatattttctacaaaacaaacatatataatcatagtatatctaatgttgttgttgttgtatatgttgctaattgtttatgtaaacttgattatatctaactgatcagaaaaaaaagtttaagccactaattatatcacaaacacggagtaattgattcttgcatgcaagaaatgggacgtgtaatggtgggtgatcgaaatgttattatagggttctatataaactgtggatcggagaaggaggagcagatagggagcatcaagtggatacaggatgaggggttcatcgccgtcggcaacatgtccgccgtcgacaagccgaacatcctgccgctgctcgccaccgtgcgctacttccccgacgcgacggcgaggaagtactgctaccagctccccgtcgtcaaggggtcgcggtacctcgtccggacgacctacttctacggcgggttcgacggcggcgacgttccgccggtgttcgaccagatcgtcgacgggacgcggtggagcgccgtgaacaccaccgacaacttccggcggggcatgtcgacctacttcgagatggtggcggaggcgcaggggaagacgatgagcgtgtgcctggcgcgccgcgccgacacccggtccagccccttcatctccgcgctcgagctcgtcagcctcgacgactccatgtacaacaccaccgacttcgacaagtacgtcatgagcacggtggcgcgcagccggttcggcgccaagggcgagatcgtgaggtacgcgcgttccgccgctcgccgccgccacgacggcgcgttgttgtgtcctgattaacctgacatggctggaatttctagctatccagatgaccagtacaaccggtactgggcgccgttcacggacgcgaacccgacggtggagagccactcggcgatcacgccggaggagttctggaacgtgccgccggcgaaggcgctccgggccggcgtgacgacgagccgggggaagaagctgtcggtgcagtggccgccggtggagctgccggcggcgacctactacgtggcgctctacttccaggactcccgcacggcgagcccctacagctggcgcgtcttcgacgtcgccgtcaacggcaaggagttcttccgggagctcaacgcctcggccgccggcgtcatggtgtactccaccatgatgcctctctccggcaagatggagatcgtgctcacgcccaacgagacgtcgccggtcggcccgctgatcaacgccggcgagatctaccagattgtgccgctcggtggaaggacggccaccagagatggtatgcgcctccagatcagggtttgaaatttcgtttcaaaatttccgaaattcgcccccccccggcaatcttatatctcagtccgaaaatttacggttttttgcttttttttttgtgtgaatttggtcaaattttattaaaaatcagtcaaaatttcaaataatttcggccaaaaaaaatcgaactttctgaaatttcgccccccccccccctccaacccaacccccaaagaaaaagcaatttcgaaaataaaaaccctgctccagatcgatagacaggctgatctccaaatgtcaagcagtttctttctgcaaaatttgagcaaagcaaaattttaaaagttcatcattgtgctagctagattcagtatgtgagattaatttttgggtgatgagaaggtttaggatcttcgcttgtgcagtggttgcaatggaggaacttgccaggagcatcaagaacccgccgccggactgggccggcgatccttgcctgccgcggcagaattcgtggaccggggttatctgctccgagggatcacccgtgcgcgtcgtatcactgtaagtgttcagattgacatggtttggcacctatgaactcatatggtgttgacagtgaataagctaccgagatgttggttgttgctgtgatgatatgatccattttctgtatactacagggatctaaaaaatcatggtctttcaggatcgctccctgacagtattggaaatttgactgggatgaaaaatatgtaagattgacacgatcatatagagtgaatccgaatgatcaaatgggataagcacttgggtctaattttcctgttgaaattgtatgcagctatttcggtggcaacaaactcacaggctccatacctgatttgagcagcatgcacatcttggaagaattgtaagctcaatggataggcagtaggagattgattactactcatcctagctaggagactcatttccatcatactaacttttctgaatttggaaaggcattttgagggcaatcagttaagtggaccaatcagcccatcgctgggaacactcaccaatctcaaggagctgtaagtatcctaaccctctttttgttgcatgtccaaacagctgataactcttagtacttgcctcatgcatttgctcctgcgaaagacagatacctgaacaacaacaatctcaccggccagataccagagagcctgaaaaacaaacctgaacttgacatgaggtatgattggggaacaaagtcttcacattttggatccattttatatgctgatggtattgcttttgcataaaaaaaaaatatatatatatatatatacaggactgaggggaacaaacttaattgaggctggaaaggaaggaatatctgagatgatcatttccaatctaatgttacatttatgtacagaaagatacagtttgatgatgaagggagaagagcgaaggcttcagaaactgtaggatgatattcatgtatgatgctgtatgtgagttgaaagattgatgtgatatttagcatcatccttttgatccattttgtgttattagtatttgttgtacatgctgcattagatggcattagtgtaggataattgttaggtcaaagaagcagttcataatctaaccaatctaaacgccaaaagttgtaccatgttccatcaaaacttaattaggacagaaacatgcagtagccagacacataaacagcagatactccaaatctgtcagctaataaactcccgagtgtcgaattggcagtaattgtggacacaccaattacaaacaacataagagtggcaaattgttccttctcccaacatagatatgggctacatgatagatgctctgcaaactagcagagtaacagattaagtgcctaatggtaatactaacagatgaggcctaaacctacccaaaatgcaatttttcgtctgccgatgtgttagtagtgccgtctttgttgatgtcacttggttacctcatttccatcatcaacagtagctcggataatatgcacctggacaaaaatcaattttcaaggattattcacattattcatatataaaacatgcttaagttacaggtacaaatttattcagacatattgttcagttcagtaaaaattaataccttgaaggttgtaggcttgaccaactgaaatactgtcgcatctccatccaacaatccatggtccaaagcaaagccagcccagccaccacttaggccattcttgtaggcaaggtaattggtatcaaattgctcgtctttctcatccaacaaagtgacaatggcatcatgttttggcaggtaagtctcgcagaaatgcctcggtaagcccttttgatcatgccaccaaacaagtattagtaccacatgacaacagttccccttaaagaagggttgcagggatgggaatgtgatagtgcagtactcaccaaccaaaatcctcggaccacatgtgaatgtagcattggcttcacgaaggagggaaattcagggtcaagttgtgattccagttcctctgcttttcttgctgcctcgagcctagcttccatggaaattgatccacgggttgccaggtagatactgtcaattgcttttcgtggagacctgcagaagaaatcggacaacgggatgtagttttgcaccttttgctacttagtgggaggcaatacaagcttcatacgctcatgtggtaatgttattgttatcacataatgacataccttttcatcctctctgcgccatctggtgctacctgccgacaaatgctacttcttagtacagaaaagatgtttcttatgatggttacatacttacatatgtggatgctaggaacaatggcacaatttaaaatgccatttactgaaaattgttaagttctgctaagaatggtttgtttcagagacttatttaatgctcagtagttcctaccaaatttgcacatttttttatcaattcagttggtcagaaaacgtgaaatacagcttcttcactgtgcaataggccgtttttacagcttgcactagctggattgacagccacggctagaacgtatgaaaatcacgctcaataatttgtaaccttaaacttagaaccagatgcatcagaacaagaagcaggtgtatctgaacttcttttttttttctatgactgaatattactgaatctttttttctccttgacatttattactgtgtaaatggaacaccaaagcaaagcagttacctctgcatacttgacctcagggagattagcgaggcgccgagacctcctcggaggcgagggagccacgaccgccgcctcgatgatcctacgcctcttctgcttctgctccgccgaaaaaagaaataaaaccaaaaaaagaaagatcaaattaatgaacggatcgagcagcgagcgagcaagagcaaccgattagaatgtagagcgcggtggcagcatgagttggtcaccatgggggagggggtcttgggggccacnnntnttnntctntannggnnntcctnttttncccctccctttttcccctttttttttccctcttcttttcctcntccccctttctcctttctcttctctccctccctttcccctttttcccntttctcttc

SEQ ID NO: 3873 - DNA, 3913 bp, Oryza sativa
  unsure (1)..(3913): unsure at all n locations
acacaacacatttttaaggccgttaaatagggggatcaattatctttatattaaaagtgagaaagaggaacctcaggggggaaaacacaaaaaattacaaaaagcgtccttaatttaagaaaaaagtaccttttttataaaaagaggaatccatctttttaaaagttgaggggggttgnattttaaaaagggagaaggggtggtgatttaaaaaaagggaaagataataattaatattggaaattaaattagtggtaaatatatttgtaaaaaaatttttttagagaaaaaaagggggttttggngggtttttttnnnnnnntnnnnnnttttttnngnnnnnnnnnnnnnnnnnnntgnncnannncnannnngatttcccccccttcctcctcctcctcctcctcctcctctccctactcgatttgctgcggctttgcgaggctggagaagaagggtttaagcgagggagagagagagaagaggcagagaggaatggggttttgggtccttttcaacgtcgtggtcctcgtgggtcaagtaaagcagagggcaggcagagggaatcgaccgttggaacggggaggggtaaaacggtgaattcaggtcagtgggacgtgtgtccctgacaggtggggcccgcacattcatccgagatgtttcgtgcttcgtgcgatgcggagtacgtgtgcgcccgtattttcgggagaaaggaaagggcacgaaaagaatagctgggccggaaaagtagttagatttttttttatccgagttctgggccggcccagaaacttggtccacggggctaaatgtgatacgattttgctatatatttgtcgacaaattttctcctaaaaatttgacagatgtaattacagtacaatcgtagtgtaattacactgtaacttgcatgtaatcacactgtaactatagtgtaacttatatgtaactttcaaaaatctctttgtaatatgttatttcggtaaaatggaggttgtgggaacaaatccttacacatatgtttgtgctgtgatttttttttcttccttaccaaaacaaatcttgtaatagatttaacgattcaaaattacgtgaaacttatatacaagttacactgtagttacatgcaagttacaatgtaattacatataagttacagtgtaattacactacgattgtactataattacatctgtcaaatttttaggagaaaatttgtcgacaaatgtataggtggtcccatgtgatatatttggtccgatataaagtgtggtcgcgtacggtaacagtgagaagggaatttttctactacgtactacatccgtcccaaaataagtacagccgtagatatccgtgcccaacatttaaccgtccgtcttatttaaaaaatttgtgaaaaatttaaaaatatttaatcacacataaaatactattcatgttttatcatctagtaacaataaaatactaatcataaaatttttttaaataagacgaacggttaaacgttgaacgtgaataatgtaaaactacacttattttaggacggaggtagtaaaaagatgggtatgcaacttgagtacgtgcttgacataactgtgatgcagtccaagaacttgatcgcgaaggaccgagatcctctgagaagaccgtgactttgatccattatcagtcgtccgatctacagtatctggtgaatagtaaatcaaagcagtagtttttacttttttactgtgtctacagtaaaaaaactgcagagcaatgttttgcactgtaacaccagattcattttactatgtttatcttccgttcgcttccaaagtcagaggagccggatccgattggcgaatgctgccaacgatcctgacgttgttgacctgacctggcacgacaatgcaaatccagtacagctgctgtttcagatgattgacgacaagccgattgcctttcccttatctgaaaaaatttggtcagatcagatgagtcatgaaatggatggatgcatagaggtcggaactgttggatttgtctgacgctgaacgcgatcgatcgatcgatcgagtgatctctcgaaaatgatgccccgtacacgtaggacttgtttactttgctactattttcaacattaacaagttttggcattgccaaattttagtaaggttgtcaaaattttagcaaggctaccaaattttagcaatattttatacgtacttactaaaatttgacaacaaactaaatgtagccactttttttaactttgccaaaaaaaaagtaaagttgaaaatggtagcaaagtgaacgagcccgtaaattactcatacgtaatattgtcaacctaggccttgtttagttacaaacttttaacttttcaatcacatcaaaacttttctacacacgtaaactttcattttttccatcacattgtttcaatttcaaccaaacttccaattttgacgtgaaaacacacccctagaatggcgatgaggacgaagctgatgtggagtttgatggcgacggagccatcgccgtcaagcacgcaaacttatctagctgcgactcctgatgttcctggccgtgatcgagctcctgcgttcttgcttaatttgagtggtcggatcggctactgagctggtgcggcggcggcggctaatcggcggcatgaggatcgcggtgacgggcgcgacggggtacctcggcagccgcctgtgcggtgcgctggccgacgccggccacgccgtgcgcgcgttcgcgctccgctcggcgggcggcggcggcggcggcggcgacgtcaaggccggcctgctcccggcgtccgtcgagctggcgtacggcgacgtcgccgacgtggagtccctcgccgccgccttcgacaggtgcgacgccgtcttccacgtcgccgccgccgtcgaggcgtggctgcccgatccctccatcttcatcacggtacgtgtacaatcttttaaaaagaaaagaggattttaaaaaagaaactcgcgaaagttttcaagcaattccgaaaaatatatgctctataaaattgatttggtcatttggtgttaaaaaaatgggcatttaatcatatcctcggacgtgttatgattatcaggtcaatgtgggagggctcgagaatgttttgaaagctgccaggaggacaccaacagtaaagaaaatagtttatacgtcatcattctttgccattggcccaactgatggatatgttgcagatgagacacaggtaccatatttatattggagttctccttaattagctccctcagttttcaaatccttcggtctagaaaatctgccatttcttgtgtgagatgtccagactgagcatgctaaaaaaaattgtgcaaaatatgatgatatgtatacttcaaattcctttcgtgaaagaaaaacatttttgcagagtaaacaataagttgctgatattgcagatgcatcaaggaaaaacattttgcacggagtatgagaaatcaaaggttcttgcagaccagatcgcattgcaggcagcagcagaggggatgccaatcaccatcgtctatccaggattcatgtatggtcctggaaaacttacagcaggaaatcttgtttctcgcatcgtaagacaatttctctactcctagttattcatcctgcatatatggtatatctgaatgacccaaaaaaaaagaacttgttcctgaaataattaacagccatgaatcatgatcagaaacttgaacatcactggctcttaatttgcagttgatcgagaggttcaatgggcgtttacctggttacgtcgggcatggccatgatcgagaatcattctgccatgtcgacgatgttgttgctggacatgtagnnnnnnnnnnnnnnnnnnnnnnnnnnnnnnnnnnnnngnaggttagncattcttattgacagc

SEQ ID NO: 3874 - DNA, 1293 bp, Oryza sativa
  unsure (1)..(1293): unsure at all n locations
naaaaaggtgaaaaaaccttcttaacgaagaagacacgcggtggttaagattttggaaagggctcaaggatcacaaacaaaaaggggccaaattccacgacccctgtggttgttgaaatttagggtggattcaggttcttttcaaaaaatcccggaaagttccgttaataagtacctggaagtttctttgggctcttttatttccagacttacttaggttcaaagttggtttttcaagggtcaagttaatttcaaagtttgcacattggtaatgataataatgaattaatgtggtaccttagattcaagttctggtttgggttttgcaggcagtgggtgttcttaggcatcaatgggcatactcatgtgagaaggccaagaaggagctagggtacagtcctaggagcttgactgaaggtctatcagagacgctcttatggctcaaggacagcgaaatgatcagattttagtgttctacatttcactcatgtaaacatatcagcattgctgtaactgcataaatagttaaatcaaagaaaacatgtggtttgaaatttgaagatgaatgcgtgcaccaaacagggccaaatttcttcttagatggtcaaatttgttcctgctgatcactgatcagacttgagactcgagaggcaaaagcagatcatatttgggcccggcccacaagtgacttgggcccgcttgcttgtgggttgactaggggtactactggacaggctggtggctggcctcgccggaaggcttggaagcccgcgttgactagtggcggttggattggcggcggcggcggcgactcgacgatgggcggcggcatgagggtggtggtgacgggcgcgacggggtacctcggcggccgcctgtgcgcggcgctggcggccgccggccacgccgtgcgcgcgttcgcccgccgctccagcgacgccttcgggctcccggcatccgtcgagctggcctacggggacgtcaccgacgaggggtccctcgccaccgccttcgacgggtgcgacgcggtctttcacgtcgccgccgccgtcgagccgtggctccccgacccctcggttttcaccaccgtacgcgtgctgattcatttctgatgttttcctgtggcaagtagagggtaactatattcattcaaatcaaagtggggagtactatagaacgcttgatgaacctagacattctggctattgtgcgatgctgtttagggtctttgaaaattatggctccaagtccaacaataattgaatttccgttgctggtctgttcatgaaacta

SEQ ID NO: 3875 - DNA, 9116 bp, Oryza sativa
  unsure (1)..(9116): unsure at all n locations
ntaaccccttcccaaagtattttatttacccctgactttttttatttgtaccactggaaaattctttttgaaacggctttttagtaacaattatccaatttatgcatgtcctgttaaaatggagtacccctttcatcaagttatcctgtaattacaaaaaggccttttacaaattaaagtaattctataagctataaacagagttcaattgttctaaatttcagagacatcaagagaaaacattttgctcagagtacgagaaatccaaggttcttgcagacccaattgcattgcaggcaacagcaaaaggggtgccaatcaccattctctaccctggagttatctacgggcctggaaaactaactactggaaatattgtttcccgtattgtgagagaatttcttactcatggctatgtcaaatatgtagttatttattatcggatatttgtttcaattttaaaatataacatttcctgaaagatagccatgaccagaagaaattaaactgttgtgattcttgcagttaattgaacggtttaattggcgcctacctggttacataggagatgggtatgatagggaatcgttttgccatgttgacgacgttgttaatgggcacatagcagcaatggagaagggcagaccgggggaaagatatctccttactggagaaaacttatcattcaaacagattttcgatatggctgctaacattacaaatacgaaggcacccctattccatgtacctctctggttgattgaaatatatgggtggatttcagtttttatttctcacatcactggaaatctcccacttatcagttaccctgtatgtccagtattcttccttatttaagtttaccatctccagataggtcatgctgttgtgcttactagattctcaatgtggattgcagacagtacgtgttcttagacatcaatgggcatattcatgtgataaagccaagagggagctgggctacagtccaagaaacttaactgaaggtctatcagagatgctcttatggctcaaggatgaaaaattgatcaagttttagcactcaccccttgtgctaacttgtgctgcattccacaccatgtaaactgagatctgatttaaacctattaactgtaagatgtacatgtttggtgtggtgttaatgttgtatcatatcagtaataacttgagatgtaacatggtagtactggttccatggaagaaaggaaaaacatgttcttcgattgaatattggttgatttgattctttacaggctgcagttgcataagtagttacagtaaaaaccacgcaatttcaaatttgagaacacgtttaaatggaattttatcgctacctaatgctgggaaggtatatgcagaaatccttacactcgcattgcaatttcaaaacaatacagaatgttttgaaattgcgagatgccgaacacagctcacgatcaaaatgttgagcagaagaaaatcagaacatgtagcacaacaattcatgacacaagcagctatttgataaactgaaatggtgaataatccatatacaactacagattggaatacacaactgagctgtttccatggtgatcactgaccgctcgatcaattaaaaaaaaattccaaacccagctggtcaggtcaattcctgaagcaatttctccagcgcatcagaaacaagaggaatgtggaggcaatcttggccatcagagtgctttctgatcttcaccagatcatggtctttaaactccgtcaggtgggagttcagcgtcacttgactgcttacaagaaaacgctcacggcatttggtatacaagctactgaaatgcatacctggcaaacaatgtagcaaggtttagtttgtaaacaacaggaagtcataagaaaataagtctgcaacaaacttgccttcctccttctcgtgtgccaactgatattcagcaagaactctgaagacactttgcgcatttggtgtcaggctttgcagaacaacgagggcggttttcatggtttgggcatgaccgccgctggcaagaatcaaggggtagaacacaccttcaactttgtaaggtgcaaacgttgggacgtgataccagctccacttgaactgtgtgtgcaccatcttcttgtcccatactacagttatttgacaggttaggaatcttaaacagtgaaggcattacaggaggttaaagctagccaggaacttacacaaaggtgcattaacatgatctactgatgcgacaacatggacttgcgggcagcacgaaacttgagctaggtactgctgtgattcagcgtcacgcaaggcaggtccgtcgatgttgtgaataagaaggcatacattgtcatccccattgtcagatgtctggttatttagaaaggagataatatcatctattgattgggatgcaaatggctgcaactgggaccttgttgctgtctggcgttttctcttaagttttgtttgttcccaaaatatttcagctattgtcactatgacctgaaatggcaacaaggcagaaaatttggcagaattaagagctttgatgtagaaatcaatagtcctccacaatataacaagaacttcctgattaatgatagtaaggaattacatgcacatgaatttacttgaggtgccgaatttgacaatattggaatggttgaacaaatagaaggtacagatgtttcaatatgttaagttacaggtgtttgggatcatgatcctaataggcaaacaaggatctccatatgactgcaagcaacaccaagataaaggaattgcgcgcagttttcatgaatcatctatttcagcttcacaactagtcaactattagagagcaatgtttgaagccactttgagcatgaatcagtggaaattaagattgcacaatcaactttggataccaaattgatgcctttggtccttatagtatttcatttgtcctaaaccttaaccccttaaggactgtaggctcaatgcttttttttcccttttcaacaacaatgcgataaagtaatccatactgcaggcaacaaaggtcaatatcggtcaggaggaggtcatacttgcttcaagttgatggaagggagatagccattaaccacaatgacggtgaaatcggtcaaggtcgtggacgcaaaatcctcaagcaacatcttcttagatccaaatccatacatcaggagcccaaatccgcacctgcagaagaacatcacatcgatcttttggcttcatccacatcaacatcaacactgggaggattttgggtagcagacgaacctgagctcgaacagccagttgcggtactgctccttgtagcttctcgtcagagcctccacctctctctcgtgcttcggggggatctcagcgagggatgctcgcagcacctgcaccaaatctcgaatcagggcattcgccatggcctcgggaacacgaatcggagggtttccaggaggggcgggttatgcagacctgctcgtcgacgaggttgaggtcggagagcttgccggcggcgcgggcgcgcttcttgccagaggagggctccttctccttggccagaaagtagctcctggaaaagccggcctcctcgtcgtcatcctcggacccagagcttaccccagcagccgccgccgcgtggccgcctctcagtgccatcggggttcgcttccgccgccgccgccgccgcgaggatggaggacgagaaaggggaaggacgcactcgtgcacagcctgccggtatataactgtaaatggttcaatacaagtagaaaataacaaataagtagaaaataacaaatagtaaacgatacggtatataactgtaaatggttcaatacaagtagaaaataacaaataagattgaatcttacctaaatgacaatgtaaattgttcaaaaggtcttagataaatccacgggtgggattggtacatcacaagatgcaactcctttttgcttcatgcttttgaataagtaacgcaatgcttgacttctccatgcctcaatctccaaccatcataccatgcaaaaatgtcatatgaggttcattgttgcacacaattttgtggtaatttatacaaatcaatatctccttaattggctaatcacagatattattgaagaaattgatttattactaagtactggtctagtagaactctatagaagggggagagggacggccggactgagggagagccagagaggtagttcactagcgctcaccggagtccggagtccggagggggagggccgctggggccggcgcagagggcgggaggccggagtgccggacgcggcggggcggcgtcgggcgagaccacgggaggccgcgcgaggcggggccgcgggaaggcggcgccaaggcgggcaggcccaggccggggggcagccgcgcggggtgtcctccggcgtgcggcgtcggaccgtcggtggctcggtgcgtgcgggagtgccccgtgtgggcggtgcggcgtgggcctgggagaatagccagctagggttttttttttttttgttgcctgttgggccaagcttttttgataggccaagaaaactgaatacctgctcttctctgggtctctgggtcaaattctagggtagtcttaggccgagtacctcttggggctcttggggcgcgtagggtaggtggtttatgcggtttatcggggaaaaccggttttcccgcgcttttgctacctcttttcgtggcaaatggctcgatcatggtcgggcccatccagcagtttcagttgggcattgtcaattttgttagcctcgaggatcaatttttcgtgaagcgcctacaaatcgggcatccgatttgtttgtcaaaaatcgggtgttgtttcactaatgaggaaaaaaatgtttcaccaagtagattgaaaatgtttcgatcttttaaaatgctgaaacacaatcaaattacaccatgaaacattttttttacaacgtatgaaacaatgatttcgaatatattaaaatatgaaacaaatccgagtacatcgagaataagaataaaacaccatcgaattgaaaatgtttcagtgctgaaaatggtgaaacagaatcaagtcacacaatgaaacattttactacaacgtatgaagcaacagtttcaaatgtattgaaacatgagacaaatccgagcacatcgagaaaaaaatggaacaccatcgaaaaccacattgcaacattttgatctaactgatgaaacatcatggtacatggactaaaacatcacaatattcaagaggaaaacctaaatctgcctcttcctccactttggtggttagcaaccacaaccgcatcgacgccgcaccgagctccaccgcacccgcatagccactgtcgttgacgtcgcacggagctcggctgcgcagagctccatcgccaacagtggcgggggcgctgccgtagcggctgcttgctcagggaggtggcggcgttcgacggtgtcgccgtcatggaggagaagcgtcgccgtcgcggaggaggagcgattggcagtagccactggctcggggaggtggcagcgtttggtgtcatcgccatcacagcgaagaaacggggaggagaagcatagctgtcgcagaggaggagcgattggcggcggccgtcggctcggggaaggaggcacggcgccgccgctatgcaacgtgtgggagagagatgagcgagataaaggagaaaaaatagggaggggaaaagtcacgggtgtggaaataggtggttgagagcccccgatattttttgctcacgttgggcgcccaagactgagcatatccaaccttttcacctcttggtattactccatcggcttgttagccgatcggctttctggtgatctacgtgtttatctatcttgtcagttgcaggatcaaactgattggcacgcctgtacctcatcaatattttagacctgcactggagctaaaatgatctcctaggccgttatgttcatcgacttagtcagcgccaacatagttctggcaccatcggccaagcgcggatttttcatcaacacactgccacccagatccccgcacgccccacgtggccacgcccgatgatgtcccctctcgctatgctgggctagcctggacaagtggacaggtggtgagctccgccgaatgcatcaaaatgatcactgatcattactgtcactttgccgcatgcaatgtagcctgcagtacttagtttgttcctgttaattaccatgcttagttacacgtgctatctttgaatcataggttcgccctagaatattcttgcacaaataatcgagtcgaatatgatgctttgttattcgtcttacaagtattagaagttatatgagcaacacatatagatatagatggccaaatgggccacctggcccgacacgccacgtcaaacggtcaggccgggccgggcctgcccacggcctccacctacggcctaataagagtcaggccgtgctagccagcctaaaggcatgacgtgctcatccttggaataattctattttacctccctcattttttggccgcgccttatattccctccctcctctttggcagtgccttatatatgactcaataagtctatattgtgcccctcatgtttcgtgccaggccggcccactatgccaaggcagcggcctagacatggcccaactgtcgggctgggctggtgtcacgcccagaaatttagcccaaatttccagactattttgtgtattaaatccctgtctaggaccagccagggtacacaaaacgacaagtaatatacagttccaaacgtaaataaagcgtaaaatacttacaaaagaggcacttagtcctcgcaccgaaacgaaagcagcagcagcggaaaaaggcgatcctagcggggcttcagctccactccacaggcaaaactcaactggggtctgagccttggtcttctaacttcgtctttagcttagaagcactacacttctgaatagggggaataatagcaaggctgagtacaaccaccgtactcagcaagccacaccaacgatgcagatgtgcaaggggatacaaggatggtttgtggctatttgcataaaggcggttgtaaaacattttattgagcaaaacagtaaaactgttgagtaattagagtaacattaaatctccactgatcaacgctacaccacgttgaacaggcccaaccaacccacctgaactacagcgtattgggtcgacttattaagtgtgagactaatcacggtgaatctggtcgaccgcccataaccgcgggcacggctattcgaatagctttactctgatcagaggtgtacaactgtacccacaagacacagccccacgacacatttccgtgcgccgacatgccaccacgacataccggaaagaggccgtgacaggacccttcgcataaccccctctaaccaagcacaccacacctcaggtttcaccccccgtccccagcgggcaacgggcagtcccctctcgtgcctaggtgaatccggaagcgacagaggccgtcgcagggcccgccccgctctatcacgcccacccttgcctggatgcgtcggctagaggaaagctacactacaagcccagccgttgcccacgctggcttgtggtaagtacgataagttcttccagggcatcccgcgaatcggtccttaactgccatgggtgcgaccagcaaaaccatgcacccacagcccaccattcagtcgcattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcatcaaagtaacacaagctaggcgatttattacccatggttgataaaggacagatatcaagtaaacatggcacaagcgagcagataggtaaaaccctgaccccatgtaattagcaaaacatgcatatttatttgtaaacggtaaaacatttataaattgggatcaatatgctcaaggggaatgtgtgacttgccttgcttcttcaaacaatcttccgaactcttatccttgcgaccgtgatcttctgaaacgacggattctacacgcaggcacgcaaaacgaggaaaaactctaataaaaaccaaggaaacagaacataaaaagtaaacaaacatgtagagctcaattttagatgaattttgcaatttgaatggcccaatttggagttcgaatgaattagatatgaattttagaagttttgagccactaaatgaatttctataattattaatgatttattgcgcatttattaaatattttcacaaaggaaaaggactgccgctgacgtcagcaagagagtgggccggcgccgacaggcggggcccgcatgtcagcgagacgaggtggcggtccaccgtggaccgggaccacaaggacggtccaccgccggtccacgggttggacggcccagatcggccaaggccgatcggacggctggggacggccgggcggcgcgcagacggccagtcaaccggcggcggcggcggtgcaacgcggcgctggcacgggaggcggctggcgaagaggaaaaggaggagggaggcggcccaccgagaggcgcggcgacggagggagcggccgcggagggaggcggcggcgctccacggggcgaagacgacggtggcgattcggcggtctccaacgaaggtggaggagcggccggggtacgggggagcgcggctaacgcagtaaaggcggtggtgtggcgcgaggtggcaaggaacagcggtaagaggcggccgaaggcggcaaacgcggcgatgtcctcggcttcgcggtggagatggtgttgctgcggtggaacgggaaaacgaagcagaggccggggtgctacgcgatgcggcgaagccgacggtggcggtggcgtggcttggtggtggctagggcggggtcgaagtagattgcattcacgcgttggnnnnnnngaaaagaaaataaatataattatattattaacgttaacaacgttgaaataagagngaaaagnaattaaccaataacactattacctacttccagcaa

SEQ ID NO: 3876 - DNA, 9508 bp, Oryza sativa
  unsure (1)..(9508): unsure at all n locations
ntgagctcgtgggaggtcaaaccggcgccgtttcttgcggggtaagtgggggaaaaggtgaagnacgtgaagggggtcgtgtccacgtggttagatgcgagctcgggtgcgggagggcgctggattttgcggcgacatgggcggaaatggcggctggggttggctggcgaaaggtaggagaaggagctgacaggtgggaccgtcggccggatggagagagaggagggaaaccgggggacataaagtagactttcgcaaggcgcgggccggccgaaagagaaaaagaaggcgcgcggcccgcgggagagaagggaaaggcttgggccaagcccaaaagggaaggaaggagaattaaatttgttttctttttatttaattgtttaaatgatctttgtgactttaaaattatttcttgagctccgaaaatttgcggaaaaatccggagagtattttagggcacaaagaatattacaaaatattctcagccaatgatttttaaaggaaattttaatttcctctataatttcacttgattaaattgatttaacttttaatataatttcttgaaatgcattattaattgatttttaatcccaaacgaaaatcggggcgttacagctgggccggcacgggctgacaccagtcggggcttgggccttttggccatctatacacatagaagattttggttactcgaattgatagtgaaacaagttttcagggtgtataaccgttttgacgggccagaaaatagatattatttagatatatgtttaaacattttcgtcaattttgatgactttcttattaggcatattgtgttaattttgatgattttcttattaaacatattgctagagagaaaaactttagggcaaatgatttggctcatgttaaaaaaaagagtgtcccggtgtttcaaaagtttggacgaaattgatgaagtttcagatgcagggtggtttgaccggcgcaccgaggcctgtttcactggagaagccgacggtctggtatgaggccccaaagttattagtctctctttgcataccacaattcaaagtatgcaatagaattttaatggacactataactaccaaatttactcaatatctatgcaacatagtgctgataacgcataacatgtgcacgagtatgtttgtcttgtgtatcatgatcctgataggcaaaccaattttgtataaggaagttttaattacccgatatagatacaacaataaacttgtcttgtaaatacacattgggtgcaacagagtgaggatagtaaaattcttatatcttatgcagtcaaatggagaaaataaatactaataatataaaattaataaattatggtatcaaaagataccacttaaatatatttcaaaatttaaaagttcatttacgatcatactattaaataatattaatacttctatctgtgttcttcccagcactccttttccactcgcatgctttccgaactactaaatgataaacgatgagttttttgaaaaaaaaatatatagaaaagttggtataaaaatcatactaatttattttttttaagtattttagctaatacttaattaattatacgttgatatgtcgtttcgtttgtgtgtaagagaaggggttctcaacccttcaaaataacataacctagatttgagttaataaaatcgatgtattttataaaagctcttttattagtttgcaagtgtcatgtttattgcaaagatataaaacaatattttgctagtttataaaagtttataatagagtgggtcttacatattataaaagtattctttatagtagtctttaggctctgctacctaacatatggatcatttataagaaataaacaatattattgtggatgtgtatgtagatacaggacttatttagtttattgctactattaagattaccatattttagcattgtcaaattttagcaaacacatttatcatattctaccaaaacttggtaattgttgtcgattgacaaacaaatctgctgaagggcaagttatcacttaactatgtgggatgtatattgatttattaaaaacaaaattggatgccctgatacaaaccacttgggttctatttatagttttaaagccccatgtttgcaactctatggtttttgtttactcgggaattgacctaatcgcccttatgacaaggacatttacatgggctaaaaaatgttttggcccaactagtgggtcacgggctctaaaggttcagtcctaggttgtttattggaccttcatgggtggtaggtctgtttagagcccaactggctaagtgatctcggcgtgcatttgaccggtcggtgatgtgttctgcttctgccatccatcatccatccatgatccacgatctgtctgacacgatttctacgtccctctatttcagcctgaccggtagccatgtacactttaacactataccgcaatgtaacatgagcatgactgccatgacataacaaatgtgccagtaaatcaacgaggggtgaagtttgcacttcctttgatgcatcatgtatattagtgtgtttatcatatcaccaggttagccatcagcattttcgacctttctaggtggttcctaactacatatatgcatgatgcataaacacaacatatactatgttagtttataaaagtttaagtgctatccatagcaataggagtgggtattaagtaccttatagcctacttatatattataaacgtagtctttaggctatgctacccaacatatggactactcacaatcataagaaataaacaatattattgtggatgtgtatgtagatatagggcttgtttagtttgttgctactatcaacattaccagattttgcattatcaaattttagcaacaacacatttatcatattgtaccaaaacttgtaagtgttatcgattgacaaacacatctgctaaagggcaagttgttacttaattatgtggaaatgtaaagtggaatgtatattgatttcttaaaaaaaatagatgccctgttacatactacttaggttctatttatagttgtaaaaccctatgtttgcaactctaggtttctccttactcgggaattgacttaatcgcccttatgacaaggatatttacaagggctacaataatcttttggcccaactagtgggtccatgggctcttaaggtccagtcctagattgattattgggccttcctgcgtggtaggtctgtttagagcccaattggctttgtcatgctgcttcacctcctgttagtgaagggtcttcgcttcgccgcttggtaggtggttcgccacttggtactcgccttcgccgcttgcaagtgcttcgcctcgtaactaagtggttgtttcggcacgttcggttgaaagtcctcatggtatgcctccaacaacaatgttgtcaatttgtcaaaattttggtattgactaatttggaaatattgattttggtagtaatgtgaccacccccaaagtgaacaaactcgtattcaccagtgtattgctggagaaataaaaaaaaggaaaaattgtacacttacatcgtttttgttgatgtcgaaaatgctcttgcacttagaagcccagtcaacaattaagagcaattcatgcgcatcagcgatgaacacaactaggtccgcacccgatggggcatccggtttatggccatgagtaatgaggtgttcgggaaggatgaatcgacgaaggagatagcttcgtctttgcggatgatcagtggctcaatcgattggaaaacaacactgctatacacacgaagaaactattacgaagtgcgtatgaaaagatccctacgtacgacacttcggggacacagaacgctaaaagcccatgaaaagtcacagccccatagcccactctatcaataagcagtctggattcttctagtacagggaaaaacagatcccctatctcagattgacagatttagtacccctcttactccttcagtgcttggcttgagcggagatgcagagagcaaggagagaatcaactcaatcaaacatatgagctacaagaatatcgattgcactagcagccgacgcggaggacgctcacctacggccacagcccacaatacgagcagtgagctataggtagctggttggcttcatgcacaggtacggatctacaaaactaaccacttatgctgcaaattaaggataacaattcgttgtgtaggagtcaatagtgcactgctattagcatgcagtaatttcctggtatgatttgaacacgatttactcatctggagtttggacagatgttgcctgtggtagtatggtagatcttctccagtatatatagatttgcagaaaataaaaatatacctcttattcttttggtttgcatcatatatgctacttcaggctgaattcttttaactaaattagaatccatacgtagtaccaaacttcaaagcttccatgcttctatgcacataaattcttctatgcttcttcagatttcgtagaatagaacagtagaagaggacatcaaaggcttcttttctacctgtaatatttccagctataagaacgaaatctaacatacacaataaacatcttttcttgtgaaattggtttactatgaaattaatgaaaccaacacgacgagttaattgaattgccgacaatgaaagggttcttaatgtgcatttttagtcctaaaatgcaatttcagtttatgaaggttgaagcatcaaggaatgtgcaatgcatttgatctacggcataagaaatactcaatctagatggcaaaacatagacagggacatacctggtcaggatgctcatcaagggatacttggagattgagtttttttttttttttttgttgaaccttacagatcgaattctgttacccaaagattgtgaaaagataaggagaggaggttagctttggagggaatcactggaaaatggcgggaccacgtcacgacgttctgcacatgggcctttattagttatgggcttaagtactaatgagaagattacaacatgtaggctaaagaagcagcccatggtggctgttcgaacatgttccgtaacaaaattattcgtacgcatagagttttccattggaaaacacctagaggtcttccagcttgctccacaaagtgatgggctagccggtctgggttcgaagctcacttgttctatttatttgatattaggtcattcactaatattagtttttttcatggcggcgacggcggcccaaccgttggcagagacaaccgcgctgagatctgtgcaggcggtgaccgcacgcgctgcgtcgtttttttagagagaggagcggagttgggaatggggaagaggactttggtgctttcgctctgggctccgcaacgatggtcgtttcttcagcctacggcccagataagttggccggagtaacggctaggagaagtgtcgagaagttgaattttggcaagaaattcagaaccttctgaacattgaaaataaactgcattccaaagacgagcacaacatatatcaacaccgaaacacatgcaacgatgacttcccagccaaacattgtattttcacagctaagtaatctcggcgtgcatttgaccggtcggtgatgtgttctgcttctgccatccatcatccatccatgatccacgatctttctgacacgatttctacgtccctcgatttcagcctgatcagtagccatgtacactttaacactataccgcaatgtaacatgagcatgactgccatgacataacaaatgtgccagtaaatcaacgaggggtaaagtttgcactttctttgatgcatcatgtatattagtgtgtttatcatatcaccaggttagccatcagcattttcgacctttctaggtggtgtctaactgcatatatgcatgatgcatacacacagcataaaacggagccattgcatgatactggtatcgatcaatatgctaaattgccaatatgccaaattgccaatatagagttacattaaatgaaccgcaaaagctgtgcagtataattgctcaattaatccttttttccaggatcattgatcaatttaattttatgtatggctatgtaacatgaaattaagaagcacgactttaggcgcgcttcgcggcgccctgccattcattaaagagttatgtaccccacagatgattataggatagcattgaatagtactcaaagaaaagcaaataatatgactatgcaagagctgctgagagcatctaaagcaaagcatacttctgaccagtttgagtaatattaagtacaaagatagtcatgcatggaagtcaatcgatagattttataatcactttatagtacatgtcggtaagaagtgtcaacattatcacttaaactatatatagaaaaaaagagtaaacaaaaaatgaactcccggctttggtttcttcctcttacccattaatttagaaatggaaaaactaatatcaaacaaaatagaaagatgagataataatttgtgcagcaagttctattgtcagtttgtttgttctatatttggaaccggcccattgggaggaagcctactcggtgcagcagcggtgggagaacatggcaaacacgcccgacattctgaagaagggacttatatccctcaccgtgttagttgtctgggagatctggaaagagaggaatcggaggatctttgaccataaagagatggcaacgagctccctgctaacgaaaatcaaagaggaggttagcctttgggctctggcaggggccaaacgtttacgtgagttcatcccgcaccctgtatagtgtatattttacgtgtaacaccttttctctctttacccttaggggttgtattttctcctgctttattcaatgaaaaggcactatcttgtgttgttttccgttcaaaaaaaagtttgtttattcttgtctttggtaactaagcggtgataccgctgtatttaaagaacatgcttaagagaaacttaagattagtggcaattctcacatttccaaatattgtgtataaaataatacatcttgaactgcaatgcagctgcttagcacattataacatgagaaagcagagccacaaggttgagaaacgctcctggaattttgacaaactttagcaccttctatggtagtagccaatccattttacatgaacagaacaaaaggagtcatcagatttgatattcccatttataatcagattgcacttatttctctctcaaaaaaaaaggattccactgtctattaacaaccatttcacactaccaattagagtagaaggcaaaccggaaaggaagataaatattagtaatttttatccttttttaacactgaaacacaactgtattatagatccaaatctggtaatatgctttttcattagtcaatgaggatgataattttaacagagctagcttgatacaaagacatgactcaggaaaagagtaagttgcatctcctaggcaaggtggtgggtgctcaacctcatggcacactaatggcacaacctcaaactgacctgaaatctaaagtggacatgaaccttcaaattttgcattgattcacttgggtgctacatagaggacaccaaaaaacttcaaagctctgtcctgaccagggtgctaccatgatagaaattagttggtgatgccagcatgttgtcggctagttctaaaatacatattgtgggcagttttctccacatatatttagtcaatctagcctcactggctcacagctccaaagtatattagtttgcccaccacagcttctgtggctcctagcagtcacttccttttatgtaattaacacataacagatgaagcttcagcgcataaaaactcagaaattttcttttcaaataagcatttagttgattcactttctgctgatatcatccgattactgtaccaaaatgtagaatgcctcatagcactggtgaatcctggtgtaatatggatgcaaaatcatatcattagagctagcaatttgagattatgtctgagatggtggcgagcaatcagaaccagggtaatatggatgaaaaatcctatcattagatgtagtaatttgagatagtgactgagatggttggcaagcaatcagaaccagggataccatggcaagtataactgacaaagacgttactcacatgagaaaatagagcgccatcgacctcaagcgcttgaggtgccgttgccaaaggcacggctgcgtatgatgtcttggggaaagtagagtgtgtgcacccagtatcagagctaggcgccgccacctcaaatctatgctttgctgcctcgctgcgctgggacagcagaacgacgacctcgctaagccaaaccgccggttccctccgaatcaagtgctagcaggccagttcaagcgatacgccgatacgctgtctcttgaacgacgacctcaccatcttccatcgcgccatcgccagcaacgaagggacaagagaacggtgggggtcgatggcagcgtgaggaatgaggatgtaaggggagaaagggagctggcgcgacctaggaaggaggaaggcggtcgcgatgggctagcgtttcccaaggggatgggaacagagagagagagagaggagaagggcggcggcgggctagggtttgctcaggctccttgcgaagctgcgatcagggttcactctatcggttgaggcatttgtatcgggggtcaccgaaatcccgaaatttcggtccaaaatttctgaaaatttgagcaaaatttagttgaatttgaacaaatattacccaaattcatgaaaaaattgaaaaattgaaaattttcggccaaaataatatcgtatctggggtgaccgaaaatttcggtctgaaatttccaacactggttgcgattggagagacagagaggagggtgtgggtgcggggaaatcgtgtgctgctgagctaacgatcccgacggtcagatatcaatcggatggccaagccagacgattaaagagagcgctccaaattcaccagccttccagcgcgggcggaccgacatgtggacccacatgaaagtatggcccagcgaacagagaaagaacggtaaattttttttgtgtaaaaatcccacgcgccatggcaaagccaccgtgcggggcgatgtggatagcttggggagcgagcacgtcgtgctgaaatccctccgaacgccctggtccgagcagatcgcccttacttttagggccccatcgtttcgctttttttctaataagccaaaacggcttattagaaaataaaaataaatttgtaggtaaaacttttatatatgtgttcttggtgacttaaaagtcaatactgaaatagaaactacgttgaaaatatctcaaaatcaatctcataattaagtttgaaaatttaaaatttagcttttttttctgnnnnnnnnnnnnnnnnnnnnnnnnnnnnnnnnnnnnaatgatgttgcttcatcctgacgtg

SEQ ID NO: 3877 - DNA, 1869 bp, Oryza sativa
  unsure (1)..(1869): unsure at all n locations
gactgtcaggtagaacaacctcattnnnnnnnnnnnnnnnnnnnnnnnnnnnnnnnnnnnnnncttcctggcactgcaggcccaccgcgcggcgcacgcgctctggtccgacaaccgcagggcgccggccctccttctccagagccgcgcctccgaggtgttcggcgtcgacatccaccccggggcgcgcattggcggcggcatccttgctcgaccacgccacgggcgtcgtcatcggcgagacggccgtcgtcggctacggcgtgtccatcctgcacgccgtgacgctgggcggcacggggaaggagtccggcgaccggcaccccaaggtcggggacggtgtgctgatcggcgccggggcgagcgtgctcggcaatgtgcacattggcgacggagcggagatcggagccggtgcaatcgtgctacgggacgtggcggacggaaccacggccaagccgatcatcggcaagaaggcggagccgcaacgagagcttcccggggtaaccatggagcagagatggtcggattgaatggtttgagtagcgtgcagtgtgaacgcgaactggttagtacaatagagtttccctccaaaagttattttctggtgatgactactcttgtaaacctatatacggagtactctctagagattagacaagtactcaattagcattgagccatttcaaatctttttttctttttttttctttttctaaggaataacgaaaaacgtttctgatcatctgttgcctccttgtaagtatagtaggagttcatcctctcatatgtgtttttttagagaaggatattttttacctggcctttatatccaaccggatatatgcagccattttaattaggaatttagcctattgaatagggaatttagtcttatcctcttgtatgttcttctgctgaagatcatagtatttttcttcttacaatgtgaagtacggatgctttcttaaatacttgagtagtacagattgatagtacataccgagtactacagtttctgattctgaccaagtataatggtttgacgaaaccctacgtgaaggtggtcaactagccagtagatgagtagtggataagtttattaacttgactagagcacaaagtatagtagcccaaacgaaaacatgaccactaaactgtgaacgagttgcataaatatagccgcagagaacacttccttcaagacttcgtccaaacaaatcggctaaatctacagcctttttcgtgtttacatcgcagacgcaaataattgacgatattggtatcctgcgaactgaaggacgtcaggatagatacaagtggatgcgaactgtggttacccgacgaaagggacttttgtgataagctaactcgatgaggctctctgtcagcaaagtcaactttgatatccagtaatctattgctggcggaaactgcccttgtgtccgtgttctccaatatgaagtcccaaggaatcgaatatcgagtgcttctaccatgattttccgtgcttaattttgatcatctgtcttaattaaaaaaattaaaaaaaagattaaaaacataagtcacaggtactattcatatttcatcatctcataataataaaaatactaattataaaatatttttaaataagatggacgactaaagttagatgaaaaactcattgttgcttaaaataagacagagggagtaagatattgcttgcgggaactgcccttgtatctgggctcaccaatataaagtcacaaggaatcaaatgcctccagataacggtacagtccactataaacttatatagctcatattagttaatactccgaccgcccctaaatataagggattttggttggatattatacaccctac

SEQ ID NO: 3878 - DNA, 16179 bp, Oryza sativa
  unsure (1)..(16179): unsure at all n locations
gtgtcaggatgaacaacctcagtcngcangccngcaggtcgactctagaggatccccagtaaaacgaatatagacaagtatgtgtcacatccaaccaaaatcccttatatttagggacggagggagtatgtatagtagatgagctataagggtatctttatttttcttctcttctttatattcctcatctatgtatttaatgtatttatcttgaagtgtgtgaatagctaacttttgcataaaaatcgaccgcttcattttttagattctctcttctttacataagtggtttataacctactaatagtattaatcttgttctaacatgtaaaatgtaacctctacacaatcttaaaaaaaatggaaagagaaagtaaaatatatagtgtgagagtgagttagttaaagaagattttggagtttgtgtgctaattaagcggtaacatattatacaagttgccttttattgatttagagcaggtttaataatgtcgtaaacttgctaaccgtaaaacatccacatcatctatagcacattagtatagattgctcatataacaatggtctttattactatcatttacggtaacaactgatatattttttaattgatacatgtcccactaattactgcattcttcactattgttccaagcatgaaccaatctccaccaggtttacttctctttcttcattgtacagtgtgctgcagctgggtgataattgtatcgtcggctcgcgttctctctctaccattttctcctccagcacagcagtggggctgacttggttacgctatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaattaccaatctagagcggttttatcctacgtggcatacgcgtggcagtccagtcagcattttttttaaaaaatggtggggtccacctgtcatgcctccacttcacctcttcctaatatctctctctctcttgcgcgcgggcgcaagtgcgcacggcggcgtggagccgcgaacgatggcggcgtacatgggcgggtggtgggcggcagccgcgaggcaaggaggtagcattgcccgcagtagggatggcgacggggagaacgggccgagcgcggccgtcgaggtggaggctgcggcggaggggggcagcgaggaggtggctcgatgatgaacctgaggagaaggacacctcctgcatgacgaccggcgatggaggcggtgagttcgggcggtcggtggtggaggcggaggcagagcgtgtcatttgcgccaactgcccgcatcgtccttccagatccgcgcggcctccgcccccgtccgctaatgtccggtctcggggaggatggaagggaggtggcgccatcgtgagatacaaccacggaggaggcggggacgacgtcaacgtgagaggcggagacagcagtgccgcgatgaaggtgggagagcggaggaggacgaggaggaaacgatagcgagagcgaggaggagacggcggcggtgacaaggagaaggggcaacgatggaatttcacggtcgcacggaggaagaattggactacggcgtcaaataaaaaaccgattcaggattgaactacaacgtcaaacaaaaaaataatatggagggagtaattgacaacagagaagacattactcacgtgagaaaatagagcgccattgacctcaagcgcttgaggtgccgttgccaaaggcacggttgcgtacgatgtcttggggaaagtggagtgcgtgcgcccagtatcagagcttggcgccaccacctcagatctatgcttcgctgcctcgctgcactggaacaacagaacgacaacctcgctaagccaaactgccggttccctccgaatcaagtgctagcaggccagttcaagcgatatgccgatacgttgtctcctgtctacagtctccacgcagcccctcaccatctttcatcgcgccaacgccagcaacgaagggacaagagaggaatgaggatggtcgatggcagcatgaggaatgaggatgcaaggggagaaagggagctagcgtgacctaggaaggaggaagacggttatgatgggctagcgtttcccaaggggatgggaagggagagagagaggagaagggcggcggtaggctagggtttgcccgagctccttgtgaagttgagattggagagagagagagaggagggtgtgggtgcggggatatcgtgtgctactgagctaacgatcccgacgatcggatatcaatcggatggccaagccaggcgattgaagagagcgctccaaattcaccagccttccagcgcgggcggaccgacatgtggacccacgagaaagtatggcccagcgaacagagaaagaacggtatttttttttgcgtaaaaatcccatgcgccatggcaaagccacgtcgtgctgaaatccctccgaacgccatggtgcaagcagatcgcccttacttttaattaccccgactagacattttgcgcgcgttgcgcgccctatcaagggtccaatgaacttttaccaataagaatattgtgagaataaaattaaagatctataatctctctgatagagacaaaaatcatgaatttctatggtaaatagagtgagcatcgtgttgtagttatgctaacaaatttttttcctaaaacacagagttggtatatctagacaaaattaacatgaacaccatataacagcttaaaccatcacgtaggctaaatataaatcacatagtgcatagcataattcatcaattcagcttgttttcttcacatcctattgaagagggtataagtcatttaataacatgtaagtacataatatacatcgatacttaggaagtgtaatatttctgcatgtcatagtcagacaatcatatcttaacaatccattttgaccaaaagtttaaccaccaaactgtccgcacagaagaagcatatgttagacaacaaagtaaaccatactggggttaaaaaatatagagtaaatttcataaaactacatatattttgcacattctatcacaaaactacagatttaagaacttatttcacaaaactacagatttagtgtctacgtttatcacaaaactacaggtactttgcacaatacatcacaaaactacagatttaagaacttgtttcacaaaactacagatttaatatcttcatttatcacaaaactacaagttcagtgtcttcattatcacaaaactacatgttttagcattgttaaaacctgtagttttgtgataatgaagacactaaacatgtagttttgtgataaaagaagacactaaatgtgtagttatgggataaacgaatacactaaatctatagttttatgaaacaagtttttaaatatgtagttttgtgatagattatacaaagtacctgtagttctgtagttttgtgataaaagtagacactaaatatgtagttttgtgaagcaagctcttaaatctgtagttttgtgataaattgtgcaaaatacctgtagttttgtgaaatttactcaaaaatatatctcacgaatttaagctagataacatttctcaagtacctgaagaccatgtgtacaataaatgatttattcatgtgcattagatatgctcagcagcagccagcaagctatacaaagaaaatatcacattgttcatacttctttgaatggcataactacgatatttgtaacagatagcagatgtttcactcactaaatcaacagtacatagaaaaaaaaaacatagctaactaactacttgaaacaactgtttccgaaggaaaactacaactaagcactgacatgatagctactaaacacaaaaggcaaaaactcaagttaaaatcatggaatacttatcacacatccataatgtattttttaatagtgccactgctaatttccttcctatttcattcgacctgagaactcaataaactaatgctgaaatagttaaccttccacaaatcaggcattcaaattcatgcaaaatggaaattgctcaagacaaatgatggaaactgctatgttattttacgaatatccagacaacgtgttgcagtgagacattaaaatgctatgcagattcagggttgccataattaacttcttctccctggtaagacctcgtcaagcaaaagccaatcaacatgagctgcatctgaattcaatcaacaatgttagaagcagttgtgttcgcctaatttttctgaagatcaatcttgttatctgttagagagtaacaatagacccccactaatttaagtagcagttaagaacaaaaataataaattcagagagaaatgacaactcccatctaactctgcttaccttgcagaagcacaatccaattattcattgaatcctaaacctacagcaggacactactattaatatgtagtttaaatcattagtactttgttcactggaaattatgcaaaatcatagatggattattgatatttattgaactaaaagcatgatacataacattcttgaacttgggtccacattcaacatgaattgctgtcacagaaaaaggagaaaaaacagagtatgcattctgatgtggctgccttgccttgccatctaatgtattctgatctggctaccttgcattgcgcctgacaccaatcaatggaaaccatgacactaagacagagagggccatttcttaccgacaagaaggaaccatatcggggattgcaatttctctgttcatctcgaattgcaacggaggagttgcaggtgaatatggcagcgactgtgccatttccgtggtccatccaagatctcatcgaacctagtatttgtgcttctacacctgccatccctaatcggcggaggagatagagctcagctgctcaagaggcattagcaacggtgaggaggcagccgacagggggacagacgccagcgatggtccactgatccggcgaagcggccgaccgctcgaggggacgtaatgtcggcgcggggcttgctggtggtgacggagctgagcgtggtgctcggcaccgtggtcacgctccttggacccgtcaacctttccttcaccagcgggcggcgctcaaccagacattggtgagccgctcgagttagaggcgggcctcttcgtcacgggcgacagcgccggtgcgaacatctctagcccttagccatctttgacgacccccttcaacattgggcttggttgggaacgtcttttctagatctggacaccatggcctcttccgatctgtttttctcaacttgcggcttcgaacggtgcatcgtcgtaacctccaacgncggcaccctggggaccacgccggcacttcatcttcgacttctngcggggatcgatcttctgacagaaggggatgtgcaggccggctgcaagagcggaagagaggcggctagggtttgggagggtggggtgaggggtgggcgccggccgccaggtggtagggttgttcgtttttacaaaaaaggccactcacttgttgttatttaaagtgcggcctatttttcgttttttttctcttcttagcataagatatttcaggtcttggagggccttaaagtaagaatacagaacacataaacgaagacaagggacttatcacagattatcaataatagcaagggctttttttgtaaaacgaccagagtcaacgcgggcctcccgctcgctcgtgaaattcggctgcctggagtttcggggccgacgtggatagcacgggaaacggccacgcctatgcaaaacgctatggaggcgccaatccagggcaggtttaaatttaaccgctgtctctaactctatcatattaaatatcacgatcaaggacaaggtcacaagggccatcaagattctaaaattttatacacgtatactagggcctatttgaaggaaatctacagcaattagttgcagtcttgtatttctagacaaactttatgtcaaaaatcatttcaagaccggaagcacaccagaaataaaactagtgatcattggatcagacacacagtttgccaactacaaacagctatcctcaccacaacaatcatggagattcactctaatgtagacatgtattgcagttcactgctgaaatgaattgagacaaaaatatcaatgtatcatgaagcactatattcccccatagaacatcatacccccccaaaaaataccatgtgcattcaatgagaacatacctggaaagctcaaagcaaggctagtgcaacaaccagctattccagcattaacaactgcaaatgaagaattcataattagtgctatatattcaactaccaagatgttacatctaaaaaactagcacgatgttaacagaaaatagggaactaaaacaatgcacatactgtcatctttgccacgcagccttctcaacaggcacacaactagacaatggacgccagagagaactgcaaaactttgatccgataaatttatgttatgagcaaggtgtctggatgattttcatgtacagaagaactgaattcacattatcaatagttaaccttggcagaggaccctgggtgctgaacaagcccttaaatcccctcttagtgaacaaaccttgtcctgaataaagaatccagtacagaacataaagattttacacgaggaaaataactagttgctacaaatggccttaactaattcacatgtctggtacttaacaagattaatagcatcttcattgacataaatatcaaaattcagatgaaggaaccaaagattcctcacaagatgtgctattatctacacattctagatttattacaaattcttacagccatactaggtgagtttgaggagaaggggattgagaagattgggaagatacgcaaaacgaggtgagccattaccgtatgattaattgagtattaactattttaaatttaaaaaatggattaatctgattttttaaagcaactttcctatagaaaatttttgcaaaaaacgcaccgtttagtagtttgggaagcgtgcgcgcggaaaacaaaacaaactatctctctttctccagctgccgaacacagcgtaagaataggttaggaatgaacttcctttgcatgacatggaaaggaacaaaatctaaaactagaaaaagttcgtgattacaacaacatagacaacatgggcagcaccggaaacacataaacactgaaacacaagggggcaacggagaaattgggataataccatatccaatggtagacaccaaatgaactgttggtagtggatgcatgagtgttgctgcactctgaagcacggtagacaaatcatgatgactaaaagcaactgcgcacattgaaagttttattagcatgcaatttgtttattacccagttagaagagatgcaaatagaaagattgcgttgttatctttttaaaatgaagcgtagagaaaaaaatcacagtaactaaagaatgctgggcattcataacccattctgtgcagttacaaaacagaaggtaggttattggtcatagtctctgccatcttcgtaggaagaaataccagtacgaacaaaaggtacattattgtgaagaacaaaaacaacagaggccacagaggtggtgcatcttttgtagctatacaattacttgaaggatggtgcaacaagaaatcaagcttacagaaaagggtaggtcttacttaggcctaacagtctagcagccaggtatttacttgctgtcactgtacaatatatggacatagcaaatagagcataattaggcataattactgaaacaggggataaaaacatttaaacataaaagggggaaaggtctatacatccatggtggcaaaacctgggaggtaattagaaattctcacacggtacaggggaagtattaggtggatttgtagtgcaattgataaagtaggcaacccggctgttcagggggtgaaatggattttttttttctgtgacagtctaaaactgacgctctgtatagattgttcatggtgtaaagtaataactattctctactaacgagcatgtccaaattgatgatgggttagaaataagaaatattacactgcccagcacaaacaataagctatcattgatgatgagttataatgcaggcaagaatagccaaaatatataccttcttacatagcttgaacacgactttgtccagaaggcttcactaactcctccctgtcaatcatcatcctaactctctttgcatcctcaaccattccggcctttgcatatatatttgacatagtcacaaaatttccagggttatctggctccaattgaaccagtttctcaaaagcgatctgtgcatgatccacatcatggtgcatcctacttccagataacaaagcaccccatacaactgcatttggtctgattggcatctgatcaataaatccagcagcctctctgaacctcccagctcgtgaaagcaaatccacaatacaagcacactgctccatagtagggatgagggcagaattttccacaaaccgctcaaaaagcgcaagaccttcatcaaccaagccacagtggcagcatgccatgagcagagttgtgaatgtcactgaatctggctgcatcccacaacgcaacattgcatccacaagttcaagtgccctctctccatgcccattctttgcgaaagcacctatcatcacattccatgacacaacatccttccgttcaatctcgaagaacacatgttctgcattgtcgacacatccaacacgtgaatacatgttcatcaacgcattccacagaattgcgtttgaaccactatcaccatggtttctcaccatgtgcccatggacctgtcttccagactccaaatcacaagcccccagcacagcaaccgcggtacgggcattccctcgaacacctcttgcgcgcatctcccggaagcaatcccacgcctcgccattcatcccggcaccagcgaaccccccaatcatcgcgttccaggacaccacgtcctcgccgtccatacgatcaaagatccttttggccgcgctcaccctcccacacatcgcatacagcgcgacgagcgccgggccggccgaggcgtagaaggccagcagtggcgcggtctttaccccgtaggcgtgcgcggcgcgagcggggagggaggcggatgcgcggcggcagcaggagacgacgcaggagaggagctcggcgtcggggcgggcgaccccggcggcggagaagagggagagggcctcccggggccggccgtggcgggagagcgcggaaaggatggcggtgtaggatccggtggaagggtgggggatgagggagaaggcgcggagcgcgcaggggaggaggccggaaagggagtaggcggagacgagggcgttggaggccgggagcgaggaggggaggacccccagcttgagagcggcggcgtgtagggtggagacggccggggcggcggccccgggggtggtggcggcgganacgagtaggcgagggagggagagagggtcgacgggaagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatcaatacatgaaaattcgtatacgtaggaatcacaaattgaaatcggttcctatcaaagaaaaaaaggaatcaacgattgaaattttcatattggtgtagttttgcattgtatcggatagcggggttgatgcgacaactgcacggaaatatattggttgtattatagtaatgttagtttcattttaaattaaaaaaatgttattgataattaagacttcaatcctaaccgatgaaatgggatgcaatatccttttctcgaatgcacgtgcacgtagtcgtaccaactctatcactataaacacattcaaaaatttaggttagaagtcaccgcaggtactacttaccacgaaaaaaataggctagaagatatacccgtctaataaaataatcactggccaccgcaaagcattgtttaccgagaaagacatgaccaatttattattgcgccatttcccaaaaactagtacagaaatcaccacacattaccatatgccgaattcatatcctctactcagcattatgccaaagttatgttgagtagaggagactcaaacattgtcagacatgttgcaccataagtaacctagctaattaattgatacttaattcattcgtagaaagtaatccatgatagacacaaagtaatctatgatagacacactacatgtaaagaacacgtaggccaaaatctcatatttctaattaacattttccccatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttaagtgattttgtgcatttgaaaccatggtgcccgggcaccatggtgccccatatgagtgtcctatatatatatatatatatatatatatatatatatatatatatatatatatattataacacggccgggaggaggaaatgaaaaaggagccatgatgagaggaatagacagattacttacatctatctaccctaaagttcaacaaatactttcactcattctttcattcatcactcaatggttcagattatccctgtgaaatccaatgctccagattcaccctccccacaaacgagcgctcccttcccaccccaaccgcgcccaaaccttaccatcacaccgccccgccacgattgacgtcgccgctgaccccagcttctcgtagaacgctaaaccctaacctcccctctctccccaccgctcgaggtcgcgccctcatcgctggtgctcgtcgcccggagcgagcgatgcggtcaccggagatgagcacaaccgctggggcaccacgctttctcgatcggaggccagcaggatggaggaggttgcgggagagacgccgacgccgtcacacgctgttgatccgattccttgctactagatcaggatgcagtcccttttttttcgtaatctgcatgtaatcctagggttggaggaaaggcactgtggagaggagaaagtggagacggggtgccggcgtgccgatgcagacgagtggccaagaataggtaaatagctctgttctattgctagctagcttttttttttacttactatgacaaattgatcgatctccctgttggatttttattaattctgattgaggaatgacgttttgttttgaacttttgtgccgtttgatttgcaagattactttgctagatttagcaattgtataatattcaaaacagaggctttcactatcactaattagagagcagaaacagaaagaatatagagtcagagttggtgtaccctgcaagtctgacgattggattgtacatgaactgcaatttgcatttcatgctactatggcattatgctcagtgaatcttgctgacttcctttattcaggcacaagtaatttgtgtcggatgatcaattctaagcagtgtctatgtgaataccgtttgaacaaggagctgtgtgggtttttaggattcaattctaatgaagccaaagaaaatatcttgaagatatttttcaggttattgttgtcttttgtgtccttcagagatggggattttgtactaatttagtcactatcttgatatacctgtgctgctgctacccataatactaaagtctgcctagataatgattttcaaactgcattgcatgaccagaaatattatcagttaggattagattgttctcaaggttttaatgattgtcacatggatagttctttctactactttcactatgtaggtgcatatctatgggagtaatatatgttccatgtgtgtctgcatcaactaaaatacctgatggatgtacatgttcattaggaaattagagctgcaacaaataaatttcatgatttttgttcccaccatcatagtaaatttcatgtgatatagaggaatagcaagctaacacacgttcttgagattctttaaacaatcaattatttacttgttggtaaatcatgcatctacagttagatttgtggtttccgtgattacattacatcacctgaagtaatcaacagatttgagcattttgtgtatgcaagtagttgaagaatttcaccatgttctgcatgatatgaagtatgaacattatgctagagttactgtagatcctggcatcacagtcccttaggtttggtaaattcaaatttaccatgttactaagacatgtacgataatttacaggaatatgaaattatttttagaccaaatatattacaacaatatatataccgttgtttggttttgagacatttgaacttattttgctaaaatatgtatcttttagcatatgattgtttaattcacattactaaatatcgccgtagcgttagtacgggcatattaccagttccaacaattggccatgttttttcaatggaattttcgttaaccaaatgaaggcatcaaattcctgtgtctggggtagacgtactaggacaacacgaacaggaaaatacgcacagaacatacttcctccatctcaaaatagataaatcaactcttgtacactagaattcattcatgtatatgtatatgtaaaattattttgcttgaccctagtatgaaggtgaaatatatttaattaaatccgatccagagcacaaaatgagaagtgtttttattcataaatttctatttaaaacacacgagagtcacataccctatcgagaaggctgtaccgtctggacctatgattaaccatctggagcgttgtgctgctgttcttattacaaccacgccgaacctcgacgccggtgaacaccgcgaatttctcgtcgaaatcaaagttggacctccaccctttgtacatgaatctgacaatgcagaacctgccggcgccgagagggacgaggtgcggcgtcaccggtgagccgctgggcgacacggggctcaccttccacacattgcgccgcggcggcgaggtcgaacgcgcacagctcgttgccgtcggaggagagcgcgaaccagagcttgtgctcgggcgcatactcggcgcggcctctgaacggaagcaaccagtcgccgagcttggtccatgtggcggtggacgtgtcaaaggagtaagtccccgcggcggcggcgacggtgctttgcactgtcatccaaatgcatgagccgccgacgcccgtgtaggcggtgaggaagtcatcatcatcttggaaaaagttgcggatgctatcaagggcatcatcggcggtaaaggcaaaggccggcaaagggaggaggcgccagtgccagtgcggcgtggcgaaggggtggtttgggtggcgatcgtggacgagaacctcgaagcaagagaagggggattggaagaaggccgggtacctttccatgacgtagatgttgcctccgatggtgagcgaccccggaaaggccttgggtgtgttcatcgggggaagaatggtgacggcgcgcaaggcggcaccgtacagcaccccgctgccgctgtagtcgacggcgaccacgtcgttcttttcgccgcctctgccgctgccgctgccgctgccgagaggcatgaaatccacggaggagggccaactcgaaagcccgtatgatgggcaagggtggaagatcatggcggcgcgaggcagctgagcgtcctcgacttccatagcgccgccgcgccgcccttcttcatcctcatcggcggcgagcggacggaacagcgtcgagacgtcgacgcggtgcaggccgtaggacggctgccgccgggcgatgccgtcgagcaccagattcacaaatcgccgggggctgttcattctcgccgccgccgccgccaccgccgccgagagatccgatcccccggatctaatctaaaacgggacgagaaagagcctggatgaaatcgtaaaaggacgaagggaaagtagtactactccccttgccttggtgacggcccaagagaaggccggagagggagtaggcggagacgagggcgttggaggccgggagcgagaagggaggacccccagctttaggccggcggcgtgtagggtgaaaacgaccgggcgggcggcgccgggggtggtggcggcggagacgagtaggcgagggagggagagagggtcgacggggagagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatccacacatgaaaattcgtatacgtagggatcacaaattgaaatcggttcctatcaaagaaaaaaaaggtgtagttttgcattgtatcggatagcggggttgatgcgacaactgcatggaaatatattggttatattacagtaatgttagtttcattttaaattaaaaaatgttattgataatcaagacttcaatcctaaccgatgaaatgggatgcaatattcttttctcgaatgcacatacacgtagtcgtaccaactctatcactataaacacattcaaaaatttaggttagaagtcaccgcagatacttcttaccacaaaacttacctcgaattaaggcacctttgaaaaatacctgtctaataaaataatcacaggtcaccacaagcattgtttacccagaaagacatgaccaatttaccatatgcgccatattaaaaaactagtctagaaatcaccacacgttaccatatgccaaattcatatcctctactcagcattatgccaaagttatattgagtagaggagactcaaacattgtcggacatgttgcactataagtagcctagctaattaatttatacttaattcatccgtataaagtaatttatgatagacacactacgtgtaaagaacacgtaggccaaaatcttatatttctaattaacatttttgcatatatatatatatatatatatattaaaatcaaatagctatatcaaccatgcgaactaatgagcaccctcccccccccccttccccgtaatggaacttcaaacaactgccagcaaactctccccagcttgatcattgagaacactcaaccgccatatatcaagcaaaccatatcatatatctagctcagaagatatttggtaatttaacactccttaatattggtttcgattatttgacatattagtccactttcattcatcttagatggttctacatgttatcctcaaaagtatcaattgaagcaacaggacaacgaaaaaagtgttaaattatcatttttttccaagtttggtaggtaaattgttctaaaaaaaatgtttgctaggtaaacattatgttttagagtacaacgcagagcagcatgcgactatgtcctcgctcacaacgtccattttgcaagtagaatcgcatcaatttgacagtgttgtaatttgaactcaagaggattaatttcaaaacaacgtgccaatctccacgtgctcccaacaatgacacacgggtttggaacgtttcccaaacttatcccatcaaagaaaggaatagaccgtaagacagcccatcct

SEQ ID NO: 3879 - DNA, 2900 bp, Oryza sativa
  unsure (1)..(2900): unsure at all n locations
gagagatgctcacgtcgtatgcctgcacgtcgactctagaggatcccccgcggccatcgtgtcggcggggggcggcgccgtcgtcgactggctgctcgagagcgtcgtgcggcgggccacgcaggcggaggccgcgcgggcgctcgcgcacctgctggccgatccctgggttgcgcctgctgtgctcggtcgaccacgagcggttccctgcctcctccaattcatcttctcttaccagccaaaacgcggcaagaaggtaatgtcctgtcaggtgctactcttgaattatttgctttgcttggctgccgtaattgtagctttaacagaataaattttgcaatcagtttaaattattcgagcatgccaatgtagctggctctaatctactaggtgattgttgttgtaaattctgtccaatctgcaagataaagagagaaaactctgaatgtttatattgaattgttagtttctttctttttagttgagaattaatgatttggtgtagcttgatttgttcttgtgttaggaatttcagtattgatatgctatgttataggaatcagatgttgagatgtgcatcagtacagcctgattataggtggaaaacaaaatttgcatcctcgtgtgctctgaggtttctggcatttttatgttttcatcccatgtctttgtgagcatggaacctttggcccttcaggttttcagattgcaaactcttaatatatgctattgatgttaagataaaagatctcatgggggaatgagttatgttatgcacctgcatgccagttatgcaataatgcagttatgtctaatggattatcaagaccttggagttggtaaatataatttattttccttgatggcttggtgatctcagctctcctataggcaatttctttttttgcttgctggcagtgctttttcttcagcttatctcttctttttttcccctatacatgtagtattatgtttcatgcgcatcttaatctagcaatgtaggtctattaaaccatttagattttccagttctggtttccttggactttaacacaatatgagttgtttgtacctaatatattgccctcctgttaatacagaactcggaatactcttcattcaatgtctcagaccattctaaaggaaggagcatgcttgttgctgcacttatggacatcatcacttccaactgcgataatgcggattattcatcatttcagcctttattgccttcagatgctgatacaagagatattgcggcagccatcgaagtcattgagcaaggggggatgcattttgatgaccatgatgataataacagtgatgatggtgacagtggattaaaaggaatagggattaaggtacttggtgggactactgtcttgggattctctagagaaataaactcattggaggtgggcaactcggatgatggtattgttggagcttcgaatagtagaatattgatgcaagaaactgctactgattctccactagtggagaagctaagttctgctgctgctccaggcctctgggatgatttgcagagggagcatgtagctgtaccttttgctacttgggctcttgctaattgggctattgcatctgatttaaaccgttctcgtattcaagaacttgacagtgatggacatactgtcacaactgcactgaaagcacctgaaagaactgtcaagtggcatggagccatggtggcgcgagcttttttggaaaaccaaagcttgactttgcttctttctgtccctaactggtgctcaagtcttcttttgccagcttctcgggctgctaagaatggtaacatggcattggctcaaatgtcactatcacctttcctattatccatgataaggtgtaatgagtcaaaatttgtgatcagacagaagggtcttcatcttcttcgtagtatcgcaaaaaagatagaaaatgagaatgctcagagcaggatgaaggaatcattagcagtggcactgagtttgctctatgctggtgaagttccgttgtcacttgaagaaactcaaagatggtccggcattcttcttcgttggctctttgataaatctgtttcagaaactacaaatctcacagctattaaaatcctttcatgcattcttgaagactatggaccagcttccgtaccaatttctcagggatggttggctctcgtgctttctgagattcttggagataacaagacacagaatttgaaaggaaccacccagcctcaaccagagagagtgaaggtaagaatcttgttattgtttttaataaatatatatttgaatgcgtgtgccgccaactgttcttagtagttaagttggttgataaatgagttttagataaataaacatgacgataatcagactgaaaatactagaacgtcaagaacttaagatcaccagtataatatagtatgtcacatgttcagatttatgacaagtattaaccatggaggaacaatgttctaaacattccatatataaaatttgctttgttatttggcgactctataaagtgcttcatgccagatgctgtttaggttttttttttttgggagctatcttcttgtctttcgaaacatttctatgaaatacacatgttttgatatttttattttaattgtgttatattgtttgaaacaaaatttgaatatttggttgctactagcctgctacttttcttgtgcagagtttcacattttctatcatctgccattttcagtttagtgctgctctttttggatgttacagtataacttattttgtgttataaagctttagcttaactcctgatagtactcctgatagtactaatttcacaatcttgttcttcctccttttttgtcctgaatcctgatacaaccttttttatggacagaaataacn

SEQ ID NO: 3880 - DNA, 6453 bp, Oryza sativa
ccagttcatattcgaagcatgctggccgcctggttaccattctctctcttctacccaattcaaagaaggaaattatttctgatgatgtatggtgcaagtggcttgaggaatgcgcaagtggacgagttccttgcaatgatttaaaattaaaaagttactgcaggttaactttgttaaatgtattctgttctgaggatccaaatacaggaagcacttctgatgaataccctgattcaaaaagtgagtataaaagaaaatgtcctcagtttggagatgctttgttcttgttaaatccagagttgcctcttgaggttcatttggacaacaatggtcatgaaatttcaagaaagaaatttaaggatgactgttgcactgaagaaggtggtgactctgaaactggagatgctccaagcaacagagccaaatatacaccccctttaatggatgtcgtgttcgtccatggtcttcgtggtgggccattcaactcatggcggatagctgatgacaagtcatcaaccaccaaagcaggtctggtggaaagtatagatgaagatgctggcaaagagggaacatgttggccaagagaatggctttcagcagattttcctcaagctcgttttttgacagtcaagtacaaggttagtttggtgctctgatgttctttatgtggggagggttatactggtctcttttaaaacttttgttattctggtaatattcgatgcttccctgctgatggaattattgttgcttttatatgtttggaggtcttactggtttcaaatgatttatgcagaccaatctgacacaatggaccggagccagcttgccacttcaggttagttttttctttttctttttcttgttccattgctgatctcgcgaaaacattccataattttgtgatactcagatctgatatgttctgtagttggataggagatgctcagagtttaactttaggcttatttgtttcttcttactgaaatttattcagttgaaataatatttgtatataggaggtgagctctatgctgttaaggaagttaattgctgctggcattggcagtcgtcctgttgtttttgtaactcataggtaatgatggtcgcttggttcatgatgtagtgctggaaattgttgaaaagtctgtgacagatgaaaaggcttacttattcccatttacatatatgcagcatgggaggactggtggttaagcagatgctgtatcaagcgaagctgaacaattatgacaagttcctgaacaatacgaatgggctagtatgtatttgtttgtcaattctttcaaacatctgtgagatctaaccatgttcatatcacaggttttctatagctgtccacattttggtagtaggctcgcagacatgccatggcgtatgggtttggtgtttcgtccagctccatcggtttgtccttcacaaaaaacttgcagcttatcttttttgttcaccccattctatatttatgacacttgcagcttatctttctttagattggcgagttaagaagcggatccccaagacttgttgagttaaatgattttgtgcggcaacgccatagtaaaggattgctcaatgttcttagttttagtgaggtaaaggaagatattgttattcaattacacattatgctttcattgttataatactaatatacctatgtcaactggcttcacaccttaatagactcaagtcacaccgatcgttgaaggttacggtggttgggcacttcggatggagatagtaccgattgaatctgcatacccaggatacggggaacttgttgtaagtaaccacgttataacgttcgcaccattgcgtagttaattgtgatctgctagccttgcactataacggacttgatagatcatgcatccacatctagtactctgcacagttttaacatgcttaatgatgtcaacaatatatgattatacatgttagagacacaaaacccaagctagtgtggtaaagacacaatgttgattttgtaggtatcccattgtatttttcttcttgtatgccccccaaatttcgcccatattatggggttgttcagattgatgacatttttaatcataccaatttttttgataaagttgctaaaaaaatgtctatatttagtttgttgctaaactttagtaaatacataagaaatcccgccaaaatttttggcaagttggctttggtaaggtttattttagctataatttgaaccacccttataattttcgtaaggtagtagcagtttatgcaacttgtaactggtggtttacttattattattaaaattttgcaggtcctggcgtccactgatcatataaattcgtgtaagccggtcaataagaacgacccgtcgtacgcagacaccttggcatttttggagaaaatattgaaatcgcgtctcaaagaatcagaatcctagttttttttttccttttaacttctcaaatatgggcggcctatggtatacaacacttcgggtggaaacgctggataggatttccttcggcattatgggggagattctgtttcttctgcatcagagattctcgtctgtttagttgatctgatctgacaatttgggcgggctgtgttttatgaagccttagcccaatcatacagtacacgaacgaattacatctacaaatagaggatagctgtaaatagttgcccctcttgtaagaagaaaaaaggaaatatatgtatgctctctgaatgacatgtattatttttctctcgaaattcataagcatgtaaccacacaccccgttgattatgaaattttgtgtcaatgctctatgattattagcaagcattaccattcaagcctgatgaatattttggtttgaaacccaatattgaaatgggctgttgagttcatgggcttacagtttgtagactgagtcaacttttagcccatttacttccaactaatgaacttggagtggaagaagaagaagcgacacgccgacacccatctcttcgtcttcctcgcctaaaaccctcgccttcctcctccgccgcttcccccctccacgccgacgagcaacggagcaagcgggcagcccacaccacacccaaggtgcccctccaaattctcccctaatcctctccataatttcccctaattgatacttgcgtcaagatttcgtcgtagatccccgtggcccgtgagggatttcaggatttgggcgaaatctgataatcgcgggccctcgattttgtctgtattcccccaggatggtggacgcgtggtggccgctgctcgccgcggcgatcccggcggtggtggccggtcaggccttccgcgtgaagcggcggcgggacgaggagcagcgcctcaaggcggcgcgcgggcgcgagaagagctccgacgaggtgttcgtctgcgagcgcgtgtgcacctccaagcggatgctcaagaaggtgggggccttctccaaggaccccatcccggagacctgcgtcaccgtttgcggcgtctccgagctcgacgcctgcgccgacgcatgcgcccggaccgtctgcgtcaaccagcaccaggtccccaactggaacgacgtctgcctcaagaggtgccagagcgagtgcctcaagctctcctccaccctcatgtagcatcccccactgtaagccatcgttgtttgtaccttgtttttggtacaaaccatcaagctcttcttgttcctaatgcaatccttattactacctaagaggagagcttcagacatccatagctatcgtttataaatcatgaggaatggaataggtgaatgactgcttcctgattgttttgtgcttcacatttgatcttcaacaaacaattgtgattgctaggtaccataccatgtcttttgtgaggcgtatccaaggttgagtttttcagctgggccgacgaataacaccagccaaatttatttagtatcagaggttgaatcaccccttttggatgaaatgcttatcgtgtttaatatgtgcttacctgagtgtgctgattctgatatgaaatcccgtctactatttatccgagtaggaaatgtaggacggctctattgcccatttacctccagaattgtagttttgtgcattagtattgggagtttcacaacttgctcaggtgatttatgttgcacagatgagttatctacagttcagaccaattgtgacagctaggttgtaggtatcatgtcttttgcggggggtatctgatgttgagtttatagcttggccggttttggccaaatttatcatgtatctaaggttcagttatcccatttggatgaaaattcttatcgtgtaggaattgtggttgcctctgcctgagggtgctaattctaatattaaatctcttctgctatctgtctgagaaggaaatgtaggatggctattacctattttacctccagatgtagtttggtgtactggtatcgggagcttcagaacttgccgaggtgatttatattgcacaattgcaatgattttcagagtttagagttgagagcattgcttgctggagtttctacctagtgctagcatgcgaagtagtgaaagatttgcagtttcttgctatgctcttattattagtcagacacaatgcttcctgcttcagttactttgctgtttacgagcttcagaagcttgttttctgctccagttagcttcttgttttaatgtttagtaacaactccctccgtctcaaatgtactaggtttgtttattttgagacggagggagtacaaccttccatggctgtcatttatctctaggaatgagccatggaatgacctatcctggttgtcatgttttgtccattccattaccctttgtgcatatgatcctcgagaaaattatcctaaggttaacagagaaggccttcctttatctgcattcagattacaagacagtgatggtctgaaatacatgtatcttttgcaaggcaacaatgccacatctttccggtcctccatttcccctaccgtctgctcagtgtgtgcacatgttgctatcagctccctgggtgtgaagctttaatcaccattgtgatgatccagtctgtagcctgaaactctgaatcaggcgtcagacaagcatcaggtagacgtcaaattctcctcttggattaggttaaccaagataataggatcaaaatcgtcactgttgatcggtgatcgcacacccaggccaccatggaaacgggcacctaacgcactgatcgtaaaactaagaggacatggagatgatcttgaacagaaaagacgcgcgacaactcccgctctagcttacgcatgcatatcgttctgtttcgtatagcatatggagtagctggttcagataataaaactatttagaaatccccctgaaaatgctccaaatgttcaaacacttcaaaacgcctctatactttaattctttgggtaatgcgtttgtcataagcaatgctgaacagtcataatcatccagcacaaaatacaagatattcgttttatatctcttacatactccactgtacataaacttgctgttctccccatcaagccatcaatcttatatatatttacagaacaaatttgcacattagactgtggctaatcacgcttaacatcaacacaagctcgagaaaacagcatcgtggaaagacaagtggctaatcacatcagtttgccacccgcacgccatagttttatactacttccatcccagaagactgcagttttgcattggttgtgttcaacatttaccatctgtcttatttgaaaaaacttttatgattagtatttttattgttattatatgataaaacatgaatattactttatgtgaaactatttttttaataagatgggcgatcaaacttgaacacgaaaaaccacgactacacttaaattggggcagaggtagtagagtttagagtgatctaatgcattatgcatcgttgtctagaggtgacacgggccgacatgatgcccatgtcctttctccaaggagtagatgatgcgctcgaacgcctcgacgtggtgctccgcacggccatgaacacgtcgacgccgcccttctccgcgcgcgacgggacgaacaccatcagcccctccacgggcaggtccggcggaaggaacgccgccgtcgagccggtgccgaggtccatctggtggaacctgaacccgagccagctatccacctttaggtccgggcacaacatcgtgcccgccgtccgccgcgtctacacaagatccccgtcgtcgccggcggccgccgccgtcgcgccgacgaagtcgacgaacgactggatgtactcgccgtcgacccttgccacggcgtcgcggatggcgcccacgacggcgccgtaggtggcgcggaggagctcgcgcgcccgcatcctcgggaacgcccagagcaccatgttgtcgaagaaatccatgggcaccggccggtttg

SEQ ID NO: 3881 - DNA, 20653 bp, Oryza sativa
  unsure (1)..(20653): unsure at all n locations
gccggcgcgtcaagaaaaggcgtcggcgcggtaaagccctccccctcgcgcaccgcggtcgcccacccggtgaagaaggcgctcatggagtgcccgtcggncggtgtggtggtgcaagatgctgccgacgacaaggccaccgcacctgtaccggacgagcttcacctgcagcagcgcggcgccgacgttgtcctccggcaacgcggggtagaggtcggcgacgtcggtggccatggcgcggccgctgttggcgagcacgtcgtctaggtcggcgccgtcgacggtggcctcgacgacgagcacgccctggtcgttcacgtggaggaagcggcggccgtggtggtcgacggcgaggcggccggcgaggtgagggtacgccgcgacggccctgaggaggccctccttgatcgcctcgttcgacggcgccggcgcccggtacgcgagcacgctgggtacgtacaggtcgaacgccgcccggtcgaacacggtgagctggacctccgcgccggcgagcgggtgcggcgtgccgtacaccggcgccagcatcgccgtgcttgtaatcttcatcttaattacacctcgtcacctcgtcttaattactttggagtggcatgcatacaaccgcttatatagagctccgaactatatgtagaacagtgtgtgatcaaccacccccagtacatttattttgggctatttatttgtacacgtcaagaccaaaacgagagtaggtatcaaccactccgcttataaaaatgactaaattcaaatcaatttgggaaataattccatgttctaaatggggaaagtattctaaactcttgagaagacaccaattcttgtttgcatgccactcaaatagttatgcaaaaatttgaaaaaaagatcaacatgatagtttaatatgtgcttgatcattacacaagcatgcaaaaataaaatttaacttcaacatgttgcaacgaaaaatacactaaaattcaaatcggtttaggaaataattccatgttccaaatgggtttagagaagaggagaacagaaaaaaaggaaaaagtacaccgaaggtccctcaacttctcatcgagttacaaaatcgtcccttaaccgcaaaaccagatatatcacatctttcaacttacaaaaccgttcactttacatccttttgtggttttgatcccggttttatctaacgtggcggatgagtcagcgtgagacccacgtgtcaggtaccacgtcatcactctttctctttcccctcttctatcccttccttctctctctaatttctccttcgtctgggcaaaccggcgggcggggcgaggtgggagaaaaggtcgggcggccggcgaccggcgacgggcgatgcggcagcggcggccgcggcggcggtggcgatgacgacgacgtgggaataggagggccgccccttatgccgccagcctccgtcgcctctccaccagctcccatggatgatgacggcggcctcctcgctctccccgttgcgctccccatcggctcctcatccttcgtgctccgtgaggacggcgtctcgcgcgccgctgacgaggctgccgccccgcgctgcttgccgctgctgttcgatctgaacctgccggcttcgtccccgtcggctgctgccgccgccgaagtcgacgagatggattggtgttgcgacacgctgctccacctctagcctgcacatcaccaaacaatggcagcaatcgccggcgaactctagcctacgacgacgacgacgacgaccaaccagcaagcaacaagaattggaaatttgttactgggttgctgcgctccaatccaaccatcaccattgttgctgctgctactgcgaagaagctctaccatctcctccatagacacggataattttctttttattttcgttttcctccatctctttttcaccactcaagatttcgtttccgccgcctctcttgtgcatctctgtatccaaaggggatgctgctgctttcagctgtaccaatagctagaaaatggtagagaagatgataaaatttggttcaaaatttgtaacgtaaatgttatcggaagacgacggggacgaggcgggcaggttcagatcgagtagcagcggcgagcagcgcggggcggcggcctcttcggcggcgcccgagacgccgtcctcgcagagcacggaggaagaagagccgacgggaggcgcaacggggagagcgaggagaccgccgtcgtcatccatggcagctggtggagtggcgaccgaagccggcggcgtgggggcggcccttctgctcccacgtcgtcgccgccgccgccacgtaggccgtcgaggtcagctcagccacgagagagagaacgaacagaggggcgggcgtcgattgctcacagtgtatcaaaagcgtgcgcgcgaaggatacggtgaggaggtcgacgagcgacgaccggaagtcgaacacccgcgcctgcacgacgatggcctccacgaatgacgcgtcccctgcgcgcgacgacggcctccacggtcgcgcccacaccctctcccctcctccatgcttttacgtcatcgtcagcgccaccggcagcagtagcctcttctccgccggaagcggtggtggtggtcaatcaccgaagcaagttagctagagtcgatcggctcggtatttgatttggcttcgattgcttcgccgcgtcgaggccgacggatgagggggacggccgccgcggccatccgcgcgacggcatccatcggcggagccgcccgtcgcatcggccctcctctctgccgcgctccttccccgccagccgccggccacgccggctctcctccccgccgcgtggaagacgccgccaccatccacgcccagggaaaaatgagagaggaagggagagaagagggaaagagagagcggtgacatggacactctgacacgtggggcctaggtgggtcccacgctgactcagctgccacatgagacgaaaccggggtcaaaaccacctaataccttgaggttttgtaagttgagggatgtgatatatctggttttgcggttgaagaatgattcggtaactcgataacaagttgaggaaccttcggtgtacttttcccaagaaaaaaaagaagatgaaggcccgattcaaatacggcccaatataagcagcccaatgttcaaactgggctgtacgatcagcgctcgtcggcccagatctaggcggagggggaacgtgcggggggcccacaggccgaagcagcgtcttctccacaagctcaggctcgcctcgccacgccatggccttgtcctcctcttcgcacctcctccccttctcccggcctcccgcgaccttcccacgagcacgccacgccggcggcggaagggcccgagccggcgccacgggaaggttcatagcgtgctcctcgccccctcctcccgacgtcgtggtcacccgcgagcgcgggaagaacgccaagctcatcgccgcgctggtttggttcccaaatcgacactcctgcattgttcacttgtacctaacgcatagtttttttttgggtggggggtgaggggaagcgtaggggattaggggattagcaatagagatggagaatacgcatcttccatttttgttttgtgataccctgtgagatcgtcgcgtattttagtgttgtgattttaggtggcctggccgactgtatagagggaaatttacgggctaattatactgtttaggacccgggaggctcactaattggtgcgagacttcagttaatgtactgatttccatctaggaaaaggttggcgtgtgctggatatgagatatttggtgctaactcgttgaacatggtgccgcgtgctaatggaactcaccattcatgtcttcaactggtcggagcttggagtttagagttagttgttttgcaatacagttcagttttatctgattacaaatgcaatgcaatgctatgttatggaaaccatttgtcattttgttagtatcagtctttcatgtaagaacatatcccttctttcatccatttcatatgatacaagttgggcatatgatctgcattgcctattttattccattagcttagagaagttttgtggatggtatgacttcctctctttttttttatgatcattgacctaataactttaatctactattagtttattatcttggatcacagtatatgagatctttacctttattctcagctgttgtttagcgtctcatgaatcacgatacatcattaatacggagtgtgaagtctgaatttttctgatcatatctagccatattctaactgctatacgtattcaactgggccatagatggttgttactccaatggatttgagaacattcctacattgtaatacttgtgaaaaggtccaattgacattagagtaatgcaattgttaccgcgtgccttgtcgaacagtgtgctaggttactagacttgattgatctctgaagggcccttggagggagtctaatgattttactcaatgttctgataaaattagagtctttgcctgttgattgtgtaatggaagtaatcttttgtgtgttgggtggtggggtcttcatccatcttaaaatgttgtaagcatgcagagtacatgttaaagtaatcatgaatgtgctgctgcagccacctattattttctcagaagaagattcaatttgtgttcaaaaataagcagtccttttgtatcatccagcttattgctatctagttttcacatcagttttctaattgaattttgtaggaaaaacataatgtacaaagtcttgagcttcctcttattaaacatgttgaagggccagatacaaataggctttctgctgtcctgcgcggtaagtagttcagtctttatttttctagtaatataactttatgtgtttctgtcttgcgttgtatatccattgctccacatatagtatattctcattacacttgctttgcaaaatcataataaaagtattccatagtttagtcacttaatattttgtattttcagatgaaaagtttgactggatcactataacatctcctgaggcagctgctgtgttccttgagggatggaagtaagattcaaacatatttcaattatcgtgcgcaattgctacagaaatataaattgtgcatcatttcacacttcattcgtcctaagttctgggctttgtggcataggtttgtgcactctgtgatttgcttgttgtctaacccaatatatgatatgttcttcaatcaatccattattctgtgatgcaccagaacaatccaaaaccaccatattaacacaagttacataacgacctatcagggctgctggaaatcctaaggtacgaatagcggttgttggagcaggtactgaaagagtttttgacgaagtaattcaatacaatgatggatcccttgaggttgcattttctccttctaaaggtatcttgcctcataggatgtaattttcattgcatgtcaactaattcgtatggtgctctcatatattgaagacttggaactgttttcagtcagtaaggtatttctttttcattttttttatttcatcagctatgggtaaatttttggcctcagagcttccaaggaccactgaaactacttgtaaagtgttatatcctgcatctgcaaaggctggccatgaaatccgtgagtcagatttggttttatccttctggttacatgcttgcacctgcatttccacaatgaccacatctgcatcatatcttcagctgttatgttaactaattatgcggattgcagagaatgggctatcaaatcgaggatttgaggtgacaagactgaacacatatacaactgtatgtttttcttttaaattaaattattacatttgccttattaattcttatttgcttactttatatgagtaatgtgaaattttggccccttgtcttgtgcactttggacctcgttctatttatctgcattcagacatcccttacctgatagtatcatattttagcttgatatggttgactgtgacatatgttaccgtagtagaggttttgtatttcaagaaacagtagtaattttcatggattacattttatcttttcaaagtttgtgtgcacgtgaatcttggatttttgttttgacctatgaaatggttgtatatacatgcaggtatctgtacaggatgtcgatccgctaatattaaagcctgctctttcagctccagttgttgcagtagcttctccttctgctctccggtaatatataatgtgtctatggctgcctcggaacaaatttaaaaccgtgttcatataataataatggtatgctagtactccctaattagatggttcaggtaaagtacgtatgtgggagagatcacaaattctgcattgaaacattttttttttggaatacgcaagagatttgtgtaccatttcattaacacggggctttgacaaggttggggctgatttctatttggacgtgtttctttatgatccataaaggggtataccgattcaaaggcacacaaacagctttatttgccatctcagttatttgcaaagctagattatttgcgaactgtctccctgggctgactttatgttacatattaccatcacaattttccttttccacagtgcttactttattcagttttggggttatcatgatgatgcagagcttggctaaatcttgcttcacaagttgacaactggggcaacgccattgcctgcataggcgagacgactgcctcagcagctaagaaatttggcctgaagagcatatattatcctaccaccccgggacttgacgggtaagcacacatcacgaaccttttgaataccattatccaattgtcaaggacacgtctgaatggtggacattcagaactggtatcaacacagcgtcacatcatatgttgtgaagcaaaattgactactgtatcatccatatgcacaattttcatattgtttttcacaggtgggttgaaagcatccttgaagcgctcagagcccatgggcaatcgaaagaggtcctctctcgtcctcgtggatactttccttgaatttctcagcttctttcgtcacacttttttctgtttctactgtaggccccagggtgttgaacttgaagacgggcaatttacttgtaccagatgctggaggttggtggacatttgtggcggctgcatattgaactctgtgcttccttgactaaccgatcacacactttttgttgtttttctaatataattgagaggagaaaccaagtcggcaactactgtagtagaactacttgtaaattgtgagctgtttattgtagctactgaacacggtgcggtatattaccagtgttgtaccaattgttgcttagtttataccagtttggcacaaaaaatgagccctcctccaaaaatatggaaatcaatgaatgcaagaggctcttgtactgggctttactaaaccgcaggtgtttctcaggtcagaaggcccaaagctgcactaggccattattaaggccctgtttagttcgcgaaaaaaaaaattttgggtgtcatatcggatgtttgactgaatgttggaaggggctttcggatacgaatgaaaaaactaatttcatagcttgcctggaaaccgcgagacgactcttttgagcttaattaagccatcattagcatatgcaggttactgtagcacttatggctaatcatggattaattaggctgaaaagattcatctcgcgatttccatgcaaagtgtgcaattattttttatttttatctatatttaatgctttatgcacgtgtcaaagatttagaaagtaaaccaggcctaatatcaatatatgtcttctcataaatgtgcatagatttatcagtcaacctgagccgtccttgtcctcactccgagagagcatgcaacgcttcgcagccgcatcataattgtggccttcttttttttttttttgacacggtcagtgccgtctactgcagaatctccagttaagttgccgcggtgatccgaatgaactgaaattgattgccacgacgacttggcaatgccacggaatctccgtcctcttcacctccaccaaacctcttaagagattccagcgtttgtgtccaccacgcaagaatcttcttcctctcggagacatgactgactgcccacggacaagtgcactaatgatcaatcaaattatgaaatgaatgaatgatactctccttcgattgcgttaatatctcgctaatctccgtggctgtcagcatcctaaacactgcaaaaacagaacgtaacaaaggtcgacatggacaatttcttttagtttcttttgttactcggttagcacttacgtacggttagtcgtccaccccctcctggacggaaacacgtccatgtccagctaacgtcgacgtctctattgcagatttgtaggtctaaccctcctgcttaactaaccaagcgccgtaacgaaaaccggcgagcttcttcctccaccgccgccggcctttgcaccggcggcgacgagccggagagagccagcgtctctcataaaaggagattaaaagttactacctccgttttaaattataagactttttaacattgctcacattcatataaatgttaataaatatctggattcattgacatatataaatgctagaaagttttataatataaaacggaggaagtactatataagacaacgatagtagcagctttaggttcgcgaatatttatatcaaaatctatggagaatttggcttctctagctatcctgttggatagattcgaggccgacttcacctcacaagagaaggaattaatcaactagacaggaattaattattaaagatggagttgtttaaccagcaacactgtgtcaactccctgtacaattaagtactaatcagtaatcacctgtactagttgttactgattacagtattactagctacgtggcacatactgtcactgagatgctgggagcctgacaaaaaaaacagagcaatcgctgaaaaaaaaacaatctccagtgcatcgtttttgtctgtaatatcctagtggtaacttggcaagagtgatcagtgagtgagtagattctccttatcgcctcgtagctcacggtggttggagcgttcagatcaacgtcaactgtctgtttctctgaatttgttggagtaaaccggagatatatatatcccctcctaaacctaaatgtggtcgttgcgaatgaaaggattattagcataggatgagttgttggagaaagactgcattggaatcaaaagccaaagtacagcagttgtgccctccatttcttcgcaatactgcagtgtaggacagaaacggagttcttttttttttctttttgaaagttcagtttcatcaagtgattacttaagtagtagtactagcatactgtatatattaggttttattgagtgggattaatttgatttgacagtgtgacagctaaaagtacgtatccctccgtcccaaaaaaaaaaatcaatcccaaaatacgtgtccagatttatagctagagtttacctttttttaatagagtagtactccctccatcccaaaatgtttgacgccgttgacttttttaaaaatgtttgatcgttcgtcttattaaaaaaacttaagtaattattaattctttttctatcatttgatttattgttaaatatacttttatgtatacatatagttttacacatttcacaaaagtttttgaataaaacgaacggtcaaacatatttaaaaaagtcaacggtgtcaaacatttagggaaggagggagtagtatattgtacaataagagtcatctcaaaattagacggatacattatatataaattttgaaatatatatacaagtgttgtgaaaatataatgttatctaaaaataaaaattgaatactaatattaaagagtgtgtaatttcattgccaaatttttaaatggacagattttaaaactaaaggacagcaaattttctcggccgacaaacaccggacactaaaaaggggagggagtacgatggacatggacatctgagaaccggaaagatcatatttactctcatttgttcaaatttgtcatgaacagtaggttggccgtgctactgaaataattgattcggccatgatttcgcaatcaatcttgaacggcagccaggagctaagccatgagagttgagacccactgactactgtagcttaaagctactccctccgtccaaaaaaaagactcaattcctgggttttcgtgtcctacgtttgactgtccgtcttatatgaatttttttcatgattagtatttttattgttgttagatgataaaacatgaataatactttatgtgtgatttatctttttaaatttttttattttttttaaataagacggacgattaaacgttagacacggaaactcaagaattgagttattttgggacggagggagtagtaagctactgctcttctgccaatcaaaatggcacacatttatgcaggcaggcaaagtatccatccatccgaggaccacaggggaaacattggaaatgtttcgaaggacaggaaagattgctacggatatcactagcagatgaatgagagatggaggggaaatatttggtagcgagcatgttcttggtttatcgcttcactgcgcaataagtttggtatcgtttggaacgcatgaatttcatagggattatcctgaaaacgtcgtcacttgaaagtggctatgattgagacatttttataaaaattatgtgttctaaattagtagcagttgtgcgagtgagtgatttatgactgatcggatatactccctgaatttcataattaaagatgttttgtttttgttttcatcatttgtttaagtctaattaagcttattacaaaatatagtagggatgtgcttctatgctctgcaaaaaaaaaaattgcacgaaagttaaagctaatcagcggctatgattaaaagggagattagcacttaattatcattagcgaggggtaatttcgtccaaagatttttgagcccatatccagcccagtccatctgaagcgatccccacattctaccagtccaccacggcaccgctcctcaaccgcaccgccgcgccgattttcgccttgccgtcgttgctctgccctcttcttcagttaaaaggatacccgagcaggtatggcctgagtgacagtaaattcagtttcagccttaacttgtctcctcaaagatttgccttcaagttacagaacagagtcaatgccttattgctgcaacccgacttgcaaatttggttgtacatatacacatctggcacaagcttcatatttacaagtaccataaaaacctcatatgcagtctaagcgctgccacttttcaatagaatcgagagaatggcattcgtaataggtgacgatggttgggcagcgcagccgacgcgcgggttgtggaggagtgatggcagcgccgacggtggcggagggaggcaggaagcggcgtggggagggaaccgggcggcaaggcggcgttgcgaggggaaaaagaaggcagagcagcggcggcaaggcgaaaatcggcgcggcggtgcggttgaggagcggcgccgtgatagactggtaggggtggggatcggactgggctggatatgggctcgaaaatctttggacgaaattactcctcgctaatgataattaagtgctaatctcccttttaatcacagccactgattagctttaactttcgtgcaagtttttttttgcggagcaacaaattaatttcattaaaaccataactgaatttttagagcatactatttgtttagtgttaaatttttgtctattttttctataaatttaatcaaacctttaaaagaagtttaacttaagttaaaatcaaaacattatatatctatactccttttaaagaagacaatgatggtgacggtgaatctgtccccaccaactgttgtatggagttttttttaaccaactaccccttcatggtttttaccatctactacttcatgtgctctaatattacaaaatttcttttatatataattctatctatttcattcctgtaatacaaggttatgatacaaagacatcagcaaggacaaaattattaaaaaacatcacaattaatttgttctaaacaatattaacgcagagataatttatttttaatccctagcaaagcatgggtatttagctagtattcaaaaatagagggagtatgtgggaaatgtggcacatgccgacatgcggtacaatccaatgatatgattgataaaactaaattgcaattgctataggatgaacatgcatatctcttgcacaaatacgtcgctacaaattcttagtagcatgtgcttataactatcctataacctttatctgcttttggaagttcctatcacccatatctagatttataagtactttttggtgacagattccctaatagttctttctcatcctgtctggacaaaaactggttgagaaaaagtatgctacatctctgcactttcgccgtgtactgactggttttgatttttcctggctctgaactctgaagtttagagacgacggtcgtcacatatcagaaactgttgctttcccaactgctgccgttccaaacaggaaatgatagatcacttgccacattgtctgtagtcttaaagaaacaattaaaagttgtagataattaattaggcttgtgactgcaatttttctaagcttatgaatgctctcggttgtagtcgtcctcctctgtcggcaaagcatggcataaattcgccattatcttgtggcatgacatgacagcagcttatcaattctgaaaaaatggcatgacatgactgtatactgatattagaaaacattatggccatgattagttaaaaaaaatcacgctatcacatcaaatggttggacacatgtatagagtattaaatataggaaaaaaaaccaattacacagattgcgtgtaaattacgagacgaatcttttaagcttaattgcgcaatgatttaacaatgtggtgttacagtaaacatttactaatgacggattaattaggcttaataaatttgtctcgtagtttcctggcggaatctgtaatttattttgttattagactatgtttaatacttcaaatatgtgtccgtatatccgatgtgacaactaaatctaaaaattttccctagctaagcaaggcctatgttggtaattgctactacctccttcaaaaacagttttacttttctacacaaatatggatggtcacatccaggttttttagaacaataaagatttatttagagggaggtagtacttaccagccgcgtccatgtattaggtagtatgattgtgagaaataaacaaaagaacatttcttttttttttacaaagtatgatattccttctattcctataaatattatgtacatatagttgttatatcaataataagttaataagatcaaagagttatcgttggtctatgttctttaaacgtttgttaggaccatattcacaggtacatgagcgtgcgtgtgtatctttcgtgtaatgaatatggatgctttaaaataggtgtactctacagtatagtttgtacgtgcgtgaaggtgcaaaccggcatcagctttggagtgcaggtggtgttaatcgtccacggtcggtaactaacgcctcgattagtcaaaaagtttgcacggacaatccgttcactgtagctaaacacttagcgctttgttgtcattgatgacatccaaaatcacctaatcaattttttatatatatatcccgaaaaaaaatttgtatataaaaaaatactccctccgtcccataatataagggattttgagtttctatttgcactgtttgaccactcgtcttattcaaaaaattttagaattattattttttttgacttactttattatccaaagtactttaagtataacttttcattttttatatttgcacaaattttttaaataagatgagtgattaaacagtgcaagcaaaaacttaaaatcctttatattatgggacgaaggggtactatcaacccatgtagtaccaatcaccatgtgagaccgtgcaactgtgcaaaaattatttttgtttttttcaaacacaaatgtaatgtaatggcaaaggctcgtaattagagggtgtttccaggggcaaaagcgggagggcgctcacccaagcggaaagcgacacggcaccacttgagaggaggacaccggccgtgcgagcgaggggccccaccgtcagattccgcggggccccgcatctcgatgtccacgtagcgcaagcagccgcccccggcgcgggtgttattatatgttcaccggaatctctagccacccggggtgggacccaccggtggggcccggtggaagtggacgccaggcgggtaaggaaggggagccggtgaggaatccgcgggaacagcgacagcgccgccaggcgcgaggagattccaccgttcgatcgacgtttggtggacacgtgtcgaccaccgagacgagctgaggctgctcaagcttgacacgatcactaatttgataaaaaaaaatgtgtcacgtagtacacgtatagtgtgaacgtgtggtaagctttgattaggaattgagtgtaatgacacatgattagcaggaaattagtgtttttttgtgctgaagggttaaacagtggaatgattaatttgtggtaattacgatagtataaacaaatgacttgaatattataaatacacttaggttagcaaattatggcatgcttaaaagatttgtaaattgtttattaaactgatgctaacgcttaaactatgtgtataggggggtaaaaaagccgtggcgatggttcgtgttaagcaaagtagcttttgactatgcatatctgcacctaaattattttcctattctgccgtttgagtcgtcatgctgcctcttggaacgggagatagtatcatgcaaaacttcggaatgggaattcagctcattgttcaatgccttattttaaattttgttttgagaggttttccttcgatattaattaatcacggttaatggggaaaagttaataatttttaacacgccgctaaagtatgattccaccattttaggaggacttgccctacctcttacatgtaggtccaccaaaactacgacctttggattgaaatggcttataactcaaagagcctgttcagtagttctatttggcagccagctgctacagtgaaatacatagaagatcaatagtagcagctgcagctgcaacggatgtgcagctgctgtatagggctaccgaacaggcccaaagtttttaatgtataaggtcctccaaacctacaatatttatttgaaatctatatggtccatcaaaccattgttatcattcaaaatggttacaacttagcaactttatgcttaggatccgtcaaacttagcaactccgtatgttcatgatttatgaaacctatagcatcaattcaaaacagttacaaactcaactacccttatgtaccgtaggatcaccgaaccaatggagtatgtttgaaatagctacaaatcaaaccccttacctgtggagttcaccaaacctccatcttcagttggaaacaactctaacgtacttaatacctcttatatatacctcttatatgtgtaaggtccaccaataacacattcaaaataatatacagcttaccactctccttacatgtaagatctacgaagtctacggcgtcgattcgaacacaactacagttttagtgggatcaccaaaccttccacggtgttggtataaaacaactacaactcagcgcccctacctgtcacgtgttccatgtcatgtgggatccaccaaacctacagtgttggttcgaaacagctacaactcaatgccaattttgtagggtccaccaaaactacgacatcagtttaacatttttttatataaatgttaatgctctaaactcatggtgggagacctcccctaacttatattgagtttcacttttttttttgcgaggagagttttgtgcatatcttttcacatatatatacttatttaagatgtgaaggaaagatggacaactcaatttatcaatgtggttacgatttgacatattgtggtatgcctagtcccagaaagtggacaaacaataattgcaaaatgtttttatagcaaacatatattgttctgaggagaaaaaagggggtcctgcggaggtatattacaaacagtacaaacctctatggggaaagcacatgtgcatgattggtcatgtctcatgtgggtagtttcttaaagcgattttgcatgacagaaaacagcttgaagtagggttcatgccacacacccaaaaaaaaagacacataatattcttttgttttgagccaatgtcgtatgacataaaccggcttccaatgaaagttgacgtgaaaattaaattaatagaacagccagaagaagcatggttttgcttggctaatgctgatcagggaatctgtcctgaccaattgtaatccttggaactcttaatatggtagtattctaaccaaggccagatcaatgatgcttaaacaaattaggaagaagattaaactttaaagcaagcagcagcgattagtggcgagcacgatgcatatggccatcggtatacagtggcatatcacaaaaagctcaataatactgtgtgtcggatcgtgatgcaaatgcttcttgggcccaaaaaagggggaaattaatcaatcgtggtttgacaaaatgatttaaatttctaacctgaaggccttaagcattattggtcttctacctgatgaccatgaacatgcatgacgattaattcttcgccgttgaaaaggccctaattaagcatatattgacgatttcaatataatcaggaacatgtattgaatatacatgtacacggccaattatttctgtataattatgttggataaatatttccaatcagaaaacatctctagttgttacaaagtactgcctctattgtttcacaaacaatttgtctattgtttcagacattgactactacattttttatacgattggacaaaccaaaacacctatggctttgcagcaataattggccttatatgtatacatggagaagacgatggagaaagtagtagtagagagtacgtttacatccaactacatggttctgggtcctgccagaatggacgcattggtccctgggctatatatctctctttcaaaggcatccaaatctatcaatttggatgatatgctgcatggagctaattaagctagcatgcaaacctgataagctagctatatatgcttctgctttgaggagagtgcatgaaatgcaactcatgctactgtttttttttttgtttctttggtttttttttaacagcattgctatacgaatgatagctactgtcgatggaatataggtctttagctagagtagatggttaattaggacaatatagtgtgattatatgtagttctagctactagcgtgggataatttattgtcaactagggacaagattaatgctcaatctattttgggcaccacattcagattccattaagaaaaaaaaaactacctgtattcaagcagaaactttttttttttacggtaagttccttttctagaaaacgtgtccatgacacatttaggcgtaatggctaacaaaaagtgtacagcaaatcaacaaaacactaagctaacaatagatggtcaaacttgtgtatgtaacatatttagtatataatcattttttccaactatatacaaattaaagtcctagggcttacgggaaaaaagtgcctgagatatatgtatgtatctctataagaaaaattgtgctcagttatgtttcaaattatactactaatatttctaaactccaaaatgtgtctcatatgaaaaaaaatgtgattccaacaacatccatatttctaaaaatcacataaaaatgtgatttcctatggaaaagaaaaatgtgattcctaacccgcatcacccgaatggtagaataataattttttaattatataaaaacccctcagatttctttcccacataaaaacaaccgaaatgtaacatatttttcttttttagaaaaagaaactggtttataccttcttttaggaaaaaaatgaatatcttgtcgatgttttctaatatggtttgttgggtatatttgaagtaaaccaaaccattgagacgaatgattccaagtttttatggattaaagcctttatttgcccataaaagtttacatgttctcttatttgcccctgattgtattaatggtgtgcgggttcagccatgtgtaagagataccaggggcaagtaaggaatcccaagaatttgccaatagcaactaaggaatcatccaattttttttgtaactatggttgtaacgttttgtcatgctatccatagcattaggcatctaatttgacattagagctgaagtttttgtttgctactactccttacttcttatttttgctagacagcgctttatgccatttttttttgctaagctatgtttttactttcgggatgttcttattctcgccaaactataatctaccatcgtgatgcgtatatcaattaaaatgcaacttcacatgttgcttgtccaataatacgtaagttgaggggttcttgttttcttaattggttgcaagcgtattctcttcatcagatttataccaagataaaatttgccctccttctttagtgaccgacaatgccatagaggtgctgttggtgaatgtagccagaggaagcatgccgtagtagtctagtagagggaggcacacgaaagtgtgcatgaggcggcgtcaaggatgggaaggtggtgtatataaggggggagaattaggatcgatgaatgggtatctagcggtccaaaagttggcttcttaatgaaaaaaggtgctcaagatatatattatatccctataagaaaaggttgtgttaatttgtattttaattactccattcaaaatgtattatgctatgaagaaaatgtgatccccaacccatattcatacttctagactcatacaaaaatgtgacttcctattaaaagaatttcttgtagaaaagaaaaatgtgattaccaatgttagcaccggagggtagaccaacatatttttgaacatatatacaaagccctagaatttcttttccgcactaaaaccaaccaacactcatcacattttgtttttcccctttcaaaaccattcatttttccaatttggtttccttgagaactttgaagggaagtgagccattgaggttgttgatttcaattttcatggccaaatgatgatggttgcaacgttttgtcatgctatatgtatataattatacatctaatttgacattgaatgttgtccaggaagtggtgttttcaatggtgcacgggtgagtaacacgtacgaatctgccctaactttgttttgttcttacttttagtaggtggtagcatgagcggtgcggtgagaggaaacgaatggtaggacaggaaggtgtagggggtgcgcgatgctaacgtaggaaattgagtttagccgtgtatagaaagggagaaaaacataaaactttagctaaagatcaaatcacaaaatcagcttttaaatataaaaaaattatcagacacctattattccattcttcttttagcaaagtttatactattcttatttgtgggctcactcaaaaatgttgatttcaagttgggaaaaagaacatgtgattcccaacagcagcagcagcagcacatgggcataagggtaatttttttcccaaacctcaatatgtccttgggaatttcttttcaacaccaaaaccaaccaacacccaacgcatcattttccttaccttttcttttctcccctccctcccttctttttcttgcctctcccctcctctcctttttatgttttttttcccattttttcttccgtggattcccatggccaccacagtgaagtctcggccgccgccaccgccaccgccgccgccgccgcatgccctccccgccgtgaccacccgccgccgcggctcctcctcctcttcgccggcggcggcgaaggcttcggtgttcttgtccgctcctcggttagtctacccactctatccttgtttcttgcttctggttatccccggagcaaataatgaaaccgttttacccccatcttgtttgatgttgctcttcacctcgagcttgatccatggtgagagcgcggagagataggaaagctttgaattatttttttggggttttgttttttttttttttgttttttggttcttgtggttgtttttgtggaggtttattgggtgctttagtggtgagtagtaaccacttttggctatttggcgatcaacctggagttgttcctgattcttttctgtgtttttttttcttctttctttggatttcttgcagggagttgctgcttgttctttgcaacctcttggtggttgctgtgctgttcgtctcgtcgtcggcggctgcggcggcggatgatggtgcggaggggagtgatggcgacctcggcggctgcctcggtttccgggat

SEQ ID NO: 3882 - DNA, 11038 bp, Oryza sativa
acaattggaatcggccaatgccgggcgcgacccagaagctgaatccccggaatgccagcaccgatggcattttcggttcgtcgtcgttggatgttgagattagcccgccggtgttggattgggggaagagtagcttgtatgtggcttccatggccaccctgaccgtggtgaatttgaacaatgacagtgccttgcgcgtgtacgagccgttcagtaccgacccgcagttttatgtgtatggttatgatgatctggtgctgcagcctagagagaatgcatcagtcaccttcatattcttgccgaagttgctaggctcttcatcggcgcatttggttttgcagacgaatttcggtgggttcattatacaggctaagggcatggctgtcagatcaccttatcagttggagccactagctgggatggatgtcataacaggtggacggctggagaggaacttgtcgatattcaacccttttgatgattctctctatgtcgaggaagtggctgtttggatgtcttcattccagggcacaaaacaatcttctcatatagtttgtcagttaggcccttttgacgagtcgttggagtttacttctttgagtagcaactggtatacagcaagtagtactgaatttggattgccgatgatccatatcaggcctagtgagcaatgggaggtgcttcctacacaaagcagcactgttgtagagttaaaactgcaacctctttcagaaggaatggtgttcggtgctatctgcatgaaattacgcaattgcacatctgatagagtagacactgttgttatacctatggagttagaggtgcgtgcacgtacctaccatgaacccactaacttagtttcggtcacatttgagcgtgtatcatcttgtgctggagttgggtcaattatttccctttctttaaggaatgagggaacaaagttactgaggattgtaagggtaactgaggataacagggatggatcaaataattttgaggttaagtacctgaatggactgatactctttcctgatactgtaacagatatagcgctgataaaatatacttcagttccaacggataactcatttgacaactgcaatatagtggtagaaacgaacagttctgttggtagttcaatcctgataccctgccgagatgtgatatctgcaactctttcttatacggctagcgctgttactgaatctgatgggccattttctgaagatgagttatctgctaactcaaggacaggatctttgggcagcattgtagaagtaaaaggcctgcaacacatgaaggtattcccttttgcattgttgagtttgccaataagtagcctatgttgtctaagttgatcttatattgttgttctatcagcattggacttcgagttttgttttcccttgtttaacataacttctccaaattatgtactcagtgcatatgaatatgatataggaagctgataatggtagcacctttcatgcttcggcgctgtttcgttatattttcagtcccacaaagctcatcctttgtcgatttgttgttcctatgatatcttaatcagcaggaagcggcatcatttagaatctcctgggcattattttttagaaaagaatctttttttcattaatgggaataagcttattgttttctattgtgtgctggttacatcattaaggaaaatatttctgatgcattgattcaagttaccaatggtcctatatttgcattatggcctaaattggtatgatcttgagatagatacctgtatctggataatatcttcgtgatcacttcgatgcacttatacaatgaattgatcatataactatgttgtgcatatcaaaatggaacactaagacggtattcttaaacatttctccacttgaatttcttgttgtgcttatataattaaaaagaattgatttcttatctcaagcaccttttcacttacaaaattttccctgttagtcttctcatgttcttttttttttaattgcagccaacaattacaagggcatataaagctgatgatacagtacttagaagatggagatctcatggtacaagaactgggatttctgttctcacagatcaaaaaatgctgtttcctattgtccaagttggatcacagttttctaaatggataaccgtccataacccaagcctagagcatgcatccatgcaactggttctgaattctgaggaaattattggtcagtgcaaaactataaatgatgcatgtgaacatacattctcgagcaggtcccctgaagttgactcaacagagactagatttggcttctcattaagtgatgcagcaatcactgaggccattgttggtcctttggagagtgctttacttggtcctatcatcttccgtccatcaaatcagtgcatgtggtcaagcatggtgttgatcagaagcaatatttcaggcatggagtggctgcctcttcaagcacatggcggacggcaatctattgtccttctggaggaatctgaacctgtttggaagctagagtttaacctcatttccgatattcagaataagtcagcattgtctaaatcagagttcaccagccctttgtgcggtcaacatttgtcgaaagaaatacatgtcaaaaatagcggtgaccttcctcttcaagtgacaaaggttaaaatctctggagctgattgtgctgtggatggattttcagtagataactgcaagggatttagcttagcgccaagtgaatcaataagaatgcttgtttcttttaaagctgacttctcttcagctatggttcagagagatcttgaattggctatgactaccgggattttcataatccctatgactgcaaacattcctgtttgtatgcttgaccagtgcagaaagtcgtacctcagatccatccattggaaaacattgatattcctttttggaactgtatccgtgtttgttctggtgttcgcgagaggtgtcccaacttctttgtcagggggctctcaagattgctatatcaagattcatgatgggaaaggtaccatcgacaagcctgttaagccctctttccttcagtgtagcagcaaaacttccaggtaaaatttagactaatgctggccgctctcgctttctttgaattttacatggtttataattcggtatggttatgcctatgtaaacaggtcaacaagggagcacaaaagagacaaagaaactcataaataccctgcggatattcataatagccccaagaggacagaagacaagaacaatgcagatgaacaactgaatacaacttcaactatgtctctgccccctagtaatactgtggaagacaaggtatcaattgaagctccagaaactagtggaaatctaaccatcagagttgctagagacaaagggaagagaagaaagaggaaagtcggtggcgcaggactcgcagcaaagtttgaggtttctagcagccacagtgggaattcgacaccgtcttcgccattgtcacctagttcaaccccaaaacaaagctggtctttctctggcacaccatcagaactgaagcacagcagtaaacttgagaatggatctgacattgaggcaaggccaccatctgctaggaataaccatgagaagagttcttggttgcaaactgctaaagagcaacctgctccaccaccttcagtaacatcaggaaatccatcgccgtcgccatcgccttcacctactgcaccaaccaatgcatggcgctcgccattgttgtcctcgccttccccgatcgcgcctcgttctcgcgctcctggatccaacctgatgaaagataaggctgtgaagagaaccgagggcgccgcgacgacgacaacaacgaggaagaaagacttcacatatgacatctggggggaccatttctccggccatctgctggggaaggcaagggaggtggcgccgccatgctacaagatgtttgctgcttctgaaggcgcctccaatagcttcttcgcgagggagccccaggccctggtgacgaagccgccatctccatctccatcttcatcttcatcttcttcgcctccggtgacccgcggtcgcgggtcgctgccgtccgatgtagcatctggttatggaataaattaagaagtttgaaacatttcggccctggctctcctctgcatcatcctgcattcatctgctctgctctgccgttctgctaaccatgcatgccctaacttcttcagtagcttaaaacttgcaaaggctaaagaaaatcgaagcaggctaaagctaacttttttacctcagtactgatggctacatgtttaatctgatagtcacattcaacaaaactgaattttttactgaatttccgctctactagaacattcctctgctctgccattctgctaacctacactaacttcttcagaaagattaaaatttgaaaaggccaaagaaaatcgaagcagggctaaagttaactttttttttcatctcagtactacttgcattgtttaatctgacagccagaatcaacaaaactgaaagctttactgattttccgatccagtgcacgctaaaggcttgtgcatcattgccctaaactaaaagtactttactagtgctaacttttaaccctggggataatttcgcaatctgaaatttttatgtacatgagcgagatctggacgcattttatcgtcttcccggtggacgagatgagtttgctccaacctttgcacattcaactgtcagataatgcgtttccagctcaagattctaaagctgacatctcacttttagtccaatccatatgacgcaatggaacatatcttgcccgcccaaagcatgcaggcctctattttaatggacgatgcatgtcaattcattagttcccaaaaaaatcgctctttgtataatgcatgcagattagcctgaaagttagatgcgatatgcttcgcttgtggattttcctcccttggtgacattcatcgtagtcttattttgcagactttgctttcaaaccggtaagaatggagatataaaagctttacctaaaaatgacttttgatatattgtcctatttgcctttgtttttctacggcttatgaactgtaccaagctagctagaactttaagaaaaaatagcttatttccctgtaatcggttgctttcagctggaattgcagacactcgattacagagccattgacaacatgtatgggagtagaattcaggtaacatccaagaacagaagaacttgttcgttctattgttattatgtgtacgataatagccagtgactctcagcacacacacatcatcatctggcaatctaaaactgtgttatttgttgcagtcttgcagtgcatgcactgatcatttggcgatgcaggcatgccatccagctgtttcctctcagttttagtttccagccatcacttggagctgaagagtgacaacctgccacatgcaaaatcaatcagtaaacaactcatcatctgaacctgaatgttcatcatcgaactaacctctgttgtttcttgacacataaattcaggtaggagttggaactgaaagtatgggagaactcacccgagcctgagagatgtatcagagctgtagtcgttgtcgggtggaggtcgcgggtaagaagcattggtgacagattcagacgactgcccttcctcgtacacgatttctgaatcaggcccaggctgcatctcctccattcttgacatcctggacacctgcagcttcagatcgtcgtttaatcaaatgaacgagcagagcaagcatagagagaaagttttctttttagataatggaaaatggttcacatctccgagcctctgtcgagtttcgacagggcagataaaattaagggtacttacttgctccttcagccttaaattctcctctatcaattgcatcctctgtttgatcacacaaatggagcagttttgtgatgagaaagagaaatcaagatctaacagaagataattaatttcagctgcatttcagtttcgctctgtagctgtgtactgaagctggagattggccaaaatatcatgctcttacctttcgttccagtccatcgatctcatccagaattttcttgctctgaagaagaacatgatcaaagatcacggtgtgcaacattgcaactacgtacgtccaatggacagtctcatgttgctgcgcgtaccttggtcttgagaacagagcctagaccggactcgaggctcttctctagctcctgcagctgttccacattcagcctgtgcagctcctctcctttcatctgcctgcaggaacacacaagggaattaatggccacatatactagctgaaccatcctgtgaatccacagaattagacagtacctacaactcttgaaatagtgtaatcttatgtagcatttaatttctctctgaaaagtaatagtactcagtaactgtatataggtcctgtatggggagtttttacagctgtatatatatagttttcacgtaatctccacctccccaagcagttcatttcagattctcagattctctaagaatatgtagttataggaagtccagttttctcagcagctcgctactagccgcttctcagaatctccagctcccgaacaaagtctatatatagttataagtatgtacctcagcctaaggctagtttctgcaagctcctcctttagtctggcacaagtactggtgtcctccccctaccagatgacatgaataaatgcagttagggatacatgtactatttcttgcttgtatgatgataaacgatatgaaatgttcagagaagtaccactagcaacagtttcttaagaactgactaattaattaaggtccacactaattctttctagaaagttgagtgatatgagagggtatatcgatcatcaacatcacatatagctgttgcatttctcttttgtaatacaagtgaaagtattttcagcttacttgtaagtcgagttgagaaggttctgctctctgaagtgtcttggaatgcgagttgtaccggtcaataatctgttccatgcttcatcaatgtatatatagaaaacaaagttagacagagttggatgtttgtagagctagctaaggtttgtaatgttgaatccaaacgttttcatcaagatgctagtagtaccaaatattgttaggtagttcttctaggcccttcaaaatacaattgcttctgaactaccatattggaaggatatgaatgttctgaactaccatattgattgtttcagagaacgagaagaagaaaatacaattgcttctgtgaagaggtaagccacgcgtagcttgttctgtggccatcaatatttcatgcatggaccatgcatgcatgacatggcacaggcagcaggaatagtagaagtctagaagacgaagacacatgactatatcttatggttcttgttatgtattatgacatgatgaactagtactatatcttatggctcttttcaaacaaaggaaatttaaataaattttataaagttgagaaaaccctatatatatgtctaatcggaacgaaggaatagtcattccaaattcctatgaaattccttatggttggctcgaatcatagggatattagagaacttttaacttgaggtccaatcttttagaaaatattctttgcatctatctatcttccaataattatattatgttttttctatatatgctccatttaagcagtcatttctgttgttttcttgttttttttcttttatctctctgtgtgtgtgattaatggtttcatgtttatacatgtagactagtagtagtgctagccaagtttaataatagagatgtctaccgcctttaattttatccctcatatctcctcatcgattcgatcaggaggtgtatatatatatataaaacatgtgtactaccttcatcttaagagattttgcccatatatatatctacataagcaaaatcttttgtatttagagacaaaggtagtacaatatatctcatccataatacacaaactctaatgttatttatttgtttactatcacactagtatttgcactttttaaattatgtagaggctgctttttatactgagagattgttcgttctctctctcctcacttaccccacactcatcaccaaatgcaacataacactgttaaaagacaacacttgagtcttataagcacgatcttgagttttattatacttgctcttatgtacgtactccttctaattccataattatcatgtttgactagaactttaacaattttaaatatttagcttaaaaaaacactggaacatagattagttttaaaaagtactttaataaaattaaatatctacttatatttttatatattataattgaaaatatatttggacaaactctgatagcggtacgtaagctcagggatccatttgattggattggtcaatctttttctagctaccaggccaattggtatgcacactctatatccatgcatgctgatagatcatgtcatgcactggcaaatagtgtaagtgatgtacatgaaaagaatagatcgactagctagttttctgtcgtcgcttgtggagaaaaaaaaaacaaacaattaacagtcgcaaacctatcactttggagaatcccatatatgtgtgctactatcagaggtcgtttcgtttgacagctctagcttaattagttaccccgaatacaaagattgaacaattaacaagtttagattggttgtatttttgcttgattttgccatgtgttaattaacactgtaaacattctggtatatatatgtggggtatcagttaacaacactcttgacattagatatatatatgcacttctttccatgtgattagttcataacacaaaacgatcaacacagtacgtaccctcatgttacgacatataattaggactaaatttgtttgcatatatgtatacacaatggttagaaccatcagtaacccaagttcagttgacaaattaattagactgtataccgatatataccatatccattaaaaataatttgaattaaatagttgttagttttcattgagttgcctagctatgtttgaccaacaatatttttaagaaatctagttagtatttagcatcaaagttataccattagatttgtaataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatatatatatatattactcatgcatgaagaatatgtaattgtcatgacaaatctgctgctgatctctgaaagctgtaataattaatttcagtatatatatgcatgtacaaactacatgccttcttattcctgctttaatgaagaaaataatatcgatgagattaactaaaaccagatggtttttacgagttaaaatttcaacaaaaaactttgaacgatatatagtctgtttcctgataagcgtccagggtgttgtctacaagatctaattaattaaaatagtgatgtcaaaagcaataatgtaacaaacgtggaaagaacggcagtgtcaagaaattagcagagaagatacttggaagtccactgagcttgtagaaaaagatggagaaagatgcagttttatgagaagatccaaccagaagcaataatgtagatatggttatctatatgtataacaactacacatcaaatcatgcgagaacagggtaagttttccacgagtgctttcacacatgcatgcaaaacctgtcctactttagtttttttttcccaagaaaatctgctatttatctctggtcatccagtccaaaagagagaaaacacccctctctgccgagtctcttccatacggtcttaaattaactgaataagattgctgacttcaagagtgaaaaaaaaaactatatatgcttatatatatatagccgtgtgcctatcggtgtaaattaaccattttcattataaaaaatgggtcgagtgaaagatagaagagaacacgacataagtgctaaacaatatttcaaattaagcgcactatggagctataattaataacatcatatacagagagctctatttaagaagctgggacatttttttcctgggaattaaagaacattccctagaagaacatattacattactcatctagaagaaaatgaatcaaagcgccgaacaatcaaaagcattttgtagaatcagagaaagcaaaagacaaagacaaaactgttgtaggattgaaagaattttacacagtacacacactagcgaattctatataaaccaaagacaaaactgttttaagattgaaagagccgatgatgagaaaaaatatacacatctatcactgttgtgtatatggagtatatccaagaaaaaagagctgaccgaaaatccgaaattggaaagccatgacctcaatctcaactcctcaactgaacaactcaattagaagcacgataaactagaattttatgtttattatgataaattttatactaattaaacacgccaaaatgaagaaacgtacttaccggcaaaatcaattagggaaatttcagaagaaaaaagaaaccctgatcgatcgacaaagagccctaacaatagtacgatattccaagaaccgacagagagatcatcacccagatccgagatttaattgcaagcaaattaaacagaaataactgcgagcgagcgaaggagacccctgcgaggaagaaagaagcatatatgtgttggtgtgtgtataactgtatatacatgcatacctggtgctggcgaattggaagagcttgccggtggcggagaaaacgacgagcccgacctcggtgttgcataggatggagagctcctctgcctttttgaacagccccctcctcctttttgaagggtcacctgcctcgccgccaggttggcgaaccccccaatgggtatcctctcctttttcccggggg

SEQ ID NO: 3883 - DNA, 21111 bp, Oryza sativa
  unsure (1)..(21111): unsure at all n locations
ggtggctttggattgggtggaggacataagggcctcttcggtaagtgtgttccctttttcttcgcttagaaacgccatccccttgtcgccatagggccccggctgggtccgacggagggctttcatcccaagaaagttcgtaaacctagtgtaagttgagggcctcccctccccctccccccttcccccgccaccgccgccgccagccatatcagatcacacaccaattcaccaccgccgccgcaaaatcggggaggatcgatcagacgaaacaaccaaaaccctagccgctaaccgcaccagccaaaccagccgcgagatacgcggcgccgcagatctatggctgcggcggcggccactcccgctactactactacttatggaagaaaaaggcagggaggaagggagcaatggagaccaccaccaatggaagcgaagcgaaggaggcgagagagaaagagaggaaacaggagcagggaggtagggctagcctatagcactgcagcaggggtaggggtaggggtaggagtaggacgactcctactttttatggcaaaggctttcaagtggtggagccacagggacggaggcaggtgtccgccacgaggtggttaggactcaggccccgtctagatctcaacttaaaaattttcaccatatcatatcgaacgtttgaacatctctataaagttttaaatataggtttagaaaaaaatttaattgtacatattacgactaatttgtgaaacgaaaattttaagcctaattgctctatgatttgataatgtgatactacagtaaacatttgctaatgatggattaattaggtttaataaattcatctcgcggtttattgacggattatgtaattagtttctttattagagcccgaacaacccatacaacaccataatacaatatccgatgtgacacgctaaaactttacaactgtatatctaaacatcccctggggacgcagggactagtgtaccctccctccacgccattgcccctgcaacttttgacattttgaaaagtcacatagttctgggttcaagagccttcggaactatttcgaagagcttaaaattttaagaattaaggggtgtttaggtgaggctaaaactttttagtccatgtcatatcggatgtttgacgctaatttagagtattaaatatagactaataaaaaaaactaatttcataaataagagctaatatgcgagacgaattttttaagcctaattaatccataattatgaaaagtttactgtagcatcacattgtcaaatcatggcgtaattagactcaaaagattcgtctcgcgaattagtccaaggttatggaatgggttttataattacagtatgtttaatactctaaattagtatccaaacattcgatgtgacagagacttggaataagtctctgtttcccaaacaccctcctcacttcgttaaaaaaaatcaatcacatcaaataggtttaactaagttagtggtttttttttttacagatggagtaattatactctttctattaaaagaaaatctatatgttcagattcatccgtagagttgaattcttttttgacatatggagtactccctgattcgtccaaaaaaaaagacaatttaggaggagatgtggatctaggagggttgttcagattcgttgtactactagaaggagatgtggctctaggttgctttttttttttgacggagggagcatttgatagtcatcttctgataatctaaaaaactaggtttcacaccttatacttctagtttgttttttagactctgacttcaacttcttagaatctggacgaaaagcttaattgtttgggaaacttgttactccatccacctcaaaatataagcatttttggaccctgacacggttttcgagatgctactttgccaacaatatctataaaagtaagatgatttaaataaaaagagttacatactatgatagtctgtttgatgataaatccagtaacatcattttttttcatgattgatcttttttctattaatggttaaagtttaaaatgtttgggttatcactgtactaaaaatacttatattttagaaaaggggagtattttagaagaaactgcagttgtcccactccataggatgtgtttagtttctaaaaaaagttggaagtttgggaaaagttgaaaatttatgtgtgtagaaaagttttgaatgtgatgtgatgtgatggaaacttgaaagtttggggtagttggggatgaactaaacacagcctatggcatgtttgtagattctgaaaaacaaaagatgagatgagctgaaaataaatagcttctggcttctggattttagttgtacttttgtatattcctcgactacaacattttagttgacagttgttaaagggcctagagatatattacagaattctccaaattctaaaaagtaacgagtgagaacctagaagaaatcgtagctgtcagaggctcctcaaattaaacagatcctttgacagctacagtcactactacgtaactcattttgccatacggggatatccatttttccgtgcggtcatttgacccgcctgcacaccgctgtctgtgaaaatcagtattttcgcgtgcggacggaaggaccgcttgggataatcgattatcccgtgcggtcatactataccacccacacggaataaaaaaaaccaaaaaaaaagaaaaatcgtcgcccgcccgccggcctgcaagcgaaccggccgccgcaactcgtcgtcgacatcgtcgcgcccgccgccgaccctcaccgccgtgagggacggccgccgccgccggatccgggcgtgtgggggccggttgccgtcggccctcgccgccgccgcctcgccgcacccgcccggtcgtcgcctcgcgaaagtagggagaggagagccctccctcctcgtcgtcgtcatcgtcgtcattgtggtcgccgccgccgctcccgcctcgtcgtcgtcgccctcgagcggggaagggcaggagaggaacgctgccgtcggatccgggcagggacagccgcgggccgcccgtcgttgcccgccctcccgcccaccggatccaccgcccgcgcgctcccgtcgccactggggaggggaggagccgcggccgccggtcatcgccctcccgtccgccggatccaccgcccgcgcgctccggtcgccgccggggaggggaggagccgcggctcctcgcccgtcatcgcccgcccgcgcgccgaagttgctgctgggaagggaagggaagaagctgcgggccgcccatcccgtctacgccagccgccgcctccccacgtccgcccgccgccgccgagctcaccgccgtcccgcctgtgggttgtggagaaggaggcaactgaagaagaaggtgagagaaagagggaggaaaatgagtggaggagaaggaaggtgagaagataagggagagagaggagagaaggggccgcggggagagagaggaaaattttgaataggatgggagggacgactatttttctgtgcgggtggattaggaggcccgcacgcgaaaatagggttattttcacgtgtgggcctgttaagtcacctgcacacaaaaattgattttcgtgtgcgggcgacgctcccaccatttttccgtgcagtctgacttacggaccgcatggaaataaaatggggtggtgtccaggataatcaatcctgtagtagtgagtttcttctgaaatgttcggtcctaaaaaatataagctaccgaaaactccgtaatctacaaaatgagctactgaagaataaaagtaactcccttcgtcctataataaaatttaggagtaagtttcattcatttatcttaaaataagtttatttttaataatcattacatcaaaattcatgaaaattaaaaaatatatcggaagcagataaagtactggaaaatgactgtattaggatttaataaatatggtattctgttttaagctttatactccctccgtcccaaaatataacaatttttagccatcaggatttgtctcaaaatataacaacttctgcaccaacattctctttccaaccaatcacaaccctcaaccacttacttctacctactttcttaataaccgtgtccagccctaaaatttcttaggacctgtttggttggtgaaataaaaatttttaggtgtcacattggatgtttgaccggatgttggaagtggttttcggacacgaataaaaatactaatttcgtaactcgtctggagaccgcgagacgaatcttttgagcctaattaagccgtcattagtacacgtgggttactgtagcacttttatgcctaatcatggactaattagtcttaaaagattcgtctcgagatttacatgcaaactgtgcaattagtttttctttttatctatatttaatgctacatacatgtgtctaaagatttgatgtgatgtttttaggaactcaatagccccttatattctaggacggagggagtattgatatatgtagaaaattaaatttattttaggatggagggattaaaagaatcaactcttaggctgtgtttagttcacactgaagtttggaagtttggttgaaattggtacgatgtgatagaacagtagttgtgtgtgtatgaaaggtttgatgtgatggaaagttagaagtttggaaaaagaaaactttggaactattaggcccgtttagtttcccaaattttttttctaaaaacatcacatcgaatctttggacacatgcataaagtattaaatatagataaatgaaaaaactaattgcacagttagggaggaattcgtgagatgaatcttttgagtttaattagtccataattagccataagtgctacagtaacccacaagtggtaatgacagattaattaggcttaaaagattcgtctcgcggtttccaggcgagttataaaattagtttttttattcgtgtccgaaaactccttctgacatccggtcaaatgccctaaacatagccatgagagaggagagaggacttctgacatccggtcaaatgccctaaacatagccatgagagaggagagaggacttctgacatccggtcaaatgccctaaacatagccatgagagaggagagaggaggggaagggggggtggaagaggggtacgttggcatcagtcggtccatcgtccgtccatttctttctatgacggcaaagcctcctgctatcgttcagaaattgatgagcttttgtagagtagctaggggtaggagtatcctattttgagctctcgccgaagaaactgttttgggtggtttttctcgggaggatggaggaaggaatcgaggaacagggaggtcaggagggacaacgtactgaccgatggattgatgcgtggacgatgcagtagctaggcggtgtgatgaggtgttgccgtgttggagcctggaagacgggttggtggagtgttgcaaacaaatttaggagtaggtggttcgttcaggtcaccgtttatcaataaatattatcgtcacgtttatttaagttgaaatgattaaattcttaatcacatgttagcaaggctaacatgatcttgatacacgttttatgttactaataacgcgtgagatccaatttattgaaagatactctcgctactaactgcgaccacaaccaaacaactgctaataaaattaaactcacctaattttaggggtggtaaattgtgacctggtaaccaagcacccacctgttatatagcaggccaaatgggtggcttaacctaacacgccacatcacctatatcggaccgtgccatgtcggcccacatgtcaagaccacagtctaaggtggtgccgtatcgtgctagggcgacgcggttactgttacagtcaatggaccggtgaaaaataaaagaaaaatgtggagatgcaaccccactatataaggaaggaaggatatatatgattcaattttgctatatatttgtcgacaaattttcttccaaaaatttaacagatgtaattacagtacaatcgcagtgtaattatactgtaacttgtatgtaattacactgtaactataatataacttgtatgtaactttcaaaaatctctccgtaacatgttatttcggtaaaatcgaggtcgtgggaacaaatcctttcatatacgtgtgtactgtgatctttttgttcgtcactagaacaaatcttgtaatagatctaatgattcaaaattacgtgaaagttatatacaagttatactgtagttacatgcaagttacagtgtaattacattgcgattgtactataattatatctatcaaatttttaaaagaaaatttgtcgataaatatataggtggttcctgtatgattaacatggatcaacactaaaattagtatagttataagattgcatagcttacggtgggttgcgacttacgaatgatactcagcatataccagagagaatcacactagagagctgataaaattaatctcgcgctttcgttaacgatcgccccttcgatctgagattgtctccggaggaattgatgctcctatcgtgtccttacaagatgaaggtaaatcgatcgaatattgatcggtcgtacgtgtgccgccgtggttttatggtgtttaatcgacggcgccgtacttagcttactagctagctctaattacgtacctacgctgtctccctcaccgggcactacgactcacttcccacttccccctcagccttgatctcgatatttgattgtgccgtcaactccaacatcaccttgatcgaacgatttcccacaactcaacttcttcgagatcaccatgattgaacgatctccgagctgcttcacaactccactcgatctagactatgctcgtgagatcagattgagctaaatccctgataaacatgtcataaacacacatctagtgatgattggacgacactttcttaataatgaaaacattcgctgaaattctctaccgatcaagcatcatttttcgtataaataatatatatgttcttgatttttttagtcaaatagaaattttgttttttctattcacttttaaacaccatatttctatcgtaatactccctccgtttcgaaatgtttgacaccgttgactttttagcacatgtttaaccgttcgtcttattcaaaaacttctgtgagatatgtaaaattatatgcctacataaaaatatatttaacaatgaatcaaatgataggaaaagaattaataattacttaaattttttgaataagacgaacggtcaaacatatgataaaaagtcaatggcgtcaaatattttgtaacagaggaagtaataaattgctaatatgatcaattgttcgactgaccgaaaatcgtttcgaacaaatgctaccgttctcgacgttttggaccacttctccctacacattctcctatccggggcccagtgatgcaaacacaaacaaaacccaagtcgcagaggttacacggcccaacagaaagcccacctatcctctccccacggcccagtccgcgtccgactccgcgtcgcctctcgcctcctctctctcttcttcttctcccccaaatcccaattgcttattctccttcgacaagccggccaccgtccatcgctgcttcgcttgctcccacccgaagcaacgcgaacgcgacgcgctccccttcccgccacctcgcggcggtgagaccaggcctccgcgaccctcgccggccgtccctgagcgccgcccgcaccggcaactcggtttcgaggctgatctcggcaggtttgtgtctgccctcgatccaaaaccggtgctgtggtttgtttcacgatcccgttaaagttgtcgaatccgttcggcgattgtgattcaggtagaggaattagttttgcaagacaggttttacaaggaattttttgggggggagtgggggacacgtttttatgctgttgttctgatgacttcttgaaagtcacacccaagttagttagttatcagcagctcatggtaatcttcagtgatggattaaccgctctacggtatctaggcaatttgagagtagaagcaagccgtagcctacagaacattttgccatccaaatgcttggcattttgatttgattacgcaggcagtaattttggagtagaaaacgcgtcctaccgaacatgagacttatcacaagtatatcgttttttgacaatagtcaataggaactctgcgttgaggggtttgatttcaatttgttctagatttgatccattcttcttccttttatttttctgatgcaaccaacaattagtctggcattggcgttagcgattaccatctactagttattttccgttagaatctatatgcatgtacagcttattgattaccaccaactgttggaacatatgtaacctgctatttctttttatgcagattgctctagtacaatgagctggagatttcctctttttgggtatgttatttttactgaaagcaatacttttttcgtttgttcttcttatgtctgttcctaacctttcctcgcatagcatttgtattctataaactgagcttcctcttttatttggtagaaagtattgtatttgttgatcagtgccagccagcaggcttgatgtgattcgtaatccttagtttctttctatactaaaaagccttcagatattgatgctcaaaaaattgctttgcttttgttccaaaagtttattttatcatccgaacagtgtccaccactcagctactctgttatttcttatggttgggtcttcagttacgctgaatttaatttttagcataagtaaattaacgtggctatttaatatgattcacttattgccttaagctttcctgaaaaacgagctcctctggcttactgtctttgtttctgctgaatgcttgccagcagcaactcgcagcagcagcaacctgatccaaatttccaggacaaccctacgcaaccttggtaccctcagtctgtagttggttcatcttcacatccatccacaccaagctcttccaatgttggtccacatcaaagagcttctgataattcccagtcttcatcgcgtgctcaaccatctccagctgaggctgcagggataattgctcggttaaaggacaaaaggtcagcagctaacctttttttgataagttgcttgtagcttcctgtatacgaagtttcattgtattatgccttatcttatctatactgtgggttaaaattgcaacagccttgttactttttaccatggtattttacatattctagtgtttatattagtactaaaagagagtcactagaatctaactaataatattagagtaatgaatttttaattgcaataatgatatcatggctgatattctatattctatcaattggtaatgaatgaagaatccctagcttttcagagggcacgacaatttgtgcaattcagaagggatgtatataaatgctaaaagaagtgattatgtatggttgggttgctttttataatcgccacctttactacatgtgtttttcacactattccttgtgagcatgcttgtttggaatgcaaaactgctgtatataatactgtccttttttctgcagtgttgatgagttgcagaggctgttgaaagacaaagaggcatataatgctttcttcaattcactcgatcaagttaaaacccagaacaacgtaagttttgttgctgagtacacaggtgtttgaaatttgtattggtggctgtacttagatgtttctgtatttcctccagtagttaaagatacacaggaaactccaaactatatgctccaattatttttctttttctttttctggcctcatatttgaggctttgggctgtggcacatctcctgtgatttgggcattaatgtgggtgattattctttaatttatattcggtgctgcttttaaccttagatagttgacttgtctgaatgctagacctcttgtcaatttgctcacttcttgttctttcttaatgttcagttacgcgatgagcttagaaaggagacagtgcaacttgcaagtgagttattcgtgtttctgttatcggcatgcaatgcttttttattggattgtcttaactatgaaaaagatataaacaacttgttagttactactgtttctaaatcaaatatggttggatcttctgaacttacaggagaaaatttggaaaaagagcaacggatcttggagctcaggaatcaggtttagtactgtgacctccatctcagaaactataagctactgtagccatgatgttcattgttaaacgaactttaaatacagttaatgctataataatggattttgtctgcgtttcaattttttttcctgagattcaaatcgcatttattattgtgcagtgcaccattataagaactacagaactagctgctgctcaagataggttggctgagttggaaaggcaaaaggatgagattatgaggtcatattctcctgctgcactgctcgacaagctccaaagtaagggttctgaacagctgcatctgcatcatttttgctgtgtattttaataagagtctgtgctttattatttgtagttgaatacattatgtgaattagtgcaccgaatcatgggcatgttttgtatgtatctattgtttgctatgaatgcactacccttctgtaaccggccaatgatcaggctaggactggtactagcgtcatagtggcgtctatgttagttccatttcgtgaaaccttgatttatgcttctgtcattgtttgaagtccaaccatgtaatttaatttttcaaacacccaaccgcaaccgctgacattttcatgaattgcttcggtgcttgctcagaatcgatggcaaagttggacgaggagtcggaggagctgcaccagaagttcctggagaaggacattgacctcccaacctttgttcagaagtacaaaaagctccgcgccgcctaccacaagcaggcgttgctccatctcgccggcaagacctcacttcgctgaaatccatcggccgtctgtaggacgaacaccctgttgtatgagtttcccatttctccatcattctattctgtcgtggtgtctgtccacttggctgtttatcagtgccgcttaatattgtagggcttgtgaaaacgtcagggtttgattgcatttgtagatatacgattgtattcgcatcatggaattttatgtatgatcatttggctggtgccaacgccagtgaagcattttgacctgtcagagacacggaaacaaatataaatcttgtgttcaaatctgagcacgaaccaggattgtgccttgtgcaaatcttgtacgtacaaaactgctccatgctccatatagtcatatcaggcattcctttttgcttatttcaaaaaaaaaaaaagctaggattgattgaatttgagagttcctgaatgaaaaaaaaaagaagaaaacgattggcttttccaacccatttgccgcaagctcaaagcatcataacctatgggttcagaacccatttgcactgcagatgaagtggcaggaaattcagatgagctgtactacatctggataaaactgcatcctcccatgagcttttgcacgggattggatctgatccctgcgaccgcatggacgcatgcaagcgaggctcgcacgtagaacaaaactgcattattagccgtggattagaacgatccaaggcgagctttgtctgcaactctgcgtgcatcgctaattcgccgcaacccgcaaggaacaaggtgcccgtgaacctgctccctttggaagcatagggaaccaactgtactccctctgtttcgtattacaagtcatttaaatttgttctaaatcaaacgtctttcaaattaactaaaattttaaaaattgtataagcattttcagcaagaaacaaacttacttaaaaaatgttattcaattataggtttataattgatgagataatttggtactatagatattctacttttttttctacaaatatagttgatatttaacataggacaaacctgaaataacttgtaatataaaatggagtagcaaactgacgtacagttggcctcccgaagattagcagatatgtgttagattaatatatggagtatagatttgttctgtttgtgttaggaggaaacaggggagggttttgggcttactctcaccgacaattcgatcacgagatagatgcattaatagatgtaggaagatctgtctatgttccttatccttgcttctcctgctaattaatttgctgataagtggctaaaccttgtacatagccatggccgggaacgatgcttgccacggatggacgacgatcttcgtgctgaatttcagtagcgtcctgcaccgttgactgctggtttgttcgtttggctggctggcttgttgatgttgcctgcttgcaaggcacttttgaaggtacaatttgcgtttgtcagctgtgctctcttctgccaggacgataggagagttttcggacaactgcttgttctagaattttaatttctcctaagcagttctcacataaatgctagttaccactgattcgccaaaaaaaattatgggtagttttatatatatatatatatatatatatatatatatatatatatatatatatagggcaccatggtatctaatgtacaaaatcactcaaatttttcaaaattttcaaattgtgagtatatacctagttataataattcgattcatatctatacctatcaacaaaacaactcaaatttaactttatttcacaatccatgattacatacctaactaattatatgtatggatgctatatacctagaatcaaaatctaacaaaaacaagttcaaattcagtacaaacatgctttgaactagttagtaaagtagttaatgttaatacctaagtaattgaaaaagtttcatactcatttgaattgggtatatactcaatttcaacaatggtgcccgggcaccatggagcaccaaacaaatttaatatatatatatatatatatatatatatatatatatatatatatatatatatattcttaataaatttaaagtcaactttgaaaaataaactacaactacaatgaaaaagaaaatcaaaatgaactctaagattaatttttaggtggcagcggctaataagttataggacaaacgatggaagcctctaagatacttgagttgtaaaatctaaaaaaaaaagtaaagaaaaaaaagctaagtgtatttttagattctcatcaattagcaagtcaatacttcctttgttacaatataaatatacctagtgcgagatgtgttatatcttacgactataaatctgatcaagcaactatttagatttagatttatagttctacaaatacaaatctggacaaataactatatgcagattcgtaatcgtaggatatctcaagttctatcgcagatgcatttatattgagaagaaggttacttagccatctgcgcgctgagtacagcaatgcacgggccatccgctcgcggctgcgtagtacactttttacgtgcgcacgcaatgcatgccgagctggatggaagggatgggacgtgatgccgctggctgctcgtgaagaaggaacagacgagcagtagaatccaacccccaaagaaaggaggccgcggaatcacgcgtggaggaacggggatttgtacacatttggatctgtaggcgtcacagcacaatagattcaccgagaaaatatccatagtccacatcaatatttccctagctagttaatagtgaggaagcaaatacatgtactgaaagaaaataaaaggagattaattgtgaggaagcaaatacatgtactgaaagagagaaaaaaaaaagagatttggagggatgtgaaattgtgagagggctagggattgaacataaaacctcagagttgaaaccacacgccgactactattacactatcaagtgcatctcaattacatatactacaggatgagagtcagagagtcggacatggcagacatgcatatgttactttgtaggaggaataggcatgtaggttacgttttatatcttgagaagcagcggacgagaatatgaagaaattggaaaaccaacttctaatttcttataaattttctgaattatacaaagttatccttttaattatgtaactaatacagctataaaaaatatggataaaaaagctaaaagctcctcctaaaaaaagccttaaatatctttctaagatacccctctataggaagtgtggttatcaacacgtacaagcatgcgttactcaccaatggatcgtggtccttgaacaaatcattcggatcacatgtttctgcagactgcagaaaataccaggatgcgagcatctacgttgatgttatttgtacacatccaagttaataattaaacaagttaacctgatcgccggtcacagccaatgacccagagaataatgcaaattaacagtaattattaacagacactcaacggttgttgattggttgataactaagctaagacacacctggtgattcgtcgacagggtgtgatgatccttgtccttgttgacccgtgaagaagctgtctcaggacgtgtcaggaatcaaggatttcgtcaggttttacctgcagtggccggacaaaaactttgacaggatgtggtacaatattcttgcccatctttgtgacttttggtcgcactcctaggcgtgtttaacttccttaatctgtcttcctcgctgtctcagcttaactaagtaattaaaagggtcaatttggttctgtgcatctcactccactacaattttgcatgtgataagccagtattttgcttctccataattaatcattgttcttgtgacaatttttgtctagtgagagattcttatcccaaataatctttctactccaagggagaagcagaacattgttcaaaaatcaagaccttatcataatttatttactaccaccatgagatgatgattgaggtaaatagtaaagcatcgaactgtacggcggtggagttgtgagggcataataccaacgaccaaagttcacattctttgagcatgtgttaggttagtcaaaagatgccaagatggtgtccgtatgtgcttggtcaaacggttaattaaactataaccttcgaaaaacaattaaacttaagaaacaactatatgtctataagagtataagcaagttaatcctaaagacttatttctttttcaaattaacgtgttctgtaaaaatcatcggcgatactattaactcaaattaatatataaatggtcctaaaagcttaaggcccctttaaatcgcatgattgagaaaatgtaataatagaaaaaacacaaaaatttgatatgaatgtaagagtaaaatagatgattgcaaaacataagaaaaacacagtaatgaccgtttgattggaccgcagaaaaaacgcaggaattagaggagagataaaaactcaaaggacgatttccatgaggtagaacctcgtgttagatttcctccaaaatttacgtggcattagacattctataggaattttataggattccaaaagatttcactcatttgattcaaatggctatataggaaaaatttctacagggatgaaatcctctaaaatttttatgaattttttttgaatcaaaggagaccttaataatgatgaacttattagcttatggtatctctctttttcgtgagcacgttttttcaagccaataaataatctgtttttacagaaactatttacgaaagttcattgtcaaaaaataaatatatttcaaaatttttaaaatacccattcgtctctaaaaacaaaaacaagtccaattctaactacgaacctagatactacttatgttagagattttatttttcttttggacagagtactagagtagtacttaatgatttgaatgtgcgctattagcccgtcatgttgtccgtgccgccgtaattaagctcaaaccattcaatcgatcggcgccaaagactacaggatcaacagccagaaaccctatataaacccagctcgctcagtcacaatcctcactcccctcagtgacactctcttagcaagcaagctagcttagccaggagagctccattgccatggcggccaccaccaccatccctctcctcctcctcctcctggccgccaccgtcgccgccgccgccgccgagctctccgtgtaccacaacgtgcacccctcgtcgccgtccccgctcgagtccatcatcgcgctcgcccgcgacgacgacgcccgcctcctcttcctctcctccaaggcagccaccgccggcgtctcctccgcccccgtcgcctccggccaggcccccccgtcctacgtcgtccgggccggcctcggctcgccgtcgcagcagctgctgctggcgctcgacaccagcgccgacgcgacgtgggcgcactgctcgccgtgcggcacgtgcccgagcagcagcctcttcggcccggccaactcctccttctacgcctcccttccgtgctcctcgtcgtggtgcccgctgttccagggccaggcgtgcccggcgccgcagggcggcggcgacgcggcgccgccgccggcgacgcttgcgacgtgcgcctttttcaagccgttcgccgacgcgtcgttccaggcggcgctcgccagcgacacgctgaggctgggcaaggacgccatcccgaactacacgttcgggtgcgtgagctcggtgacggggccnaccacaaacatgccaaggcaagggctgctcgccttcgggcgtggccccatggcgctgctctctcaggccggaagcttgtacaatggcgtcttctcatctagcctcccgagctacaggtcatactacttctccggctcgctccggctgggcgccggcggcggtcacccaaggagcgtccggtacaccccgatgctgaggaacccgcacaggtcgtctctctactacgtgaacgtgacggggctcagcgtggggcacgcgtgggtgaaggtccccgcgggatcgttcgcgttagacgccgccaccggcgccggcacggtggtgaactccggcacggtgatcacgcggtggacggcgccggtgtacgcggcgctgcgggaggagttccggcggcaggtagcggcgccgagcgggtacacgtcgctgggcgcgttcgacacgtgcttcaacaccaacgaggtggccgccggcggagcccccgcggtgacggtgcacatggacggcggcgtggacctggcgctgccgatggagaacacgctcatccacagcagcgccacgccgctggcctgcctcgccatggccgaggcgccgcagaacgtcaactccgtcgtcaacgtcatcgccaacctgcagcagcagaacatccgggtcgtcttcgacgtcgccaactcccgcgtcggcttcgccaaggagtcctgcaactaattaagaattaagattaattaagatgatctaccgctatctcatctagagccaagctgctgctagcaaatgcacgagaacggcttgtgcagtctatgtattctcttcttttccctttctgaaatcacggtgtcctcttgtgggcttgtagctttccgatctgtgcaataaggtatacgtgacatcaaaacttggtcacgggcgcctgtctcatctgtatgtgccaatagggctatatctaggtgattacgtacgtactcagggttttaccagtgtgaattggtatgtttacatcgatcttaaagatcttcatcatttgcatcgctagaaaaacttcatatgagaataccaaatcaagggcagcaattcacaagtatgagtactgaatcgattttttatgtgagcagaattatagacccaagttactcatcagaactcacaagatggcaaccacacatatattccttgcagcaaatgtcactgtgatacataggccaaacagagaacatccgatcagttacttcatgttgttggatatttttgagctgcgggtctgcagcgcgcgtatacaacagggtgaatgccagatcagtttgccttggtgctgttcttgatccactccaggtacttggtgttaccaccagttatgggaagagcgataacttcaggaacactgcatgaacaagttaccagtaaatctgacaggaacatttttctcccgggccggccgaaagaataggccaaccaaattacattaagatttcagggagaaaagttacaagtaaactatagtaaacagacagattgtacagcaagatcaataaactgaatgaagcttactcgtattcatggttagctttgacatgttcagtcaaggcatctagaagagattctctagtcttgattatgagtaactcttcagcatcagtttgcacctgcaagaaggcagattattgatcactaaatcctaggtctgctaaggagcaggaaatacatcatccgaaggaatgataaaccactgaattacaaagatgagaactattaataatctattcagtctataggtaaatttccacaacgcacctttccctcccaccaataaacagattcaatgcctgaaaaatgtacagaacttcagtataattcagtataaacgataatatgaaacaagctaattgcgaatcttggcacagcacctgttgcctaacagcataaggaagggcagcgcaacaatcattggacaaccaaagcaccattatatttcgtgattcaacagagttcttgtttcagtccaaagtaaggtaagcaaagctttaaaagggtttgttcccacatatgatggattttcttgatctaattcgtttacactgccacctctactaaaccttttcagtgtttccattaaattttttgaaggtaataaagatgttttctatggaatacagagggccaataacactgacatatgatctgggttcataggcatatagtgtcagagaaacggaagtgatgagcaaagtgacaaaccaggcactatattgacacaagcagctagtttctcactgatgatgctctgtgacagcttcttccctgcagtagatgtgaaacatgatgcttttaaagactgcttaaacaaaaggcagaaatagatgctaaaattaattaacaaaaaaataaacgctaaacaacaatattgaaaggagaaacatgatgctcacaagacaaatagtgcaagatcaatctcaactctaactgctttatcttggaggaaatgaaatatattgcctagcaagttccacaaatgaaatgcgcacacaatataacaagaacaaaaacacagtaaagtactacctgcttccctgtttggaacagtcacatacacaacaatggatggcacggtggtggaagcggactccatccgagcagagctgagacctcttaccctgagaaattttgcattcagatatcactacaagaagatagaattcaaactagataaaagcgtagcaatgttaacctccaaagttcacacatccatcaatgtcataacatggataaactacactcttgtaccatacttcagcgattcaattttttagcagccgcatgttcggacgtgcctagcaatttcgcgggttccacacaaaatctaagagcaaagaggaaagagaaggttacccgaggaaggggaagcggcggcgggagaaggcgcaccccgtcctgcaggcgacggcggcggcgctggcggcgccgatgcttaggaacagaacgccccggtgagcgacgagcggcccccctctccggcggtggcgcggcgcggtgcggcggaagccgcggcggcggcgggagcgagaggtcggaacggcgcggggaggagtggcatttttcccgacgagcggtttatgtacacgtcagcattttgcttcctttcttccttcctcgcgaagacgcgaacccgatgctttgttcttgggccgggcctttctctggtggggccacatgggctaggctcgcatcgagttcgcttttgttctctcgcgtgatacttaaccctctcgcttcgcttggaacacctccaaaaccctacttccgcctccgcctccgtctccgcggattcttcgagctcccggccatggctgaacccgaggtggtggttgccgcaggtggggaggcgatggaagccgaggcggcggagccggctgcggcgaatccgagtcaaaatagggagagggaggagggggatgactccgccgccggcgctgctggcgaggaggcggcggagggagctgcggccaagaagcaaaaggtggagggggagggggaggcgaagggagcggaggatgaggcgaagggggaggaagaggagggcgcgaaggaagaggaggcgaagccggtgaagctgggacccaaggagttcgccacgggcgtcgagatgttcgactacttcttcgccctgctccactcgtgggcgccgcagctcgagatcaacaaggtgagggttgcgattcggttgtcaatcgtggccggcctctcgctgtttttggccgcgaaaaaaagtttcttgctttattgatgactcgcgaagtcacgatgtgtgttgttgtagctaaactttggtatgataaaagttttatccttgtagctgtagtgataagctggtaggttatttaattagctttagtggtgtataatggtgcccgtattaggtagtactttgcctttgaaaccggtgatccaatcggctaaataattcgacatgataatctgagtgttcgccttgtatttagccaagtttgcatgaaactccatagagcccccagattcgttgagttgatctgtcactgtcaaggatgtttttaagcttggagaggctgctttatgcatttcgtatgtatggtaggtacttctaaaccaatgatctttgttgggttgagttcgttagcaccagtgattggcacttaaacattatccttctttcacctagcatttctttaggttctcatgggcaagtttcatttacagaatagcatatggcgttgaatactccgtagagcccccagtttcattgggttgatctgtcatggtcaaggatgttttagacatgaggttatacaatactaaacgcgg

SEQ ID NO: 3884 - DNA, 772 bp, Oryza sativa
  unsure (1)..(772): unsure at all n locations
caacggcgcggcacggggacgccggtagcggcggcagcgcccggctggagtccgccgacgagcggcggcgcttgggctcacggggaggagggggttccgggcatgggggagcttgggagagaggggaaaacggaggaggggagcacgagggtgctttatatagggctcggggatggagatcgtggccgggagaggcgggatcggccggtgacgtggggaggtgaagtggagctcgtggggaggtcaaaccggcgccgtttcttgcggggtgagtgggggaaaaggtggaggacgtggagggggtcgtgtccacgtggttagatgcgagctcgggtgcgggagggcgctggattttgcggcgacatgggcggaaatggcggctggggttggctggcgagaggtaggaggaggagctgacaggtgggaccgtcggccggatggagagagaggagggaaaccgggggacataaagtagactttcgcaaggcgcgggccggccgagagagagagaggaggcgcccggcccgcgggagaggaggggaaggcttgggccaagcccaaaagggaaggaaggagaattaaatttgttttctttttatttaattgtttaaatgatctttgtgactttaaaattatttcttgagctccgaaaatttgcggaaaaatccggagagtattttagggcacaaagaatattacaaaatattctcagnnnnnnnnnnnnnnnnnnnnnnnnnnnnnnnnnnnnnnnnngttagatcattcaagccgt

SEQ ID NO: 3885 - DNA, 852 bp, Oryza sativa
ccttgcttctgataacatgacggagcacactcttgtgcactcaggggttacaactcagagcagaagtacatggttctcctgtgctctgatctgagaaggttaatgctttttcttcatccagattctgttgatgcttaagaactccctatttgcattgcactgataaaagtgaaatgatatttgtagaaatctaacctttgacagtaaacactaaaaaaaagaccgaagatatctgaaaagtctgaacttgctcttttgtctgacagttaattgtccaacattgtgttcatcatttttacttgtgcagatcatcgttgagaccaggactgtacacaccagcatatggaggcttctttgaatatgaccttgaaaaggagaagaagatctccttgagaactctggtgagtgaatgaatcagtgactctgcatctgcacgatcaacacaacacatctaggaagtgaaatgaacaaacagtccgaaacctgactcgccggcgtgcgtgcagatcgaccggtcggcggtggagagcttcggcggcggcggcagggcgtgcatcatggccagagtgtacccggcggcggtcgtcgacggcgccacccacatgtacgccttcaacaatggcagtagcacggtgaaggtgtcgcagctcaaggcatggagcatgacgagagcacaggtcaatgtcaggaagggatgaactgattgattaatcaaaatggaaacaagagagcaacatattacatgctaattgtccagtaagtagttaattgactacccattcatcagaactcctttggtaggaataagaaggaatgatgaactacttgcagtagaacgcattctatgggcgc

SEQ ID NO: 3886 - DNA, 58647 bp, Oryza sativa
  unsure (1)..(58647): unsure at all n locations
tgattcnnatgagtatctcgttggtacagtagttcatcagtcgtttccgaagagatgttaccgattccgaccattttcaccccttaattccttgtagatctcccctcatctactattttttaaattaaattcaatacaaatgatcgtgaaaagttctttaaaaaaaatgacaatgtagatttcagtaacatttaccactccaacaacacttatcttcgactccaaactttaatttcctccattttcgttagcacgttttttaaaccgttaaatgttttttacgaacttttctatgtagaagttgttttaaaaattaaataaattattttttaagtttataataattaatgcttaattaattattgagcatgtgctcaatcaaccttctcgtttcgcgtgcgctggaaatctccgcgatgtaagaaaacggacgccggcctaggttcagactcgctcagtatatcaaacagacaaatccacgcacgtatatattgcagcaatgctattcataactcataagttggattttatctttttctattatttgtggatgttattttgcgaagttgtatatttatgttttatatatgaattttcaactttttttaagattttctcatgataatttgaataatgtttgaacaaagagattaaatttgtctccaacatgcgcacctatgcaactccatcaactggtgcaagctggctagcatacgagattagatcttaatcaccatcctgctcgtgcattaagtagtaacaactacactaagcactagtactaactgcactgtacctgtgcaccatgcaacctggctaaaaaaatgtcgttttgacatgagcaaaaaactaaaaatcaaagaagacaacaaaaatccaagcctgctactagccaacaagaaaacaagaaaacggtcgggtaatcatgtcgcggtggaccgtggacgaacaccagctgctagcttcaccttcacacggtggcttccggcgagtggccgccgccgccgagccggggcggggaggccggcggcgtgtagaacggcgtctcgggctccggctcctcctcgccctcgctgccggcgccggactcctcgtcgatggtgtagagcgcgcgcgaggcggcggcggtggctggcccgaaccaccgatccctccacgtgttcacctcctcctcgtcgggccccgccgcctgctccccttcctccccctgcgtggcggcggcggcggagtcggccggctccacgcgggtgaggcggcggcgggagcagaacaggaggcggagcagcgctcgccggagcgcgctgccgccgccgcggcgccgggccggcgccggcttcttcgggctctggaccgtgagctcggcgtcggaggcgacgacgacggctggttgctgcctgtttgctgccgctgatcggcggcggcagcgccagagcaggaggagcgacgccgcgaggatgccggcggcgagggcggcgagcgccgccgcgacgacgacgagctcgacgacagcctggcgtctcattgtcagcggctaactaatcactctcgctaaatcactctgctcgaagctcgatcgatcgagacgatgaagtgaaatgtgtttttggatatatggccaacgagatgactccctgtgagcaaagagaatttatgtctcttcttttttgattttttgatgtctttaacgttggcttctttaactttaagtcgaatatttcccggcgatggttagtgggagagaaaggaggaggggtacttttgggatttcgactttgcgttatcagagtggggcccagttgccagcgactcatatccagaatccggctgaaaaagatcagaggatatgtgttgtgtttgtttagcttgattgatgtggtgttttgccaactcatcgcctgcatggcatgaaattgaagggcacgacgaactggtcgctaaataacgtgcatttcggtgtccatatgaaaaacatctctattcatggcagttgattgctgctgctgcagactcggtcagtacgtacagtatgcagtagccaggaggtcagggaactagtagtatttcctaaaaaaatataaagctaatgctaaacagtactacatcatttttaaattggatgacaccgttaactttttttttaacgtttgatcattcgtcttaattaaagatttagtataaatgtgtataaatataagtcaaggttatattttatttgatgataaaaacaagtcacaataaaataaataatatttatatttttttctaaatgaaacaaatggttaaatattatgaaaaaattaacagcgttatacatcttgaaatagagggagtattttttcccccaaaataacttcgtttttagtcttatacgtgcaaaacaagaaagattaaagtgttgttaaaaaaacaggagtagtattaacggtaaatagattagggctgattaggcatattgaaggaatcaagctgattgatttgtgaactgaggttagacaggaagatagaaatgaaattaatctgtgtatcgatcattgcagaaggaacgacaccacactgcacacaacactttagctctttagtttgtgatcttttactactacgactacgacctctttaggctttagcgaaaattaatttacagcgcaagcaaagtaaaagcaagtgcctttaactcggatctcgtggacgcagtcgtcggtgccgacgcattcacctacacggcaaattctattcaggtgcagcattgcagcctacggcttctctgaaagaaacaatgcagagacttcacttgcagggtgtagcacagtggtagcacagtgttcccctgccacaatttttcttgcactaatttgcgctacatacaacgtagtactacattcattattgtaaagcaaacattgtactgtagtagatacaaatgatattacataatagtgatatgaggcaaaaaaacgtcatactcatctggagtacaatctttaatttacagtccacctaaaatgtactccctccgtgttatttgtatgacgttgattcgtttaaaattaaacaaaccaactttatatatttaggaaaggaggtagtactagtgaatagagaataaactatattaaacatatttttatacgggtagcgagattgtccacttgtagggctgtcggaggcgatggcctatgggtccttgccgcagcccatgagagcgtgagtgagcagcatggcgccgcggcgggtcgcctccgccagccggccgaccaccgggaagctcaccgtgtccctgttcttgagaggcttcttgtcccaccagtcttggtgcttcacaaccttgccgtcctcgacgtcgagcgtgatgagcgacgccaggtcgatggccctgcccaggaacttgtagtgctgcttgttgtcgatcagtatctgaaacagatcgattgattgttaattcctctgttagtgatcagcatgatagtcaaacactgtcgatgaagtttgggttgattagttacctcgacttttccgggcgcggtttcgttttctgtaattgtgtactccacgattttggattcaccgaataactgatgaatcatacaggcatagtatattacagagaattcagtttgaaataagttttggttgtgtggaggtggaacatgacagatatgatgttaccttggggagtgtgtagaaggccgatttgatctgcttaaccctggaatgaaagaaagaatgaaagagaagaagggatattttttttttcgggaatacgtaagaagcgcatctttgtattaagaggagtaaaagtctgtacaggttaaagggaaaacacagcaggagacgggattataggaagtcacccaagaacattaaaccctaatctcgcgatacaatgttgcgacctgagcgctctaaaggcgtggccggtatggcagtattggcgagccgccacagcgctgcctcttccgccattgcccttgccacttctgtccagcttctgtgcttctggttgaacaccctgttatttcgctccttccagatagtccatgttgcgagagtagcaatggtattgaaacctcgccgttgagagctcggtaaggtttccctcttgtcacataactaggagtggaatgaggtttcattgatgggcaagcattccgagtagggctgtcaaaaaagctcgagactcgcgagcagctcaagcttggctcgtcctaggctcgattcgagctcgactcgagctccaaacgagccgaactcgagcttgagtaaaagctcgcgagctttaccgaaccgaggttgagcttctaccgagcctaaccgagcttggctgtgtacagtctatattgcatgttcaccttattaatataataaactaatagataaatatatatatttgtatctatttacacaataaattagcatgtgttagcacaatatatttattttaatcattttctactcttttattagtgtgattaactagaaaataattagacttatcaagagattattattaaaatatatattatactacttatggccgagctcggcaccgagctcgagctcgagctcgagctcgaacgagctcgaaccgagcttgcctaaaagctcgaaggtgcaataggctcggctcgagcttgtgtcgagctcgagcttaggcagacgagctcgctcgagctaggctcgttgacagccctaattccgagcaaccgattgccgagagcagtagccaccagagctgtcttgattctgggcatgcgaccaaaatgtggttgatgctttcctcgtactgatcgcataggacacacatgctgggatggggcaagcccctgatgcttaacctgtccgccgtccagcagcggttgagtgcgaccagccagctgaagtaacggcagcgtggcggcgccagcgatttccagatcggcgtggattggaacgggattcgaccgaggaacaatgcttggtaggcggagcgggaggagtacatgcttgaactttcccatttccaaataaattggtcctggcgatccgagagctctatctcccgcaacaacgaccagagattgagatactctacgatggcctgcaatccgagggctcctcatatatcgcggatccaagctctgttgagtagcccctctgctaccgtccttcgtcgtcgggttcgcttgggtactcgatcatagagtgccggtgctagtgagcagatgcaggaaccatctagccaccggtcttcccagaagagcgtagtcgtgccatcaccaatctgtcaagtcatggatgcagccacgaaacactgttctttcggagaacaggggatggaaaggccttgccaaagaagaagagatatgatggatcgatggtgaggaaacaaacgtagacgtacccatgagctcgcataagcgggtcctcgaatgtggcatgcgccgcgtaaatctcgaagtcccgagccgtcgcgcacgatccgtatctgcaacatatgcgtgcaacttttttttttttctgtcttgtttcgtcaccgaatcaacaacacagagctaagcagagaacaggtgaacgtacatgttgaggagatgcggcatgatgtgccgggagacgggcgaggctgccttctcctcttccatggctcctcctgcagtcgtcgtggtggagaagaaggagaaccagagcccgtcgacggcggcggcagcagtcgcgcggcggagattgagcatgcaggccaggatcggatcgagcggcggtggcattcattcaaatggcgagaagagaagcgtactagtctagtctagtcgcctaccctgccgtggttgactagtccagttggcatgcgcggcggaggagggcgctacgtcggcgggacaatccggtggcgaggacgacgacaccacgacgcttttcttcttcttttttcctttttttcttcttttttttttcgtctatggaacacttacggcccagaggatttttggtagggaagtacatcaaaggtccctcaacttgtcatggagatacaaaaggaaaaggtacaccgaagagaatgcttgatggagattcttcgccgcgccgagcagacgaccaagaccaagactttcatatgacagaaacagcaccctagcttttcctgttacatctcaaattgtatttattttgttcgcctagcacctaagggagagaagaatggaaggaggaagtagaaagaaagtcagtttcatcagtacataatcacaggtgttgcttgatatattgtaggaccaggtgtgccattgtatcctgtctacagagcagtattctgaattcctgattgttcattaatgccatcatggtagattaattggttatatcatctgaaagatccaaatgagcatagtgcagttaagtatagcaccaagttcactggttgttaacaagactagtactgctacaaagcaaatactccaatggaggtaacaagagatattcaattatcaggtgcaaactcatatatcatctctaatcattaaaagaaaaccgacatgttccgtataagtttctgacattttgcatgcaaaaagctatagtaattttactttgaactctgaagatacaacgccatgaagctaaacccaagcaaatcaaactgtctgagccgatcgaattacatcagaatccacacgctttggtctcatcacagattgcacatgcgctctcagcatgtgtgcctctcagccgggctccgtgagcgcgatgtcggccttcttcagtgctagcgcgtgcgatgttggctgtgccgatgtcggccttcttcagcgccagcgcgttcatgccgttgccggtcatcccgcacaggtggccctcccgttgaatgatcctcacgatctcgtacttgtgctccgggaacatgccggcgtccaccggaaacctgaaattacacaaaggatggaacataagttgcctagctactcaataatgatggattcgatataccacatatttttattaaagttctctacctcaattaggtttttgtcaacagtgagatggttgagagtgagagttccaattttgtcacagcagagaacatccattcctgccatttcttctatggctgtcatccttttagtgatagcaccttgccaaaaattaattaattttagtaatgatatgtgatatactgtctgttaattgaagaaacatgacaacaatatcttggacacacctgttgagacaggtgatgagaacctattgcaagtgtgactgacagaacagtaggcattgcgatcggtatccctcctctcagaagaacaagaacattgttgattccatctccgtatgaccggtgctggattgggaacatgattataacctcaacaatcacaccaatggcgattgagcagatacagaacttgcctctggaggtaagaacctgaaaattcactagttagaaacagctgacagcacatccacttgcgaggttcttataatcttattacagtctgaagattgatgaatcaccttctgaaaatgcccaacaacctcagtggagtccactagatgagctgccttgccaaagaaagagtgtatccactagattcagaggtgacagaacctaaactagacattcatgcaaagcatgtattggatctcttagacggccgtctatatgctactgtgcctcaacagggtgtggtctcaccttaacattggggatgcatttgcgttggaaatccatcgtatagaactaattaatagcaaaatgcatcaaattattaggctactagctttataccaatctgtgcatcatagttttttttttcattgtattgttctcaatactcatatcaaataatttatcgtgattatattattgattgttttttgtgtagttcctgacctctgattctgtagatttgctacacctcatgtatctatatgcaaatgacattattgcttagacagaaacaacagcttgagtctccaccaagtgcagcgtaaacaccagtatggtaggagtaatttcttatgtaacagtaacatgaggagaggaaaccaaaagccatgctgtgcagagacaaccaatacagttaatcgttaaaaagataaatgattccacattactattttttttaacacaaaacattagccaaaattagtggcgtggaataaccttcttccacgaatcgctaacctagttcttactcaggatcaagataagtttcattggaatttaacccaaaatggagagttttcagtgaagtcgcattatcttgccttggtacattcagatttgcccaacataaacaaagtaatttggaaattaaaaataccgcttaaagtgaagatcttcctatggtatttacgtcgtggggtagttttgacaagggataacctagctaagcgcaattggcaaggaagtaagaattgttgcttttgtcacaaagatgagacaatattacatttgttttatgagtgcagatttgcccgttttgtgtggtgcattatacaagtggctacagggcttttcccgccacgtggtgtatccaatatgtttggtaattggctacggggaattaggaaagacttgaagtcacttatcctgttaggggcagccactatttgttggtcattatggctttgcaggaatgatatggtgtttgacaaaagaaaaatctcttctcctttacaggttatttttttaactatccacttccttcgtacctgggctatccttcagaagcctggttcacgggatttggttgcagcggcgtgttagcgcttggagcaggtggtcagggaatgttttacccagggacatgggtggcggtctagcctgaagattggtgctccctgatttttactgctttccttctcttgttacaaactcttttgtgggtttgtgtgttttggctgtgtgcatcctagttatgcagaggccgggagttttcttagtatggttctatcaacttgatgtaatcgtctgagattaataaaagcttcctttatcaaaaaaaaacattattaagttgaacaacagtgaggtaaacaagcaacatgcttccttattcagctccaatgtcccagaagcaacaatgacagtttggatctgtatcaggcaatatttgtgcaagtttctgccttctgcatgttttatttgtggataaaagtaggactaaagaagtagaaatgacaatacccagaagcgaggtagatgatcgtccacaagaatagccatcaaggagagccaaaaccaccaccaccaggagtgagaatctgaagaatctcaccagcattaaccataacagtgttcttccctccaaggtaaactctacgaccatctttcttgacgagatagtttgcaccacgggccccatttcttcctcccttcagtcccctgggagcatgcacccttctctctgaaagaatgctcacaacaacaggctggcaaaattcaatctctctcacaaggccatcaccacctctgtggaaaccagaacctccactgttctccctgatgctaaatctatgtaaaagaacagggtatcgctgctcaaagatctctgggtcagtcatccttgtgtttgtcatgtgacactgaacaccacttgtaccatcccaactcgccccagctcctgaaccgcctccaatggtctcatagtaaccgaaggtgtcgtctccaaatgtcaaattgttcatgcaaccctgggagcaggcgcatgcttggaaagccattaggactacgtccgtcactctctgagaggtcaatacattaccaccaaccactgcagctttgtcacttggagaaaggaaagagcctttaggaattaggatcttcacaggagctaggcagccttgatttagaggtatatcaacgtcgaccaagcaccgtaagcagtatatcacagcagccgctgttactgcttcaggagcattccagttaccatacacctcaggactggtgccttcaaagtcaaaggttgcttcgcctttacttgaatcaagggtgagcttcaaatggagcacagaaccatcatccatgtaatcttcatcttcgatgacacaagacccattctccttttcaactctcgatgcaactaccttaagcatttctctaacagcttcttcagcattgttttggacatgattcatataagattgaacagtgatcaaaccatactgatttatcagttctttgataagtgttattccccgctggtttgctgccacctgagcatggaggtcagaaagattatcttggatcttacgtgttcctggaatcttatggtttgtaagttcatcataggacggtgactgtagcaagtgaattattccttcctcttggaaaacacctctctcaacaagtttaaatgctttgatggcagcaccttcctcccagatgctttttgagaaaggaggcatgcttcctggggtgataccaccgatctctgcatggtgacctctactagcaacaaagaagataactttaccttcattgaaaacaggtgtgacaactgttatgtctggaagatggctacccccagaacatggatgattcgttacaagaacatcaccctcatggagattatcaccccaatatttgagttgccaacgcacggtgctagacatggctcccaaatgcacagggacatgaggggcatttgcgacaaggccaccatccggaccaaagagagcacaagaaaagtccagtctttcctttatattggtagaaatagaagttctttgaagtgttcgacccatctgttcagcaatacccatgaatcgatgattgaagatagaaagttggaccacatcagcaactgtctctgatacttctacactgcttggagcagcacttatctcaatttttatgttaccatacttggtgatgatagctttacagtctttttctactatcactgtactgttcccattcattataactgcaggacccttcaatacatgcccatagcccaaattctgaagcttgtaaagtggtgtttcctgccatccgtatgaaaaataaattcgacatgaactttctggcacaggtttggttgatactggtgtcagttcatgaggctgcaagatatttgtagcaccaactccctgaaccctcacatcacatatgagtatttttctgtttaataatttgaagccatactcttgctgaaacagtttcacaaactcatcagcataatcacttccagattccctctctggttgtttaaccatgattgctgtatcggttccctcgtacctcaagttcaagtatgaatgtgtcctgatgctgtcctctccaaaaccctgctctattaacttttctttcacctgcttaactaaaagatctactcttcgagatgcctctgcagcagaatcaacattataaatagcagagtatggctcttgcaaatcttcaataacatcagcaaggcccattccatatgcactcaatatgccacagtagcgatgaataagtaactcagacatgccaagggatcttgccatagcacatgcatgttgaggaccagcaccaccaaagcatgcgagagcatggttcttagtgtcatgccccttcatttcggtcaactgccttataggtcggcacatcgcctcatttgcaacattaacaaaaccgagggcaatctcctcaaccgtcatgtcctttgctgatggatcctgactctttcggtgagagtttatctcaacagcaagaatctcaaatgcctttttagtagcgtcataatcaaggggtaaatcttcgttaggaccaaatatggatgggaagtactcaggaataacagttcccagaatcaaattggcatcagttattgccagctcaccaccttttctatagcatacaggaccaggatgtgctccaacagaatctggcccaaccttgaaagctccaaactgaaacttaagcttcgatccaccaccagcagccaccgtgtttatgtcaagctggggagcttgtattattgccccagcaatttgggtctccagaacttgttcatagcttccatcgtagcggctaacatctgtggatgtaccacccatgtcaaatccaatcagcggttttgatgtctcaagttgaaacaaggtctgagagtagccaaccacaccacctgcaggacctgacaacactgctttgtgcccggagaatctcctctctggtgccagaccaccatctgactgcataaacagcacattcacctgctcacctcccccttcaaacctggacatgaatcctgataggtactctttgatgactggtgtgagataagcatccacactggctgtcaagccacgaggcacagcacggaccatcggcgtcaatgatgaagacaacgatacatgcttgaatcccatctcaagagataatttctcaatgagaagctcatgctgaggataagtatatgagtgcattaaaaccactgccaaacatcttattcctttgtcaagcaaacctttcaacaaaggcttcaatgcttctacatcaaccggcttcgccaccctgaccaattcccctgagatccctttaacagataaaccatcatccctctcaccatcaccaccaccaacaagttcaaccctctcatcaacctcaaccacctcctcatacaaattcgacggctttgacaccttgagatcgaatatgttcggccgagcctggttaccaatctgaagcaaatccctgaatccccgggtgacacacagcgcgatcctttcacccttcctctcaagaagcgcattcgtggccaccgtggtgcccatccgaatccaatcaatcttgcccgtgggaatcttggacgaccgcgggatcctctccccggagaactcctggaggatcctcctgatcccttcgatgggggcgtcgtcgtagttcgacgggtcgacggagagaagtttcatcacgtagccttccctcctcccgggcacctctgcgtagatgtcggtgaatgtgccgcccctgtcaatgcagaatctgaatttctccgtgctacccatcctaacttcgaggtactctcagaatctgcgtcctctgcaaaacaccaaaacagcagcgtagatgcaggcaattcagattaatctggtaatgggtgatggattactgtaataagtagaaggagttgtagcactgagctgtgctgtgaattaatcaaacaaagggggataagagcgccaggggcggatccaacttgggacatggggggttcagttgaactcccaaattttgggggaaacaaacaataaactgttacttgtattttctcgtgaaatagcttcttccagaactagaaaagaagctaggggttaacgaacgcaagcaaattccagacagacgtagccccggtggggtgggagagagagagagagatgaatcagaagctcaccaggatcccctcccctgctctgctcgccaccgtgctccaaccctgccaccgtcaccgtgctgcgtcgccccagttgccgtgcgccgtgctgccgccgtcaccgtgcgctgccgcctaaaccgtcgcaccgagagaaggagggaggaagcagcctctggctctgccgccgctgcctcgctcgtctcccctttttctcctcgcgataaggcccgagtcgacgagtgggcggcgcgacggttcggctggatccaaggtaatgcgatggcatttcctgtaatttcgatgaaaggggacgggtagcgctgtaattattttcagagtaggacgtggagccacgttttcgccactccacctcgctaagtcgctagtactctgtttctaaatgtttgacaccgttgactttttagtttgtgtttggtcattcgtcttattaaaaaaaattaactaattatttattcttttcatataatttgattcattgttaaatatactttcatgtacacatataattttatatatttcacaattttttttaataagacgaacggtcaaacatgtgttaaaaagtcaacggtgtcaaacattttgaaacgaagggagtataaatttctggagcgattcacttggctcccgctccaattgaccatttggccgtgggaatcttggacgaccgcatgatcctctccccggacaactcctcgaggatcttcctgatcccttcgatgggggtgtcgtcgtagttcaacgggtcaacggagagaagcttcatcacgtagcgctagcgccttcccctacctcaagaaccccctcccgatgctggacatcgctgacggatcgtttggctccggcgccgcggcgatgtgctaggactgcggtaaccaagcaaagaaagactgtggccaccaacattgccgcacgtgttgcaaaagccgcggcttcggttgctccatccacgtcaagagcacctaggtgcccaccgctcgccgccgtgagcaccaacagctcactggctcatccccgtcttcccccgcaaccgcctctaccacagccaccgcttccgcctctgcctccaagaagccttgccttctcacctcccaaacgacgacgtcgcacaccttcacctccgatgccaccacgcccgcagctttgacaccacctccagccatcaagtaaaacgccattgataccagcgcatgttcatcaatacatacgcgcaattcggcatgtttgtctcctacgaatctacaaacagctcaaattattaagcttgtgccattttttgcagatgtgttgtttaggagagcttgccaatgcaggtgtgcacaccggtggtgtttaggtgagaggagaggaaaatatgaaagaaaaagaggccgacggagaggtggccaggccgccgctgctccctatcgccgtccccaccatcgctccccaccgccgctcggggcaaggtgaaaaaagaggccgggggagagaaagagagataagggagagagagaggggggaaggaggaggaagaagggaaggaaagggagaatgacatgtggggcccacattgtcgatgggtcccacttgtgtgtgtttgtgagtgacatgtcagtcctacaaaattacaaaattttgccttttgttttactctagttccacataagcaacgcgtcgacgacacgtgggacgaagaccggatcgacagtaccacgtaggtgccacgtcagctaaaaccgcttgcaaacccacctaaggagtcaaattgtatctgttttaatagttcggggagttttcttatccagctttctggttaaagggcacaaattagattcggccgatatttaaggaagtcaaatgagctttttccttgtttaataataaatccctctgtcagccgcccaacaaataccagcgtaatcaaatcatatgatgtggcaattaatattagcagcacggtttttaaatttcccctcgtgatcgcgcacaagatgtagacaagatgctccgtattcatgacatgcaaaatagatgattatagtactttgaaatcgcaaaataaacatgcggacaacctttgttataccacccgtctcacggccaccggcagatcggattattaactactccttgattagctacagtactttggaaaaaaaaacgttgactgatcaaaatttatacggcgacacataaaagtatatcctaaatttatttattttgacgcacattattattgccacaacaaagccatcgcacagaataatactaacatattagcatagtacacgtattccaaatactagtttccactgtgtgcacgacacggtatgtccggacgtgcacgtatctccattgctaacgtattattaccactataaatacaaaccggtcaagtttgaagagtcagtccaccatcggttctgtacatagtaaaataaaataaactagcaatacatacaggaagcataaaagatttaattcaaatccaaatccaaactcaacccaaagcttggcaagggttatacacggcgttgatcatgtggctcacacgcggaggagtaaagacacgagactttctgatccgactagaggccacgtgccacaagcatcacacagaacaagaggcacgcacacgagaaaaacaaaaaccaaaaataaatagggagagagaggaaggggagagttttatagcgtggtgggagtggggagaccagaccaggaaaggagacggagacccgattcgttcccacctcctcgccgcccaccgctctccatctcctcttcttcctcctcctcctcctctcgtcgtcctcgtcgccgtctcgtcttctatttatttaggagtatttttttttcatctatctatctgtatctatctataccccccgcctccccgatttttcttcttcttcctcctcttacctcgcgtcgccgccgcgggcgtcagcgctcgcgtcccccgtgtctcgtttcgtccatcacaactcgctctccgtgcggcggcggcggcggcgatccccgatcgggcgactccggcgattgcgaggtaactagcgtctctcctcctcctcctcccttctcgaggttcgctcgatttgggcgcgtgtcgaattcgggaggctggtttgctctgattgggcttgtacagattgcttgcttgcttggtttacgtgcgcagccgcagcgtgcttgttttgctaaaagggcggcttggagaaatttttagctgacatcgaccgagcttgttgcgccgccgccattatcgtgcgacgacttaactgaatccgtttgcagttttctgctatgcggcgtcagttagttcagtttcctccgtgcggggggtggggcagggtgcggtacatgggtgggggcgatgaactgtgtggcacatcgaatttactgcagtaatctgacaagggaattgcaattgtaaggatataagggaactgcttctgctgtgattctcaagtgctgcaaccctaggtggcttccgcagtgcccagcccaggtggtccaatgacttgtacagtaggatagttgctactcgtgtgcacattgcacagtaggtggggtgtgtgaagggccacaaaacacctcttgttattgcttcttttgttgcatatatgctactgcaatcagctatgattttgttcagtctgtgatttgttaatagacagttgcccctgtccgaatgggtcctctgaatgtcaaaaatttctgccactgtttcatcgagcttttttatttgtgggatgggatttatatctaggtgatattaactgccacattgaattggttgctagctgttagggagtatttttcatctgtcagtcagtggaactcaggtctgcagtaagtttgttcatgattgagagcatatagcttatatctcacccaactgctaacttcaggcagataggaacaattacactttattttgttgcatgctatccccctctgtggatctaaagctttgctgcccatttttagatccatcttgcttgtcatgttttctctacttcattttttaacaacagtttgcaatgcattccgttttgggcaattatatgatatacatttttctgcttattaatcttaacaggttgaaattaatacattgatgctgtatcatcacagaggcggtctttcttaatcttcaatattttcttagagctaaacggttatattttggtgtcttcttagcaacaatgccatctcttcagttattgcaactgacagagcacggacgcaaccttttgtcttcgagaaggtgtgctgttttaacattgtctttctaaattttagtaagtcgatcatttagttcttatctcatgttccttgttctttacaaacatcaacaggagaactcttgcagttgtttctggtgcgttacttgcgggtggaactttagcatatgctcactcagctcggcgccaaaaacgtcaggaagaatattctcatagtgatgcaagtacacagaccacgggtaatcagagcatttgtcaaaatggtgttgatggtaaattggtaaaaacaaggaaaaagaaaaatgggttgaaatccttacaatttctggctgctattttgcttaaaaagattggtccaaatggaataaatcatcttctcggcttgatgataacagctgtaagttcgatggttctctttagtgtgggtgtttttgtttgacattctgataatattgttctgaatttaataacttgtatggccatctatgctctacaccttgaatgtgtattctacttcatggactaagcatattgtgcttgttatctacatttccaagtatttatctgcattttatgctagagtttaatatgttactgagctttgctgacttggttgctgattagttatgatatgttgtatcagttagttaaactctcgatcattgagctatagcataccatgataggaagtaccatttccagccttgtctgactacatgtaaaaactctatagagcttgggttttcatatttcttttatataaataaaatcttgcttctgcaggtgttacgtactgccgttggccacagattagcaaaagttcagggctatctattcagggttgcatttcttcggcgtgttccaacctttacacgcctgattatcgaaaatcttcttttatgcttccttcagtccacaatatatcagacctccaagtacttgacagggtccttaggtttgcactttaagaagattttgacagatcttgtccatgctgattactttgaggtatgttgctttatgaagttgaaatcttcattctttttgcaccttaaatttcacatgattacacttactgtttatttttttctttctccacgtatataatctactccctctgtttcatattgtaagtcgtttgactttttcactaatcaaacttctttaagtttgaccaagttaatagaaaaatatagtagtattatcaacacaaaacaaacatattatcaaaatatattaaatgctagctttaatgaaactaatgtagtattttagatgttgctattttttttctataaacttggtcaaacttaacaaagtttgactaggagaaaagtcaaacgacttataatatgaaacggaggaagtaagatacttgatactctccaattacgcagtgaacagctatagttaattcgataggctttgttgatagaataattgatgaacagtgagacaaaatgcttgctacaaacagagcaactgaaaaggttaccttattcctgattatagaaaagcaatagcacaccttaaacaaaaaggaggctatttacttaagtcagttaaaccccatagagttaagtcactcctgttgctgaaatgtacaggaaaatagaattactgtttcatcttttcggagttttcagtctatctgcacgaataccaaattttcccttcttctgtagtgaagtttttgtatattacttgggtttgcagctacttctgtagaatcgttgagtcaaatagatatgaaagttattataggtcacattggaggttctagttatttgactttgactttttgtactcaatagctttccatgatctcatgctgtagagttcatcatgtaaaatgtagatcgattagttagctcatctaatttccttggaaaggtatccaatagtttggtcaattgcttgacgattaatgtgttgaactgcatatttaacattacatgccattgattctttttctcccaccttttgtgtgcagaacatggtttactacaaactctcgcatgtagatcaccggatctcaaatccagaacaaaggattgctagtgatattcctaagttctgctcggaactaagtggactcgtacaggatgatctgactgcagttgcagatgggttaatatacatctggcgcctctgctcttatgcaagtccaaaatatgttctctggattctggtaattaactcccccaccccaccccaatggatgcatgcatgcatgcaccctacaacacacacagagtaaagggttgttacgctttgtgaaatataatatgacaacctctcctgctctttcacgtcaaaaaaggaaatgaaacatcttatgacaatggttgaaaagtagtactcctagtttgagaaaactgtgctaccttaatgtttgtttaatatatattatgactactagcttgctcattattatatagattgtcaacactggtaaattgctttcaggcatatgtacttggtgctggtggtgcaattagaaagttttctcctgcttttgggaaattaaaatccatggagcaacagctagaaggggaatatcggcaggtccattcacgtttgagaacccatgctgagagtgtggcgttttatggtggtgagaacagagaagcatcgcacatcatgcagaggtttcaggctcttgtgaagcatttgaatgttgttcttcatgaaaactggtggtttggcatgattcaggattttcttcttaagtatcttggtgccaccgttggagttatcttgattgttgaacctttctttgctggaaaccttaaacctgaatcatccactttaggacgggcagagatgttgagcaatcttcggtatcatactagcgtcataatatcattatttcagtctcttggaaccctttctatcagttcaagacgcttgaatcttctcaggtaaatgcactgtccttgtgtgaaatgcttgccctgtcatgttatttttttttgggggggggggggggtgcactgtcacatgtttaatggacattgataaagtagttgatgatacttgatggttcttatgatgtcatatgacatgtttaacctttatgtaacctcaggttcatattttgtttatttagtggaactataggttctatctatcatcatcactctagttctttgctactaagaaattagttattcactcttaaacttcgtttctggagtacaaacataaaattttgacttgtggtttctaaggaatatattggtgattcatgttttttgtgtgtatcagtactgttgcgaatatgcaatttaagattatctgttgatatatttgagtccatcatattccaagaatatcttgtgcattacaagtatctatgacttcataattccatttgataaatatctttttgctgattaactttctattctcattaacagtggctatgcagatcgtattcgcgagttactggatgtttcacgtgagctatctggggttcgtgatctatctatgaataaaaaatcttctgtagacaattatatcagcgaagcaaattatatagaattttcgggtgttaaggtaatcatgatggggactactagttcttctgtctgtttggtatgaagaattctaataaatgatttgttacaggtggtgacaccctcagggaacgtcttggttgatgatttaactcttcgggtagagtcgggttctaatcttttgataactggtaataatctataccaaaatatgtgtcctcttagtttggatttgcgattgagctattgcaaattcatcatgcttattgtaatgaaaacctgatatttgcacatcactttttaacacgcccaatacaagttcttttatgattgccatctgatgtaaacattagttgacactgggtaactactgtgctgatgggcaaattgtattatgccgagggaaagggcttaggagaagcgactggaatggacttttggaatgagaacatttattgtttatcttgctcccctcgttggcaataactgtcctttatgtagtgataacacttaacaactgtctaaacttttgatctaaagataatattagataccatgcactccatatatccatggatgtaggttgctgtcggatccctgtgatcaaccttaaatttgactcttaaatgtacgcataattatatatattctttctagacattttgtttgtatatgtgtgacactacttgtatgttttggtgctttttcatgaaagttacagccatggaaactaattttataatgcatgtttgctcattttcaggtcctaatggtagtggaaaaagctcccttttccgggttcttgggggactgtggccacttatgtcaggccacattgtgaaacctggtgttggctctaatcttaacaaagaaattttttatgttccccagcgaccatatacagccgttggaacacttcgggaccagcttatctatccacttacagcagaccaggaaactgaaccacttagctatggtggcatggtggatcttctaaagaatgtaatactcataattatccacttgatagattggcatctttagctgcctcattgcacttgtttgtgactattttgtcccaagtacctagaaagtgttactggaaaaccttagtttttttcttcccttttggtaggtggatctggaatatttgctagaacgctaccctcttgataaggaagttaactggggtgatgaattgtctcttggagagcaacaaagattgggaatggcccggctgttctaccataggccaaagtttgccatcctggatgaatgcactagtgctgtgacaactgatatggaagagcgtttctgcaaaagggttcaagcaatgggcacatcatgcataacaatctctcatcgtccagcattagttgcatttcatgacatcgttttgtctttggatggagaaggagggtggacagttcaggaaaataggttatcctcatgatgatttttatctccttatttatttatatataatatgaaatgcagttctaaaaagttcgttatttctcttgtagaaatggctcctttatctctgctgaaccagagtttgatgcattgaactcatcagaaactgatcgtaaatctgatgcacttgctgttcaaagggcttttattgccaacacaaaggtagttattattccatattgcctgttctgttgttattgattttttatgtaccattcttttaacagattttatttgctagggtaatgctttaatgggccccaaggatcattcttattctacacagctcatagccacttctcccaatatggaaatagaacacacagaacggtcaaatctagttccacaattacagtgctcaccaagacctttgccactccgagctgctgcaatgtcaaaaatactggtgagaaacatacatttttttacgcttatcagtaattcagtatctagtatccactattcagagatctcttcgactcaaatttgctgatcgtccacatgaaataattttctgggatatttgtttggcaggtccctaaattatttgataagcaaggtgggcagttgcttgcagtggcattgcttgttttctctcggacttggatttcagatcgtatagcttcactgaacggttggcttttatcttcatgtactggagatagatctgatggtataccttttacttaatatgttttcacaatcttgataggaacgagcgttaagtatgtcctggagcaggacaaagctgccttccttcggttaattgggattagtgtgctgcaaagtgctgcaaattcaattgtgtcaccatcactaaggtaatattggttccctgcaattgaaatgttcctaccaggatgctttgggggcagtgccaggcaaatactccctccgtcccccaaaaaggcaaaccctgggtttccgtgtccaactttgactgtccgtcttatatgaaaattttttataattcgtattttcattgttgttagatgataaaacatgattaatattttatgcgtgacttgtctttttatttttttcatatttttttcaaataagacgaacggtcaaacgttgggcacgaaaaccagggtttgtctttttttgggacggagggagtagataatacactttttttttaaagtaaagttcctgagcctttttaacatatacttgtcggtgggcttaagttttccttatagttctgatatctgtttatgtttgccagaagaatgtatgttctactttcctagtcaggatatttaactattgtgcattggtaactgattttgtgtattcaaattcacggcttgataaatatttctatgcagaaaccttacttcaaagattgcccttggctggcgaattcgcatgaccaaccatctacttcaatattatttgaaacgaaatgctttttacaaggtaaactctactgatagatttgattgtaaacattgttttcttgcactttctaacatttttttctcttttacttttttttccatgaaagctaagcagtttgagtttttctttttcaggtatttaacatgtcaggcatcgatattgatgcagaccaaagaatcacacatgatgtggagaagttgaccaatgatcttgctggcctagttaccggaatggtgaaaccacttgttgacattctttggtgagtttgtcatggtctaaaatattacccaggtgttctttgattaatcaggttttcttagcaagtccactattactctccaggtttacatggagaatgaagattttgtcagggcgaaggggagttgctattttgtacgcatacatgttgctaggtcttggttttctaagagctgtttcccctgactttggtgatcttgcaaatcaagaacaagaacttgaaggaacattcaggttagtgacatatgatttgcggtcattggcaaagttgactttattactaaggaacttccaagtattgaccttgttaatttcacaggttcatgcactcaagattgcggacacatgctgagtcaatagctttctttggtggtggatcaagggaaaaagctgtgagtttttcatgtctcataaatgctgcttaaaatttctagtttccacactataattcttgtgggcaatatgttttttgtgtatacaaatttcttgttgcttttgaacatctggtacagatctgttagtaaatttacatgccctaatattatgattattttatcgtaaatcagatggttgaagctaaattcacaacgatgcttaaccactcaaggactcttctgagaaaaagatggctatatggtatttttgatgatttcgtgacgaagcagctacctcacaatgtgacatgggggcttagtttgttatatgctttggaacacaagggggaccgagctttgacttcaactcaaggttgataaatttttcaaatccaaatgatattatttttgcatagaatttcccaacaagttctcaatttcggattgcaggagagttggcacatgcacttcgattcttggcatctgtggtgtcacaaagctttatagcttttggtgatattcttgagttacataaaaaattccttgaactgtccggtggtattaatagggtgtttgaactcgaagagcttctacagacatctcaaagcagtaagttctcagtacactgtaaattttactcgatttttttttttttggatgagagacagtagggagaaaccagactataaggggttggatctgtacaaaagaggctttctccactgtaaatattaagtacccactgttaaaactaactatcccagccactgagagatctcaaaattaagaagttaccaactctcagaaattctaaatcaataacgagaagttttccccatcataagttatggccttatggggcacccatcaaatcctcaatggttattctcagtaaccaagccagtgaggtatcagctcaataatctactaccagtctgttgcactctctgcaaacatatgcttgagtttgaagttatgccgttcaaatatactatgatgctaatttttaatgggtaattaacttctgacatctgcaaactaaagaacagttactgtctatattacagattcttaaatctgtaaactttgtcgaagggtgcaaagatgtaaatcttctgatacatcatgtctataaataaagaaaattctaaattgactgtctttctgctgtttccctggacactgaaaaccatttaggagtagtttttagttggagcccacattcttcagtacaatatcttgtctgatattgtccctgaattaaaaaacatcatgtctggtatacacctgttaactatctttaactttataagaagcaacatgtgctgattttaggaaccttctccttgttcaaagctacaaatcagcacatgttacttcttataaagttacatcttaaacagatttgccattgttgatgaaattgtcaaacttgatgttttgccatttgttatcttaatgctacgaattgtagcttcatatgttactgttgtttttctagatgctgccatgccctctaatcctattattgcggcatcggaagaaattatttccttccatgatgtggatatcgtaacgccatctcaaaagctattggctacccagttatcttgtgatgtatctcaaggaaaaagccttcttgtgactggtacatcatctggcagcttttcgtcctagcttttatttactttcatgtttacattatatgttctaatatctatcatgctgttttcttaaggcccaaatggcagtggcaagagctccatttttagggtgctccgaggtttgtggcccatcgcttcagggaggcttaccatgccgtctgatggcatctttcatgttccgcaacgtccgtatacttgtctaggaaccttgagggatcagatcatatatcccctctctcatgaggaggcagagttgaaggttctttcattatacaaatcaggttagtgccagctaactttgaaaaggaaaaaatatctgcctattttaactaatgaatttttaagcactcctttattttgattatggcttttaacaaacttctatgttgaccatttcctgttctgttatgagcaatgtatttgttggtaatgtaacatcacacccttatccttgatgatgtaggtgacaaggcaataacttctgggtcactggatgatcacctgaagacaattctagagaatgttcgattggtctatcttctagaaagagaagggtgggatgctactcctaactgggaagatattctatccttgggagaacagcagaggctaggcatggtcagtgattttgcttcagcttatatttgttgtctaactaatttccatttgttttttatggatatatacctttactaagtgggtaataaatgctttctttcgttttttatggatatatacctttactaagtgggtaataaatgctttctttccaggctcgtttgttcttccactgtccaaaatttggtatcctagacgagtgcaccaagtatgtagcgtatagttttttaatgttctcatttccattttttaccaataaatgcacagctcttataaagcatactcattgcagtgccacaagtgtcgatgttgaggagcatttgtacaagatagcaactagtatgggcataactgtcatcacctcgtcacaagtaagtatcatctagatacccacttatcctaactcttcaaatggtgaataaaaaaaaaacatggttttcatttctatccattttgtttctagttgatggtattttgcatcttaagcttacatctttgtcagaagtgaaatttgggttgatgatgcctttctctcatttattcatttgcagaggcctgctctgatacccttccattcgttggagctgaaactcatcgatggtgaaggaaagtgggaactatgtacaatcaaccaataattgatgtggccaacttgaatttttgacgagttttcatcaagtgcctattcaccagtggctgcctttacaagccatgaagaaaataccaattcacattaggagacttgcatactttcacgcagcatatgcgcttatacgagattcttttttccttggttagaggtttgagatatagcaaaacaacatacaggagttgtagagtggaaaggtagatattgacttgtagcccctaagaagatagatagcgtagtacataatttgtccttccagcctaattgattggcttgtagcaattgtaacacggagcacgaagtgtgcccttgcaaatgttagctcttttatatagaaaaaatatcttttattttgttatttcggtgttatgtttttttgttccatgtcagttcagctatatactagtttgaagtttgaactttaacttgtccgattccagcatctggtacatatctagggcctgtttgggggagttttagattttagattataagaagcagctgtttggtagccaacttctgagaatctggaaaagctctgaaacccagcttctggctttttagttcatttttttcagaatctgtaattacagattctctgaagctgtggactgtttagggcagcttctagcagaagcagtttttgagaaaagctgtagctgggataagctcccccaaacagggcctgagccatacacgaaatggaacaggaatataaatttgaaaattgctatccatccttcgcccgatctttctgataatcgtcggttgattttgtgagaattggacgcaacgtagtgattcgtatgcgctccggcaagcttatcttcttcagtaatgtagtgattctgattcacgatttcgcatgtactcctgcaggctgcgtttgatttatcttattggccaaggctctgtttagatctcaccttataattttttactctgtcatatcgaacgtttgaacatctacgtgaagtattaaatataggataaaaaaactaattgcacagattgcgtcacaggacgaatcttttaagcctaattgctccatgatttgataatgtggtactacagtaaacatttgttaatgatagataaattaggcttaataaattcatctcgcggtttacagacggattatgtaattagtttttttattagtgtccgaacaccctatgcgacaccctattactatataatatttgatgtgacatgccaaaactttatatccttggataaacaccccccaactattccatcgtttttatgagtactatttctctaaatactaaatggtttgtgagctctgtttctcaaactaacgttttgtacaaaagatatttataaggaggtttattaaaaaaaccacataaatttattttttttaagtttatagcaatcaatataagtcctccctccgtcccataaaaaatccaatcctggagagaccatctgttactactatctccgtcccagaatataagaagttttagagttagatacggtattaaaatatgtaaaattaaatgaggaaagattgtgatttgttaagaaatagaggtcgataagaaaagtgaatggtttagggttgtgattggttgagaagggaatgttggcgaagaagttttgtattttgggacaaattttaagtgctaaaaaaaatcgttatattttgaaacggagtgagtagcaccgaaaataagctgtttttgtcacccgtgagagcatctcgagaaaaaaaaacatgactgtctcaaattcgattttgagcgtttttcgttagaacttggtttttgtagccgacgattaatactacaagagatcgtgtaaagtccgaatcacagcgtattaatttgcttcacttttcacatggaaacgaacgaacgaaacagagtttgctaaggcttttgctgagagaggagcacgagcaatccctgtgggccgacgaggatctcgctggcgaagctgacgaggccgaaccacaccaccggcgtgacgtcgacgccgccgagcggcgggatcaccttcctcgtcacggcgaggagcggctccgtcggcgcgtacgccaccacgtaggggaactccctcacggggagcctcgggtaccacgacatcacgatccgggcgatgaacaggaacccgaacgccgacagcgccggcccggccaccccgatcgccgccttcgccgtcgctgggtccagctcccctaccaccgccaccgccctgcacacccactccgccacctcctgccactgacgctccggtgcagcagcagcagcagcagcgtggcattggccggtcatggccgccgccgtcgtcgccgcggccacggcgagctggccgtgtgaccctcgctgctgcttcacatcgttgcttcttctccttcttcctccttgtgctatctcgatgtcctgtagtttggagaaatcaatccatgtcgatgaagatgaacaaattaaacagtgcatcggcggtgatcgatccagcaaccaagaagatgattaccttggcggcgctggcgacgatgcacctcctggcggagaagagcatggacactgtcctggacatggaggcttccatggtcatggccacgaggaggagaggccttccttgctttgccttactttggataaggcgaattgaagagccaaggtgggggagggaagaagacgacactgcccgccacgttgctctttctactgggcctccaattgagacggcctaagcccactggcgatgcgaccaaaaaaaaaaacaaaaaccctacggcccaacacaagcaatcgtctcccaacatcaccgcggcggcggcggcggcggctttccacctccccgccggcttcgcgctcccaacctcgccgtcgttcgtcatgttccggctgcgctcctccgctcgcctgctgagagaggtgagccagccaccggcggcctgctacttctagttctagggtttagcgggtgcttctcgcttacgatttcagtatggcttgtggttcgcgttgcagctacgggaggcgtcgcggtcgtcggggcgccgccgggaatggctctccggcggcgcagtagcctccgccgcgcggacgacctcgctcctgcaccctctgcccgggctcgacgtcccgcagtgcctccccgaccagctcggcgtccagcccacccgcgtcaccacgctccccaacggcgtccgcgtcgcctccgaggacctcccggtattggatactctatgttcctctgctgtgctgcggcggcggcggcggcggcggcgacgaggctgacgctgtgtgagggtttctggcgcagggcccgtcggcgtgcgtaggggtgttcgtggattccggctcggtttacgagacggcggagacggccggcgtgtcacacctgctcgagaggctgtccttcaaggacacggcgcaccgcagccacctgcagattgtgcaggatgtggaggccaccggaggaaacatcggggcgtctgcatcaagggagcagacggtgtacagctacgagactctcaaggcctacttgccgcaggccatcgaggtgctcatcgactgtgtccgcaatccattgttcctccaagacgaagtcgagcgacaggtgctggactcatggatagactagcctctaagatacagcttattactagctatttgcagcgcactgattatggttgtttggtttatcaggtggcctttgccagagaagaagttcaggagctacagaagaaccctgagagatttcttcaggaatcacttaatctagttggatacacaggtgctcttgcaaatccactagtagcccctgaggagagtctcacacgaatcaatggcagtattattcaaaagttctatcacgtaattctcttgcttctgtatcacatttgacttataaattactcataaatgcgactcaattcatgctgttcgtagtttccaaacgatgctaaaatgcaagtgtagctctatctctatagctcagtgcctcagttaacaaatttatgaaaaaaaaatctattactgaacaggagaacttcactgctgatcgcttggttgtagcagcatcaggtgttgatcatcaataccttttagatgttgcagagcctttattgtctgattggcacaagggctccccagtggaaaggccagagtctaagtatatcggtggggattttagacatagagcagactcagaggtaatatacttcccatcaacactactttgcctattcttttggggtttccttttgctctaaaattgaaaccctgctcattcctctccctgcagatgacccatgttgctttggctttcgaagtgcccgggggctggcttgaagagagagatgccacaattatgactgtagtacaggtatacttaatgagtgggtatttactaaaaacaatctggcctatgttgacatctgcatcccaactgcactttctaacatatatccatgaatatgccaaaatattttgtagactttaatgggcggtggtggttcattctcttctggtggtcctggaaaagggatgcattcacggctttgtaagtaattatctctcgacaaccatttgactttagtaggattgcaaattgctacaatatggaataatgaatatagattagattgtgcttttaatagccgttgttgtgtaattgctgcttttattttgccgttttagttatttcagttcctaaagttttttttttaaaaaaaaggctataagttgaactgttatttctttgcagatctgaatcattctcttgacaaccatttgatagtaggattgcaaactgctacaatatggaataatgaatatatatttgattgtgtttttaatagccatttttgtgttagtgctgcttgtttagtaccctagtttttttggccgttttagttatttcagttttttaagtttttttttgaaaggctataagttgaactgttatttctttgcagatctgcgtgtcttaactaaataccacacggtcgaatcattttcggtatttagcaatgcatttgatagaagtggcctctttggtatttacttgaccacggtaagctcatctttatacattattctgtgcctcgaattaaatagtgaattatatgaaacatgttgcagcttctaccttgagttgttacttcgtcattttatcaaattgtgtgagtaggacttcaaaagggactagagctggcaaagtctgctttttcaaaattttgaagtgccattgcttcagttcgtttttgagtactagaagtttgaaatactttttttttgtttttttattggtccagccttcagattttgttgcaaaggctgttgatattgcgacaaaagaactgattgctattgcaacacctggacaaggtatatatcatctcctgcttgccaaaactgcttcagcatccactgaagctacctgatctgaaacttgatgcgatttgtatgtatacagtgacagacattgaattggcacgagcgaaaaactcaacaatttctgccgtgctgatgaatcttgaatccagggtaattttggaacccccatccccaatacacacacgcgcacacacacacaaaaatctttctgacccttttcacaggtaagtaacctgctttagtgtacttattttaatttgcaccaggtaattgttgcagaagatatagggaggcagatattgacttatggttgcaggtaaggcaatatctttcacacttcattttttagaagtcttccgcacagaaatcattgattcttttctattctgtcaccacaggaagcctgttgaccattttcttcaatgtatggacgaaatgactctagatgatataacagcttttgccaagaagatgttgtcttcaccacccacaatggctagttggggagatggtatatatgctttatgaatttgcgaaaaatatgaatgacacaaaataagaattaatgtgagttcattgactctccttctgcagttgataaagttcctccatatgaatttgtttgcaagaggttttgaagttctccgacacaatgatcagtggtggacatgaagatgggattttgtttacaatgttgtataatccaattctcgctatatttgggccttatcttagaaattgccctcgttatacacatcacctgatgagattagatttttgctatcatcttcaaacagcatatatcttgtgaaagtccaggtcaaacggaggtgaaagttttgcaatatctctcgaagcaagtttagcgattcctcgtcttgttatgcaaacatgcatatgcacttgtcttattgagtgctctgtaaacaattttcacggcgatgatatataggggttacggtgcggaaattgacaggataatggcatggccttgtttcgacaggacattatgttctcggactgactggtttgacttcagttgctaccgtatattttgtgtttcttttaatgtatggcaaagcaaatcttcagaaaaaaactagtacgaaatgttgcgtctttgcttaactacagagttggataataatggatgaaaagcaacaacactgttgagttcagggaaattgagctccccatcatctgaacttttacaaaacttccaacctgaacttgtacaaaattttcaacacttgctgcaccgacaggtcagtttgcacgtttgaagtgacaaaacaagcagatggtgcatacaaaagctcggcttgcaagtaaagccaaaataaggagttccaacattccattaagcattaatcgccagtcatcagactcgcagctcattacaactaatcccatcctgacagtgcacctgatcctacctccggcacagatgatagctgctcaagagctgacgagccaaagacggtgcctttggctttcttcttcttcttggtgtgatcgattaccaggccaccaaattttccatctcgggcaatttcctgatttttgcccttcaactcaagctctggattgttgccttcaccggagaacaccaagtctgcaaatggcatttctgtgtcatcaattccgtcggcgttcttctcttccttcttggcagattttgtcctcttggctcccttactaacctttttatcagtatgatcaacagaagagttgtcatccttcctctttgatttcttgttcttgacatgttctacagccgctttttccttcttcatttccttgccatcaagcagttcagatttggctggggcagcaatggtgacatccgggcgagtactttgtcctgcaggttcttcagggctcttaatttgttgctttgagtgtttccccttgcctttcttttttgtataaatgtcagtaggaccatcatcaggcgtatcagcatcattgattggtagattctcttctctagaattcttactcttggagctggcctccatgggctttgagttaaatatgcgtaggttgggaactaatttcttaacctgagaaaacatccagagttactccagaattgcatacatacagaaaggcagaaaataaacggtattaccttcttggctagaccgtctttctcagcaataggatttccctgcaagtttaggttcctcaagtagtgcaattcagaaaggacctaacccaaaaaaaaagaaaaagaatagaaaaaagatagactgagacagtgtaaagatattatgaatgtagaagggtgggagaaaattaatcagatgcaaacctccaaatctgatctcctctcaattaagttgtttcctaaatcaaggttcaaaattttgacattttttgccaggtctgatggaattgtctgtgaatcagacagagttcagcaagatgttacagagtgaccaagtggaatgtaacatgctttcgagcagaaaaaaaaaacaatgtgcaaaagagacccagacatatgctatccataagtccatatacatacagtgatcttgttgtgagcaagtctaagttccttcagttccacacacgcagtgagagaagaaccaattttttctatctggcagtgagataaggatagctgaggaaggtaatgacaaaacattagtcatgtaaaacaggaaaaagtgcatattaaagctgataggtcttttttttttgcaaaactaaataatacaaacctttttcatggcctttgccttcatcaaagcatcaccaatagtgaaaataggattcttggaaagaactgcagcagaaaaacattcagaagtaaattaggtggagggaacatcattattctttgcctgttccaaactggactgtaaaacaactcttttgttgggtgatgggtttgtactacaatatgaaaactgaatatggatgatttataagaaaactggtattttacatgcagaaagaaattgcaatgggcaaggatcttaatgttaaggttcccaaacttactatacttacaaaaactattaacatccttttggtttatcaaaattatcggcacaaatcaagaccatatcatttaatcattccaaggggaaaaaatgaattctacaggatgaagccactcagttcattctataattaattgagatctcactatgcataccaagtgtgttcaactgatgaagctggtcaagtttgcagatggaagaaatgttgttatctgcatgagaaattacagagatccagtcatcaagctaccagcagaaacaaaatacaactgacaaaacatagcatttgtgcatagcattaccatttagaatcaatgctcccaggcttgtcaaagatttgacctcatccattgttttaagtttattcttgccagcattcaatacctgtacaacaggagaggagcaactgccaatcattgcaagtgaagtaatcaggctaagatccttttgcggggcagagaagtaactcacctgcagctttgagaggccttcaacaccttttaggctcacaagcttgttttcaataaccgaaagccacttcaaattggcacagtttgatagacccttcagcattcaaaaccacaatgtgagtggaaaaaaaaaagatactctgatgaacacagccacagcaatgatttaatggaacgattagccatcaattctctacttcaatgaactcaaagaataatccagaccgaatgggacatcaaattagtccattatatgactttctaaaaggttattacgggattcatccttttaactattcaatgtttcagatggatttacccagtgcctatgcttgtagagaacacagtaacaccgacatcgcatatatccatacaggtgaaattcaccaagaatctacaccgatgctaaatttgttgtataaacatgtgcatttctcactagaatactgtgttttaacccgtagtacattgactagttacctcgagagtgaggaggcagttgtagccgaggtcgaggcgctccagattcacgaagctgctcaggcacgacacctacacaaaaaccaacacagcacagcaccgcacaacacaaggatgagaaaacatggcaggaaaaaaaacaccaatcgacgaggcagaggctacacagcaccgacgtcggagagggcgcggtgggagaggttgagcgacgtggcgagcgtcccggcggatcccgcctcgcgcttcgcctgctccaccgtgagccgcgccatctcctcctcctccggccgccgccgttgaggagggcgaagcgaagcaagcgctcgttgcggcggcaggcgagctgagctctcaagtctcaaagacttcaagagagaaaaataccctaacctaacaagggcgatatgcagctgacatgtggggcccactgtcagcctccacggagtatttctctctcttctcgttagagaggggggtaaagcgcaagagactcgcaacgcaggtcagagcggaaggggagaagaaggaggtgctcctctcgagtttggagaaaatttcccccgcagaggcctccgcttgctcgcggagatggcgatgaccgtcgaaggtgagggtcgctctgagtttccctcccccatctaagatttgctcaattgctagtctggttctgttcccgatttcggcgtcgtttgggctctccgattcgagtgtcggggtggcgggggattgggcggctagggttccggttcgagtttggtgttacgattggctggtgcgtgctttacggattagggcgtcgggttcccaattcatcgcgcatggtttgttgtaatgcttgtgaagttaaactttcccagatttagtcttggcattcggtgaacacgattatctgtttatatgtcattcatagaatcagagtgaattatccctgcaaaaaaaaaaagaatcaaagtgattagatcctccaagttagcaccttgtattgggtcttatgttttgccagtagatattgtagtccggcttacctacaattgtgcatgaaacactatcctgtatttcaactcatctgcatcctcccgagtttccaacagaacaaggagcataagccaaaaatatgcctgcaaaaatgtgaacttaaccatctagctcaataacaagtgtccctcagaatcgcttaactgatacccatgagcatttactatgtgcatttggttttgagttctagctctaggatataaattttaccatgtgcatttaaattattttggttgtttgctaccaacctgaaactacactgcttctgagatgtatttggatatcactttcttcaatttattgctaaaagcatacagtgatactgaagcatcaaactacatggttttgattcaaaatttgtaaccaaattctacttatgattcatggaactggacaatttgaagttaacatggagctctgcacatgcttgatgtatgtttagtccatcaaaaaacaacatcccagatcaacttatgttcttctttcgacctttatttgtgcaacctcatgttcataaaaaatatcatcgaacttgttcaaaagcacttcgaaaaccatgtcgtctttagattagcctttatgtagcacaacaccaaagatgagcatgaccatcctctgaagaaaaaaaaatcatgctgaactattaagcctttgaagtgtttttagctaaactgggaggaagaatatgcattaaattatggttatgaaattcagaccagcttgttgattttatagaatagtatttcatttgcatagagttacctttctgaaaatacagttcattttcactatcagctatttgttagactctagtgctccttattaggtcatgccatcatctttgttctcctgcaattggtttgaaagtttcactaacttaatgcttcttgtctttgcttttatacctttctgctggatgatgatgatgatgtcacttatcattgatgtgtgtcttgacagtgtaagtatattattcagattcttttctgaccattcttttacatttaagataagtgttaacaatataattgcttctactacaggctcgctggacttgcatttatgttctcaacaagtattcttttgcaaatactggtacataattctcacttgtttaaatctccacctagcctcttttatttgctaaaattcaggcttctgggtgctttgtttcatgacagttgctatttatttactcactaactatttcattactttgagaagtgagaacctaacagtttgatttggcattttgtttgtacaattcattcatgcacattactctgtatgtctgtcatgctaattatgttgtgaaattcataaaacttagagcaatctggagcatcaattgctgtccagaattactgtagaagagtatgcgtgctagaaataatacttcacagtcagtgaacaaagcgtgtagcattttgaagacaccatagcccacatgacggacatgctcttgttgtttgatcaggctgttggttctatagctaattatttttccttattttgatggtgcaggcttgtgctctgtacaataattggtggcctatgttagcaggtaattgttagttagttatcctcaatcagtgttgtctaatcctcgtcgaccttcaactgacatttgccatacttctgcagctcttatgtatgtccttgtaccgatgccatgcctattcttcggtggtggatctacccagttcttgactagcagagatggtggagggtatggtttgatttgttgttttcgttccagaaactttaccatacatactgtactacttggatgtaaactaacatatgtaaagaatagtttggaataaggaaattccttctgatttgtagttgtgacaaactaatgatagagtgtttatcatttcaggtggttcaatgctgcaaaattcctgactggtgcatctgccatgggaagcattgcaatcccagcaattctgaggcacgctggcctaattgagactggagccatgttcatcgagttcacgtccttcttcatccttgtatgcacagtgatgtgcttccatagagctacgctggatgaagattggtaaaaggctcgaggcacatggacacaagaaggtaaatctgtttcatggtttgcttctcagcacgtacaagagaaattccttagtggacactaacatggacatgtgtacaaagaagcaaatatttgagttggcgtgactgtctgtataaatgctcaaagatttgctgatctagcgacaatgccaatgttctatgtgcacttttcatgtgaatactcctcacatgatctatgggcaacctgtcagccatccgtgtgaaatgcgatcaaacgagcaggcaggcgccctgtttaattcccttgattggttctttgcattttgaagcatttggccaccgtgcggcagctcgtctcctgctgcatctctccaccgtttcgcttctctcatccctatcccgcgccaccgctcagaatgtcttgggctttaatttttctgtgttatactgttctcgatcaatgcgattaattttagacatgtgcttgttctaaaaaccaattcatcaaatcaatactggacagtttttactacttgggtttgaagatgaagattttctttttggaggggttcgattcagaattgttgcagaattcctaacctcttctccctcttttcaaaccatctttttattataagaaaaaatactttaaaaattatattaatttatttttcaaatcatgcgttaattcatcgctccgttttttatgtgtatggatgaagttaccaacttcttcaaacggtgcgttcctatatgatatttgtgctgtaaaacaagcagagatatttcacatagcaatcgagcattcagaattttatttaccggccaaaaacaggtaacctctgtcctcttctcagctccggcttgtttttctttttagcgtttttaaaatgtctttatgatttataaataacaatccgcctaatcacaacgaagacagtttggccgagtggtctaaggcgccagatttaggctctggtccgaaagggcgtgggttcaaatcccacagctgtcataatttttcttccttctgattgattttgatttttaatcctctggttttttgcgttcccagatatataggttccgtgctcatggattttcgttctggtgaaatttgcaaggattttcaaatcgtttaaaatgttatcatctcagcgatgaggtaataccgcaatacatcgagcacaacaacccggagagaaatgcagaacgtcagtgtgtgtagctatccagtgaagtatgagattttcagtagttcggtcagaaatatattctagtggacacggttttttcccctcccttttcctttttgttcttttttttttgggggggggggggtggggagtggatagagttcagacagcaaaacaaataaaaaacaaaagaaaatcacaagaggattttgttgacagactgctgctgaaaatcagagtccatggtcaaaaaaaaatagtttttctgcaggaagacccctgaagaagtgaagagagaagatttagagaagaaaaatgtacgagagaggagaaagacagaaacattgggagggtaggcaaatcaggaggcgaggaagtagaagaaaccttttgcaaagtccatgggacaagcaagaagtcttatgaaaatatgctaaatgatgcttagctggctcaaatagattcttcaaggtatattatggttgcagacagttccatttttttttcatttagaaccttattttgcataaatttacattaccaagtcaaacaaactaagtcatgctgaaccttccttaagctggtatgctccatgatattgcaacaaagcaaggtctaaatggaaactgaccatcctgttgaagtaaactaagtactgaatgcttagaaaactcctgtttggaccaatccaagcaagtttcattacttttgtactgctgggtcaccacgccaacaagttaacaaagtctttcacacatctcacatcgccatttggccatttcctctccaatggtcatggccccaataccccagccatggcatcagtggccctttctcatcctcttcttccttgtacttttctcctgtgaatctaatcttccctgcaggaatggtgtagaggccacacagagagtcttcctctatccacagtctccaaaggtctcctctattgtcagcaagggatacagaactggatatcacttccagcctccaaagaactggatcaatggtatgtctgcatgttttccatcagtttttacccttttgactttggctgaatccaaccagaaactgtattatccaatttggtgttccttttgtttcttgattcaagaagaaacagctgccctaattagttagtatcttttctagctgcagaagttaagccgtgtggatgagcttaatttcttgtgtctatatgaatttcatggtatagagaggaggggggaaaggtaggtaggcaactcactgcttgtgtgagctctactgctgattgttgcacacgtttatggtgctgcagattgattttcagtaaaatcgtaatatggttatttctatgtttagattttcgctggaaaatatttaccgctgaaatgttgtatttgtggccgtcttttgacgctaggcatcatatttgtattaacagaacgaacagtacaacaaatgtggagttttctcagataaagctactccacatttgttgtactgttctgttaatactagctccagttagaaaatgttgacctagataattctaagatttgttctaaaaggcctaactacataacttttttttctgaatatttagcagatcttttcttaaacataggctagtaactagtaatcaagcatgtactgattcttgaatttttcctcctgtttgctatgtcttctatattggacaattcttctaaagctgacattctctcttctttttcaaatgttccatgaaatgacaatcctggcaaatttgtggcaattcaaaagatccaaacggtacgcatcttcttcacataatatgcatccaaacaaattgtagaataaactgagacattgcgtgcctaaattatctcaaaatttacagggccaatgtactacaatggcatctaccatgagttctaccagtataacccgaacggatcagtctggggtaacatagtttggggccactcggtctcgacagatctcatcaactggatccgtcttgaacctgcaatagaaggaaatactccgagcgacataaacggttgttggactggttcagcaacaatcctcactggtgatcaaccggttatcatatataccggtgccgacacggagaagcgtcaggttcaaaacattgtgctaccaaagaaccggtctgatccttacctgagggaatggaccaagccaaaaaacaaccctttgatcgaaccggtcggtccgggtttgaactcaaaccaattcagagatccgacaaccggttggataggaccggatgggctatggagaatagcagttggggctgagctgaatggctacagtgcagcacttttgtacaagagcaaagactttatgcagtggactagagtagatcacccattgtattcttctaatgcatccaacatgtgggagtgcccggatttctttgcagtattgcctggcaagaacaatggactggacctctctgcagctatcccaaatggcgccaagcatgtcctcaaaatgagcttggattcctgtgacaagtacatgattggggtttatgatctgaaacatgacatgtttgtgccggatactgtcttggatgacagacgattgtggttgaggattgattatggcaattactatgcttcgaagtcattcttcgattcgaaaaagggaagaaggataatatggggctggactaatgagacagatagtacgtcagatgatgttgcaaaaggttgggctggcatccatgtaagaaaatcagcctctaatctcctccttgagtaaattgcatcgtcggtacacaaacttgtcaggtgggtgcaacctagtgcacaaacttgtaaaatgctcgttttggtgcatgaacttgtttggtgcgtgaggaggaaggtgaaaaggacactacaatactacatggctaatcttatcgatttaggggccgattaagatactatgtaaacatatatctaaaaaggttgctattaaacatacacctattcaatcaaaaataaaaaataaaaaatagaataggatataatgatagtagaaaatgatgaaaaagccgagcactgatttaagggttagaaacatataaaattcatcaattccatgatgaaggataaagtagagaccaaatttataaatattgcatgtcttatgcatactcactagatgtatgcacgtcacatactaatcaacatcagcattataaaattaacattgtcaagttattttggtcctcgttcgcacgaactagacaagttcgtgtactgaaacgagtattttacaagtttttgtactaaattgcatccatctaacaagtttacgtaccaccaatgcaatttactcctcctttaattttatactatggaagcaatgttttagccttagcatgtcagtgtaacatactgatcctcattcgtcatttcataaaggcaatccccaggacaatttggttagatggtgatggcaagcgattgctgcaatggccaatcgaagaggtcgaatcgcttcgaagaaacgaagtcagccatcaaggcttagaactcaagaagggtgatctgtttgagatcaagggaactgatactttacaggctagttccaatttacctcaacaaaagtattatgttttttttttgcagacactgtagctaatatggcacaccattttcttgaagcaggcagatgtggagatagattttgagctgacatccatagatgctgctgatccttttgacccttcctggcttttggacaccgagaagcattgccgagaagcagatgcatcagttcatggcggcttggggccatttggacttgttgttcttgcctctgataacatggacgagcacactactgtgcacttcagggtttacaaatcagagcagaagtacatggttctcctgtgctctgatctgagaaggttaatgctttttcttcatccagattctgttgatgcttaagaactccctatttgcattgcactgataaaagtgaaatgatatttgtagaaatctaacctttgacagtaaacactaaaaaaaagaacgaagatatctgaaaagtctgaacttgctcttttgtctgacagttaattgtccaacattgtgttcatcatttttacttgtgcagatcatcgttgagaccaggactgtacacaccagcatatggaggcttctttgaatatgaccttgaaaaggagaagaagatctccttgagaactctggtgagtgaatgaatcagtgactctgcatctgcacgatcaacacaacacatctaggaagtgaaatgaacaaacagtccgaaacctgactcgccggcgtgcgtgcagatcgaccggtcggcggtggagagcttcggcggcggcggcagggcgtgcatcatggccagagtgtacccggcggcggtcgtcgacggcgccacccacatgtacgccttcaacaatggcagtagcacggtgaaggtgtcgcagctcaaggcatggagcatgacgagagcacaggtcaatgtcaggaagggatgaactgattgattaatcaaaatggaaacaagagagcaacatattacatgctaattgtccagtaagtagttaattgactacccattcatcagaactcctttggtaggaataagaaggaaatccagaatcaaaatttttagctgctcacagacttgttgatgacatctacttgctttgtagcaatatgtttttacttgtagaaaggagatggaaatcaaatcattgttaagaaatggttcgcaattggtaacgagatactactcttcgtgttttacagtcgaactgtaaaattcgttgtccgtcagttaattatcctgctccaactctcatccaaaatcattccgtttccacattgaatttattacttacccaaatgatgttttttactgagagaattcatttcagcatgaagcctatggatcatggtttcatgcttgatgaactgatgaaaaaaagtactgacttatcggtgatgttattgttggtggaggggttcggggaaaaaaaatctccgaacccaaaagaggcatttgggccgtagtcgtaggacagattcgatggcctttcagctgctcctcagcctacagtgtattcttcttggcaaaagaactctgcccaatcagcgaattaatttggcaagcgaaggcaccggcaagaatacgtttcttcatgtggctggctgtaaaaggacgctgtctgacagctgataatcttgaaaaaaggggatggcctcacgctgattgctgtactttgtgccaacaagaacctgaaaactgcttacatctgtttatcaactgcgactataccatcacagtgtggagactgatgcggcaatggatcagcgcttacttccccatccctgggagcgaaaacacatgcctgacagagtggtggttgcaggccagaacatgttttcggaagtgctacaggacaaacttcgacagcgcttgtatgctgatttgctggcagatttggaaggaaagaaatgcgcgtgttttcgaccaaagatcgagaagccctaaccagttagcagaggctatcaaagaagagatcttagtgtggaaagaagcaggctatttcgagatttgcagatcttagttttttagttttttagtgttgacgttccagttctttagtttgccgggctgtggttcctgccacagtctaattcgacagcctcctgtcgttgcaagcgaaaactacttgtactttgattttattcctcccaatcttaatgaaatttggtcgccggttccttcggccgacccggcagattcgatggcctaagtgggctggcccaattgctgttgcatatacggcccaaacgactctttggggttcggagatttatttcccgacccctatgtttcctgttttttgaatcagcgtgtgttgtttttctgagctgaatgttgttgtcgagagctgttcttggacggattgcgaaagaggatgtactacatctgaatgaaatggaaggtttgctaagtttttgaattgatggactatgtagtttgatacgacgttgctttgacgatatcatcgcatcattgttcacaactggttcacaatcggtaacaagatactcgacttgtttgatctgcagattcgctgtccgtaagttaattatcctgttccaactttagcttctcccagacctattgatgacatctactagccttgtagcaacatgtgtacttgtcagagttaagaccgttctctcccccgagtcggttctccccaggggcggctcgggaggcgacccggcccgccctcttccccctaccccaccccccgaagccgcgcggccgcaaggacggcggcggcggggcgctcctcgtctcctcgcgctcggacggcctggggagccacccggggatgggctggcgacggggtaggcggcggtggcggcggggacgggcgacggtggctgctgaggtgagtgcgcccggtggtgtttgtgggtggcgacggcggtggtggaggccgcggatccggcggcggccggcggtggcgtgagcacgcaggcaccccgcggcggccactggcgtcctccggcgcccctctaggcgtcggccggcgttggtggtgagggggacggccggatctggctcccttgcccagatccggcgtgtcctcgagtggggacggggtggtttggcgtccggccgtcgtgcaggtgatgtgcatattgcaggtaccctcggtgtgtaggtgacatttggtagctcccgtcgtggatgctatagttgatgggtgctccaaggcgaaagtcttgctccgctctcggtgctagcaacggcgacgcccttgggcgccgttcactttcttgaaggcgtttgctactggagccctcgttcaactccacttcaagagttttctctgggtgaaaacctagattcgttaggatcggacgatgacgtcgttctgtcggcgtgaccttcctgaaggcttcgttttaggagtttatctcttgttggacaactgtacttaggttcagtttgtcaatgtcggggttttgccggttttcctttaattaaccgtgctgttgtaaggtttttgggtccggtttcccttataaactggatcaactctcttcttctatagtgaattgcaggagctccctgtctgtcccatcgaaaaaaaaacatgtgtacttgtatagacaggagacgaaaatcaaatcactgcgataaagaactggttcgcaattatggtagtacgtgcgataggggaagaggctcctctgacataccgccctctgatgtgggtggctgacatgtgggtccaccagctgtgaggctcatatgtcatcctctcaaagttagagggcaatacgttagaggatcacgtttcgtgcgataggacttaggagcggatcggagaagaaatctccgaaccagagacatttgggccgggggtggatggtgattgacccagttcgtactaaacggctggcggcgcaaatgcctcttcggggtttgagctcccatcggatggcaaaaaaaaaactaaattttaaattttcaaatttgattttgagatatttttaaggtagtttttttttcagcattggcttttaagtcaaaaaacatatatataaaagttttacctataaatccatttttattccctaataaatagttttggcttattatgaaaaaaaccaaacgatggggctctcagactcttctacaccgaaccccacaaatcacacgtacgcccgtgcgagactcaacgacgagtgcaggtggaagcccaggttttcgtgcgatgattgtttactccatgaatttgcttaatattctactgagtaaaattgaatcaatgtgtttctttttacagaaacacaaacgcagacgtccatattgcgcatatactcactcttataaatacacaccctacctctataatcacctttaaaaagttgggttggcgtatcttaaaattgatgaagtcatcacgaacacattgttgttgagggtaggtagtctatcactaaaaaaataattagccgtaaatgcgagtattcatatcaaatctaagttttgaattcggatgagctggttcaccgtaagatgaaagatgtttttcatattcttggaatgcgatgcagtttatatagcccaacgtaaaaggctgactaaattttgcattggttaagtacatagttccatatgacgttgtttttaccctaacatcacaacattgttcaccagtttgctagtagttaaataaaggtaaatgaattgaggaaaacaatgtaaataagatgaggtaaaaaaaatcgtaaatatcacatcttgttcaccagtttgctagttgaataaaggtaaatcagttgaacaaaaaaatataaatcagttgagttgagcaaaataatgtaaatcagttgaggaaaaaaataaacataaatcattttggagaggatgggctcgaaccggagaaaaaaaacgattttgctatatctcactcgaaagattttttcttatctctcactcgattttcttactcaaatttacagtgcattttctggtaagttacagtgtaatttatgaaacttacactgtaacttttgtaagttacactgtaatttttgaatcttcgcatgtaaattttaaattttgtattggatttggtctttttattgaggatatggtaatttagtgtccattatggtatttcttaattgctttttgctttttattatatctatcggattttaatctaaagattaaaaatctgtgtgatacgattataaaaatctttcgaaagatgtataggtactcccaaaaaaaaaataaaaattcaactgagggcccatccgggttcgaaccggagaaaaaaaaataaaaattcatccgagggcccatccgggttcgaaccggagacctattgatctgcagtcaattgctctaccactgagctatggacccttgatgtttccaaaccaaacagtttattacttgatttccatatttagcaattagccgattcttaatgataaaaaataattaaaatctaaatgaaaaatcacatatttcctatagcagaataatgcgtgacacattttatgagaaatatttttatttatcttatacaatattatagtatatttttttagcaattagcaaacacatgcatttagctagccatctaaaatgcacatactccctccgggttaataatatttgttgttttggacaagagtatagtctccaaaaaataactttgaccattattttctgttataatatgtataaaagtattaacaaatatatgattttattaaaatactttttaagactattctatacatgtaatcaccatatttgaaagataatgattttaaaaatgattcataatcaaagattctaaagtttgatctcatccttatctaaaatgacaagtattatcagcccggagggagtagtacttttagtcaaaatattcattttacctatcgtgaggacatggtcaactccaatctataattatgtgtgtagggtttattgcgtgtacaaattaactgggggaccgaaatttcagaaagaaaatatttgaagtttgacaaaaaaaattgatagaatttgaacagatgttactaaattcacaagtattgaaattttcggaaaaatatagtttcgtaccgggggttcaaaattcccgaaattttaaaaatttcaagccgaaattgtaaaccctggatgtgtatggattggaccaaaccatatatatatatataccccgatcgagtacaaccaaattagtgttgaattcgtattatattaacatgaattatctgtaaacacgtacgtttggtacgactccaattccgagattcttatctcgtgggagctaaagctatatcaagcacttccaagatcttggataacataggtaaagctaccacaccgcttccaaaagttacactacaagcatggagcggcatattcccgccgctttctcagctcctctccaccatagtagctataccaaatacacccttaatcgatttagtaatctttctagcgatagaacatactagcacacagaagggagtggattttaaactgacatcctctcgttatttacatatcatgcaaataactacaagaaaaaaaataagataaattaatatgtgatatatcactccaccaacatgtaagttaaaatttaaatttacaagttgcaacataaaacaaattaaactatagatagtttacgtatacaatcaaatttgcctttttttaacttgtagaaattaaatttgatgttgcttatttatgaagtaatatatcacaaattaatctaccttaatgattctttctttaagttttttccataattattcgagtgacacttaaacaataagaggagtctccttaagagtttagaatatttcagatgaccaggtgcacacacaaaatagctagcctcctgggtatacacgtatgtttaacacgaattgttcgacaatcttggacaaataatttagtatagttcggcaagcaaacatcaaacaagacaactatgcatagatatactactctcgtgctttgactcaatatatacagcagcattagttaacggttacaaaggcacacgtcgacacacaacacgtaagagtaagagacgaactactaatccaataattccatgcttaattagtacagacaaaaccaacgcgtcaaaatgaaagccatctgaattaactggagtatcttccaactactaatactaattaatctaaccactaaagtctctttcattgcatgagataatccatggcttttcccacaaattcattcattcattaattccatcactcactttgcatgatggctgctagtggccgtcgacgacgacgacgacggcgccgccatctccacgtagttggtgatcttctcctcctcctccggcgacggcggtcgagtggcggcagagtcgtcgtcgccggccatgttgtggatgcggaagagctcgcccatctgctcgagcgtgcgtccacgagtctccgggaggtaggtgaagaagaagagccaagcaagcgaggcgacgccggcgtagaggaagaagctgccgccgatggtgatggccttggagagggagaggaaggtcatggagatgacgccgctggtgacgcggttgaggccgacgccgagagcgcagccgagggcgcggaggtggagcgggaagatctcggagctgtacacccaggtgatggggccgaggccgatggagaagaaggcgacgaaggcgaggatggaggcgatggacacggcgatggcccagccgccgccggtggcgtcctcaccgatgacggtgaggcctaagccgagggtgacgagggtggcgatcatgccgccggcgctggccagcagcagcggccgccggccgaagcggtcgagcgtgaacgttgccaccaggatgaagagcgtcttggtgacgcccacggcgcacgtcgtgccgagcagcttgttcttgtcggtgatcccggcgctctggaacacgcgcgggctgtagagcacgacggcgtcgatgcccgacgactgctggaagaagtggatgccgagcgccgacaggagcacgcgccggacggccggcgtcggcgacaggatcagctccttccacacgcgcctctcgccgccggccctcttcggcacggccacgacgtcaccgtcgaggtcggccgggatggccaccgcctccttgatttccgcgaggcgggtggcggcctcctccgccgtgtccgaggtctcgccgaggacgaccttggcgtcggcgaggcggcccttcatgacgagccaccgcggcgactccggcatggcgagcaccatgagcgcgagggcgacggacggcgccgcgccgacgccgagcatgaggcgccagccgagctgcaggcggaggcgcgagaaggcgtagttggagacgtagccgaggaggatgccgaagttgatgaacacctccgggaaggaggtgaggaagccgcgcgacgacgccggcgagacctcggcggtgtagacgggcgcgatcatgaaggcgtagccgacgccgatgccggcgacgaagcggccggccatgagcatggggtagttgacggagaggcccatcatgatggcgccgacgaagaagatgaccgcggcgaggatgatggtgaggcggcggccgatccagtcggaggtccggccggcggcgaaggagccgacgagggagtagaggttgaggatgccgagcaggatctccacctcgacgtccgtgatcttcatgtcctccttgatgaacagcgacgccccgcatatgtaattaatgagactgcatatgcaacatgaggctctctggagactggagagagcgtgtatatataggcagtactggtggctgtgtgtgtgatcgacggtcagagtaatcaattgatgacagtatgacatttggagcgtgtatatataagccatactggtgtgtgatcgacggtcaaaataatcagttgatgacagtatgacatttgcccattgcaacttgtttacttgtaaaggttggaacttggaaggcctccgtgccgagcccagctggctcgtcatccaccctatttggaaggcctccgtatcaactttgatcctgctaccatcaccatcgacaggtacacccaaaatatttcaaaaattcatatttttaaaaaaaatatttcaaaaaatcatattttctttggatccctcgtgggtttggatcccatgccactcgacttcattttatcagtttctcatggattctcctttccttgatttcccttttaccatcaaattaaaatctccattccttgatttttcctgtgcacttttgtttattttatgccatctagttacgaattaagaagcgggaaagctggacacatgtgcacatattgcctcataacaattcacatactgccatactgcgatacaaggcagtgcttctagcaattcagaaagtgagaaatcaacacaaaacataaccagtcgagttccaaattgtcttcagctaatatattgatgattcaaacagatgctaacgatgcaagttagaagagaggtaaatccataagtcataacaactccaactccaacactcaactatcaaatatagctgattctggcccagttctcttagacaaaggcgtttggacattgctaagagcgacgtagcaaagaggcaatcctcgacacaagactatatagataactcatttcgggtttttgagcacaatgatgaccgagtccccacgtaggaacatcttgctgatgaacctgtccttgttcactggaagagccttcttcttgcctttaccagtctttggtacctgcagcaagagtaacacatgttattactgaaaacagcactacactcaactggaacaaaagttcaaaacttcagataacgccttgcatgtacctcggtccacatctccctgacattctcaagaaccatgttgcaatggctatcaaatgccctcacacgacctagtaacttcttgttgttctggcaattgataagcacctagaaagaagagcatacacaatcaaaacaatgcatatctttagaagcatcaagtgtagtcaggagaaccacttatggtcggctaattctataggtaactcctaaagatacacttattaatataaccgcactgctagccgcaacaaagatctgaggtcggacccatacaatatacatcaagcagatattttcagagtttttgcctagtgtacacaaaatacagtagcagctatgaagaagtcagcacaaatttgcaactatggcttgttttcccacatcatacaaatgaccaaaattgacaaatggttacacatagcacagcatgataaagttgaggtatctaaagaaaaagacataacaccaagtgaataaattcaacatcctagtaactgaaagcaagatagcatatcaaggtatctaaaccaaaagatatcgcagggaatgaatgaattcaacatgcagtaactcaatatccatgacaaaatggcatatttcaaggtgtaaagggcaaagataggtgcgtgaattcaatccagcaactcatcttgctattgcaccaactcaacactccagtaagtaaacagactcagaaaatcaagtaaataatgaaatactaatcccacaacccacaacgattctggtcgccaaaagttcaaattaggactccatacgatacacaaacaagagcagtagagcatgttaaggtaatagcatggcgagcgcgaacctaagatatggacatacctagacaaaccatagcacaatccaagactactgtttgaactgataaaagtgaacaaaaagtaggtaattaagaactacataactaactaaaacagaaaacaaccttactgaagaagtgaagatagactaccacgttgcaatcaactatgtttcagaaaatgaagtggcagcccagatgcaacatttacactaacactacatgaaaagatgttgactatgaccaattattcagatacatgagaaaggctccattaatttaacatgacttacagagcatccttattggctaagagagttgagagaactacagttcattcacccgttaggagaagggtacttccttatttcagaaatccagatgttcatagacagttcaattgcaaacgaatcagcttctaaggaatatcaccaaacattcaaggcaaatcggttgccaaaacttttctaaggaaccccaacccatgagccagtttacaatctgtggctacattgtccattgctctgttgtaagaaattaaacttcttttgttctttgcattagatgcgataaagcttatcttatagtcattgagttcgcagatattagagttagtagaattgtctgatgtatccagttggaggatggagaaagctttaaagaaaaggataattacaatactgtggtgcccccacacttttaccactgtagataaaagtgtaccagctgtgaattattatttaacaaattcttgttttgccaaaaaatagcccaccatcagagatcgcacagagtaatagttagaactacctttaattcgtccctaggagtctgaaggccacctcaactccatcttatacttgcaaagagcaattcctgtaaaggggttatatagcaagggtgatcactttcgtactcagcaagtcaatagtagcaaaacatagatgcataaatgatacctttatatcctacatcatggtcattcatatttcatcatcaaatctaagtttattttgtaaaagggtttccaaaagggacttataaaaactaaaatacactcataacattgacaaagtttgtagcaactcctcgtacaaaagcatgaatcacgatttaatttagcactgtgcaggcttgtaccgctttacccacagctactctgatttttagggcctttgcattccattcgattgctagacttatcagagtacaagactttttccctcatttccatttactacactccacgacaccatatacgccgggtcgtctaatggggtttatatcatctcccatctatcactatgcattcgatggggttttatatcatctcccatcattgctacgcatttgatggggtttatatcatctcccatcctaactactcatagatggggtctatatcatctcccatctgaatactatgctcttgacggggtttatatcatctcccatcctcctacaactacatacccatgtggagtataataaacttaataaggtactaggcccagcccatcttgagacagatccatggttgatcggtatacatggttctctggtacaagtgaggatcaataatctttatatgtatatcaatatctccatcataatcagtctagcaaataatatcatctatattatatttattttatatgaataatggtttgatgcaatactaagagtaaaaaattttataaaataggtttttaattagagggagcgtatcctatgcacacaggccctcacgtgtacacaccgtgtacaccaactaaaaattatcaaaaaaattctaggaaaattcatacatatactttcaatagtattacatctacgtgcaaagtcgcatcttcaaattcattctacatagagaataacaaaaaagataaaattctgacaaaattgcaacctcaaaactgtcagattttttgtttttttgttacagttaaaatataatgaatttgacgttaagattttaaccctaggtgtaatacaattgaaagcatgtgtatgattttttctagattttttggtgacattttttagttggtgtgcacgtgtgtacacgtgagggcctgtgtgcataggatatgttgccttaattagaatagaaggatcatcatctatcaatatgatcaaagagagacttgcctgagtttctatagttttttaattttttgaggttaataactgcctagcatttgccgagcctgagtatctgtagttgaaatcgaaattatctagtgccgattgacccattttccattctagctttatgaaacttaatcatgatgtcattgttttccaactaattgaaccatgtgccatgaattaatattaatgatttctatttaggatttaattaagtgcgcgtcgtttcaaatatgcacataataaccctgtattaagctgatacccgatgggtgagagggggatctgactattcttatgttcttatgtaacaggagctctaaggtagtttatcccctcaattcagtattcaatttgtcagaacaagcaactcttagtttatcccctcaattcacagaacaagtaaagatgtaccttctaccatcctcgaacagagctaaaagagcatctgaattaatacttttccaccatccctcggacagagtaactgagttaacttaggctgagtttgagtaggaggagattaagaagattgggaagatacgcaaaacgagatgagctattagagcatgattaattaagtattaattattttaaattttaaaaatggattaatatgattttttaaagtaactttcgtatagaaactttttgtaaaaaatacaccgtttagtagttcaggaaacgcgagcgccggaaacgagacaagctcactcacaatcttctcctgccgaacgctcccttagactacttttttcttttctttttctcttctcttctcaacgtctcagttctcacgcctaggcaggaagatgcaggtgtgcggccgacggatgatcagtggcggttgtatgttcacactgcgcttggtacgtcaccgaagtaactgtaaatgatgagagtgttggtgccctaggggcggnagctggcagttgcgactaggaattgattcatttatatatagcgtaaaacttgtagtcgccttgtcgcatatctgcgaccagaatattgggcgtatgatgtttatctttctttgggcaccaggaaagaaagcct

SEQ ID NO: 3887 - DNA, 33909 bp, Oryza sativa
  unsure (1)..(33909): unsure at all n locations
accatgtcatattcccgccggttactccattatattatcgcggtgaaattgtttcaaagctctcaataagcaagtgcatagccatgttgcatacaagacaggaatcgctaaccttcttcgagagatatcgcgaaactttcacccaggtttgacttgaactttaacaagacatatggtgtttgaagatgaaancaacctctctctatacgtagcctcggtgggtgagcgggcgaacgtcgacctctctgtcgccagccacgccgcctccacagcgccgcgcagatgctgtcattcggcgccctcggaatcaccaccactacgtcttgcagcgcctgcctttgcacgttcggcgacggctggtacagccggagcacctcgttcagcacgcaccccatcttcgtcagcttccccagcgccgccgcgtcgaggaggcccgaccgcccggccgcctccaccacctcctcccgcaccgccgcctgccactccgggtgcgccgccagcatcagcagcgtccacgacagccgctcccgctcaccgcagtgctcgacacgggtagcgacctcatctggacgcagtacgacgcgccgtgccggaggtgcttcccacagccggcgccgctgtacgcgtcggccaggtccgtgacgtgcgccaacgtgtcgtgctgctcgccgatgtgccaggcgctccagagcccgtggtcccgctgctcgccgcccgacacgggctgcgcgtactacttctcctacggcgacggcacctccaccgacggcatcctcgccaccgagacgttcacgctcggcacggacgccgccgtgcgtggcgtcgcctccgggtgcgggacggagaacctcggcagcatagacaactccttcggcctggtcggcatggggagaggcccaccgtcgctggtgtcgctgaagaagaacgtcttgcactcgtccaccagctcccgcgtcgtcagcttcctctcgcgcccccgcgctcgccttgttccctcccagcagcagctacagcaggtcgttcgtcttcttcctcccgctgcagccgctggtgacgccgcgactcgatgatgtcgagcaggagcgcgtcgatctcccgccccagcttccacgcctcatagttggcgcggcacgccgacgaggcgggtggagcggaacagcatcgcctgcatggcctgcagcttgtggaagaccccagcgccggtggcgtcatcgtcggtgccgatgccgaagctggccttggcgatgatctcggcggcgttccagaccacgcccttctcgatgtcgatgcagctctaccccgacaccaccatgtcgctccactcgcccagcatcttcgacgtcgtctccggatggggagaggcgggcgctagccgccgctcccgccgtcgcgggcgttcgcgccggccgcctcctctccccctctcccgcttcttccccgcgcgccgcagcgcccgctgcgccggcagccgcgcctgctcagccgtcggccgcacacccacatctgcccgcctgcgcgtgagaactaacaagatgagaagataaaaagggaagaaaaaaagatgtgggcccacatcattttctctcgctgacatgtgggccccatatatttattttattattttttactgactagtatgccacgtcagcaaaaccagtcatctatactgccttggatccaaattagacggttttgtatagtttaggggtgaagatttctggttttgtggttaaggaaccttgaaatcttgatgttaagttgagggaacttattcctatttacttccgtttgaattttaaatacacatgtactaatatttacagagttaacagtttcttaaagaaagtcttgttttatagaagtaattttataaatgtatttaataaaactaatttcagattatgacttttctgggggatgtcattggactatctttattaataagaaaatatagttacatcatccacgctcataataaagctaggggctggttcattgatccatatacatgattttcttgaaaaaaaaaagacctagccaattcatgagttacctggtttgcctctctattacaatactcaatagaaaccctatcaaaaccattatgtaaattgttgcaatcttcgtatatggctatcgatgccattgtcaagaaacctccatctaacataatgtcaacaacctacttacaatctatctgaataataaacttattccaaaccatgacttggtgctgatggaaaactaatttcacaagtaatattaaatgggttcttgccatgtacaatatttataagctaaagtatataagttgaaatccgtttctatttcgactttagaatctcaataagaagacctaagtaaccatactctatatcccttagctctagctttaaatactatgctttacatatcagatgttttaaaaaaattcttgctactaaaaaataccaaaaagtatgtccattgaagaatgcagcggcggtgccctgaaccatatctcccgcacattaaggacacacgttattctcctcctgctctaaacaaatcacagacaataaaaaaaagcaatggttgagctagtaggagctccgcttgatccggtaaatgagctaatatcaatctatcatgtgtctatgctcctaccctacctcgatcattgttctccttccgagaggctaagcggtggacttattaaacctgattggagccatgtttgaaaacacaacatagatttttctttttaaaaaaaaaaaagattttgatgccaatgagaaagggagatattagctttgaatctccctagccatctatacatagaatattctatgttatatggttttgaatagaatattctatgttatatggttttgaagtactaagttgaataaggatcaatatttaccaattcaagtactatgtacacttacgaaacaattcaaagcaacttactatcatagaggttctattttatagatatcgtgaagtatatttaataggaacacactgtctggcaccgtttgtaaaaaaaaaaatcctctatatctatccttgtgaatactggcacactgaaatttcagtttaagaatttatacactgataatccaaattacaaccacaagttgtggcgatttggacagaattttgttaatcccaagctaggtgttgaccatgggtcaacaatctcccatggtgcccgtggccgtggtgtacgcaacttgtccgcagccgcgaccccgacccgacccgaccagactcggcacccgctttctcattttttttttctttttgccgacttcccccctcagccgccacacgccccctcgccgccggcgacctcgagttctagggttagggtttttgccccggctcgccaatccactatcgcccaaggcttcggccccaattcgacgcccgcgggttcaattccgagcgctcccaagtcgaattgtccgcctccaccggtggaattcccatgcctctgagataaggattttgggggagacgcggggtgagccgggcggccatggcggggagctcgaggcccgacctcggcggtggcgggagcttccgcgagggcccgcagctctccggggcgggaaccccgagggcgctggcggagccgcccccgctggcgcagtacctccccctggagtcgttccccgtcggcgaccacaagcagtcgcgcgccacggagcttcggcgggtgctcggcgtcaccgtggaggcggagcagtcgttcgggctggtgcagaccaagccactcccttccatagcgtccgaggaactcaagcggatccgtgggggcgtcgtggagtcgtcggccaaagccaagtacatgctgcttactagttactgcacactactgcttcaatctgcattgctcattaacccgcaaccggtgaaatgttgtgcagggagaaaaccaagtcgctgcaggattctattcagaagctggataagtacaggaacgttgtcacgcggaggcggcagaggagcgaaggaggtgcgactgagaggtcatcagggagtgggtcgggttccctgaggatgggggctcagaacagtatggataatcctggccagcggctggaggagagggctaagagtgcgaccacaagcaagcgtgtccgctcatcgctagcagcagatgcacgggtttgtacttgtgctactctaaagattcatccagggatttcattttgctcgtttgccactgtctccatcaatgtaaatagttacgtcgatactacaggattacagaattacaatcataagctgctctgttactgtaatataacaaattagtttgaactttcaactggtaattgggcatatgccgcatatcagtgtgcgttggcagttaacatggagtagcaatttaaattttattgcatgctaaaaaatggattccaaatgcaattggacccaattacgtggtcatggttaccaatttgagtgaaggaatacatcctgtgagtagacgtagctgatcaggttaatatggaatgtacttaagcatcctttttgcttattttgtaaagagcagctgaagcttatttttgggtcacttttatgtctttgtatctctttgttgctgtggtatccatgtgagcaatattatattattatatatgagagcacattttcgtcattctaaattcaacttagagctacctatgaggcatggtatttctttttgggcgttatcgtacttgttatgtatttactgtgcttccaattttccttttctttgactcttgtgatatatatttcagttagaagggcgtggtaatgttcctacaaggcaaggtcctctggcggacagtgagaaaagttcctctttggagaaggaaaaaaactctttgaggaatgtcaatgctgcatcagggttttctgaagacaaattacggggcctagctcctggaggtgaaggttgggagaaaaagttgaaacgtaagcgctctgttggaactatgctgaacagaggcaatgacgtagaccgagatgttaaaccgttggttcaacatagaccaaacaatgaagctcgcatgcgatctagtgatggtcttccaattaggtaactttcatacattgttgttacttgttaaccttgttatatgagttagtttctgtacagactttagcttcaaatgaaaacatcattgaaacgagacaatgaggtttactatgccacacactataatgacatcataggtggtactcctatgagcattgaggtctgtcatcatccctttaatgctgtgttgacaggcatggagcttctgctggagcattaggaggaagcaagatggatggaggttctcaacagagtaatgcaggttcccgttatctactgaaggcagacatggactccacttctcttccaaatgaaagaagagagcgccatttagggatagacaaagaacgggttttggtgaaaggaaacaagtaagcatagtaattggtggcattattttagcaatatatgctatgatacaagcacactgatttgcattttggaatgcctttaactctttgtgtgattggttacactgatactttgtatacgcagtttcttgtattttatgagtactccttttttgcggggagatgagtcctgttgaagtgttgattatttctactctataccatgaatgagaaatgatgtactgaatcattcttctcttatttagggcaaatacctctgaggatatgcaacctggaactttaaatcctctgactaagggcaaggcatgcagagcaccaagaactagttcccttgttgttatgaattcatcatccactcttcagcgctcatctggaggaatcgatgaatgggaagaaacaccatccaccaataaatcctctcctttgggaggcactgcaaatcgcaagcgtcccatgactgcaagtgggtcttcacctcctgttgcttgggtgggtcaacgtccacagaaaatgtcacggacaagaagagcaaatgttgtttccccagtctcaaattttgatgaaggcctatctgaaggatcaccacttgatgctgctgttagaccagcggtagagtcacctggccttttgcttccaaggggtgtagctagtaataattcacaagttacaccaagaatggataatatttcatctccagctggtctgtcagaaagcgaagactctgctgctacggaaaataagaacaaggataaaatcagtaatagtggtgattttgagaacgagggcgcaaattcagcccataattcagcagacttaattatctcatcgaagaaaagcaggatactgttaaaagaagagcttgaagatggaagtattcgacggcaagggaggagcggaagaaacactatgcatgttaaagggtgtgcatccatgccaagagagaagttggacagcccagaaacaagaaagctgctgaagagcggaagacctgtatctgaaaagaatgaaaggtgcttgatgattggaacttattgaggttgttagttatatgtatcctaatggaactaattaatttctaaattgattcagtaagttgggccgccctccaacgaagaagggttcagaccgcaaagcatcatctcgacactcggagatcctaaattgtgggttaacagatatatcaggtttcctgaaaggcacctttattatccacctaatgccttcgaattctataaggagttaaggatgttaagagtcttgacattaaactgtgtgtcataggtgaatcagaagatgaccgggaagagcttctagctgctgcaaatgctgcgcgcagtgccattggtgtgcaattctgcaaatcaaagtttcctatatgatttgcagagagctgtaattttattggctcatgcttaataggttccttatcctttctgcagttaatgcatatgctggtccattttggaagaaaatagaaccgatgcttactttcatcagctctgaagatttatctttcttaaagcaccaggttggattctgtttgcccttttgactttgcataagttgctttacatttttgcctgtttgggatgaacttccacttaccagaatctctggtcagattacatttttggaagagcttgagatgggcatgtctaagtcatccgatgaacataatttgaacacatcaactaactacagtgggccattatcaatggtattttgcctgaattactccactacagaatttcaacaaaattcttcaacctgtgtattctgttatatctccactctaaacttcatgcatatggactgatatcctctttccatatgttcttttcataaacagggtcaaaattcatctctgcctcagtcaaattcatgtgtgtcattggagcaaagcgaagcaaatggacccaggacaagagaatctattgatattttgtctcccaatgatgaaaacactgcatctcaaaagacacatgcagaagaattgtttggtggaatggcttccttgacacacaaactcttctctgcttttattgtagaagatggtgataattcttctgaatgcaatggaggagatatacttcttgagttctcaaatgacttccttccttatgctgccaacatgaacttagaaaatgattttgaagctagtgcagtaaaatccaactttggatcaagtcctgatttcaagcactcaaaccatagctcagtgcataacagcatgtccaatggttttacagcttccagcaatttgagggcctcatatagtccaaattcaatttgcagtgagaatgcatcggatgcgataaaatttgcagtatatccagaaaatggtggttttcatgaatttgtgccacatatctcacaacagtatcaaaactgtgcaaaaagtacgcctttaccaccatatgaatatcagtatgaccagttgcctgtgcatgacagagctttaatcgagctgcacagtattgacctttgtccagagatggtatggttcctaaaaaccttccattattttgtaaatttgaagaatatatactgctttcctggttataatgttatatgccaaggtgtttctcaaacatctcaattagcatgaatagaagttgagaccatacattttcttctgttgccagtttgttgctctggttctggtgtttaggagactttgatttcttatgttatgctatgaatgtagatgtagctttctatttatttgcattcctggtggggcatatgtaaattcctgttggcacaaggcacctagtgcatcaatggtgaggaaaaatatcgataaaatgtagatcaccttaagaactgcaaaagtagtgtgctgtaatttgcatttttatcttaaccattgttcttaggagctgcgaagatattagcaaaaactttttatgataataaaatatacaccaatacttcgattggaacagaaaaatactgaaattataactttgatctgagtggaaacagctgaggggtttagaggtcttgaggataggaaaggttagtgcaaggggttggacgccaatcagttgctagagtgactgttgcccctgttcaatcatgagttctactagggtgaaccagtggtgcttattccttgagagagagctgaaacaattttggtgcaaatctttgattcttgtacgaatgctccctactcaatattcttgcttgaaaaagaagtcctgacaattttcttcttccggtagccaaagctggatgatggagaggatgaggacattgataaagttattacggagctgcagaaaagactgtttgagcaggttctctctctctctctctctctctctctctgtgtatgtgtgtgtgtgtgtgtaaccttgtaaagtgtataacgtttctagattagcgaagtataaagaactatagaactagggattctaacttgacttcttattatagtgagagctatgattattcagaagtagtaccccatacaatcatcatcatcccacctcaatttggcctatttgaatgataagggcatggccaaaactactgacacaactggtcgtgtggtcttgccaacttctctagcaagttaactgtgttcagtaaaaatctagcatgatttggggtggattctcttgataggagaatatgtcatagctttctcagtgccaagttttcaagcaagcaattagtagaatagctgagtcggtcttgaaattacttatacattgtgcatcatctgggtatgttatcaccacaaatgagattttcgatcacagttcagggcttcaagcgatcctgatttttctgtatttctcatacttggatgatattctttaggcttcaatatcacataaaatttgtatgagaacacctacatttcattgtgatgtttcctggacagtatttcttttgttacttccagatgtattctgggaaattgatgtgctttttctaagagttaacacctatttaacacttgtgctcctcgacttatttcaggtgaatcaaaagaagtgccaattacataagttggacaaagcaatccgtgatactaaaaatatggaggagaggtattaaatattccacccctatacaactttccattataaacacatatatggaagttataacagcaactaaacttggatttcaggagtctggagcaacatgcaatgaacaagctagtggagatggcatacaaaaaactgatggtacttgaatattcttttggttacattaccacttacttaccttttataagtgtttatactttacacagcattataggttatagaaacagtctaatttataccagacgaataagattaacatcttttttgataatcagattttgggaaaatatgctatagagattcagaatggccatcttatacgatctattttcaaacacctaatagattcctagtagctcggttttgaaaggcattaattgttgcttgttagctttacctgtacaactgagtaaatactgttggtctataatgttactttgtactaatgaatacacatacactttcttaatgttgacctgtgcccctgattgcatgccatatttgttctattttcacagggtggccgtggtagttctagtcataagggtggtctcaataaagctgctaataaggctgcaaaacaagttgcattggcttttgccaagagaacacttgcccggtgccagaaatttgaggaaacagagaaaagctgcttcagagagcctttcctttggaatgtgctgtctgcacctttgccaaagaatgatgcaatagatggtaatacacaaactattgaacagccaaacaagttgcataaaacccagttgttatgttacattaccatcaatataattttctctatgcttcaggtggtctcccaggatctgcagataggccaaagcttttaaagcttgacagaagtccattgagccaaggtatttcactgtttctagcattcttcaacaaatcctagtggaatatggcgtgcagaccttaagtagggatcattaatgtactacttgatgtttgttagaactctttcttcaagagagatgttaagcttctgctgatccttttccaggtactacaaaatggaaaaagagtgaccgagaaagggatcaaaacagagacgcgtctttgaagaattctaattcgaaatcaggacgcaattcgtccggcaatgcaaggagtgagcgtaaaactaagataaaaccgaagcaaaagctagcacagttgtcgacatctggaaatgttcttggaagagttacggagccatcaaatttcgcagcacccggccagagagaatcccatgattggacgagtacgtcgagcacaagacctactcaaccagtcagaaacagcgcagctactgttgcccaggataccttagatgctccattggcaaatttgcctgcaatagatccaatggacatcttggacgtgcctgaaggtaacgacatcagttcgtggtttactgatggtcttgatgattccttacaagattttgacttctccggaggcctagaaatcccagatgacgatcttacccaactgggattcatgtaaactgaaccggtaaatatgtacatgttcatattaattttaagtgttgatcctatgttagcactggcattgcttggttaccgtggtaacggtgactgattagtctcttgtgcccctaagggcagagcttgcaagttgcaactaggaattgattcatttatatatagcgtaaaacttgtagtcgccttgtcgcatatctgcgaccagattattggtcgtatgatgttttatctttctttggccaccaggaaagaaagccagcgtttattcacaaggctctctggagcatttgtggcacacgtcttgatatgatacgagtattaaaactaattagtaataaatcctctgatttggcggagcggacaaagctgtccgagtgcatttctcaagcagttaacagctaaacataagatgagagacgatgggttgtccctccctaggcagaacatcaaatttttgaggtttttttttagagttgaggggggaatgtctgagtagaggagaagatacgcaaggcatgcaaaaagggaattgagaagacaggagaggtggagtagtggtgcaacccacgtctgtcccctctctcgctgcagcttaactgtatctccgatccattcgatcgacgaccaaccacctctccataatatatccactcgtcttaattagtctccaccaattctctctttctctctcaattagtctacgacatttcgttctgtcctcgatcgaattaggaggttcgttgaagaagagaggagagagatcgaggtaggatatttgatatttctttcagatcagtaggtggcttgtcgcttgagcttgacaatggacgtggccggcggcggcgaggaagtcgaggaggtggaggcggttgacggcggcgagcagcagccgccgatggagatcggttggcccaccgacgtccgccacgtcgcccacgtcaccttcgaccggttccatggcttccagggcctccccgtcgagctccagcccgaggtcgccggcaacgcccccagcgcaaggtaagcgtcttcttcttctccatctccggcggccggcgcggcggctgacaactgtattattattatggatatggaatattgcagcaagacggtgttcggcgtgtcgacggagtcgatgcagtgctcgtacgacgcgcgggggaacagcgtcccgagcatcctcctcctgatgcagcggcggctctacgagcagggcgggctgaaggcggagggcatcttccgcatcgccgccgacgacgcccaggagcaggcggtccgggagcagctcaactccggcgtgctcccggagggcggcgtggacgtgcactgcctggcggggctcatcaaggcctggttccgcgagctccccggcgggatgctggactcgctgccggcggcggaggtgacgcggtgccagtccgccgacgactgcgcgaggctgtgcgcgcggctgccggcggcgaaggcggcgctgctggactgggcggtgcagctgatggcggacgtggcgagggaggagcggagcaacaagatgggcagccgcaacgtcgccatggtcttcgcccccaacatgacgcacgccatggatccattcaccgcgctcaagcacgccgtccacgtcatgaacttcctcaccatgctcatcgaccgagctctcaacgacgtccaaacctgcaacaactgatccatcaatataattaagcccaccatgcatctcgattatatatgatcactttaattatagcacgtaattacattgtcattcattcgtagcagggttaattaattaagcttaatcaaaattgtttgttttagtttcattttactttcgtccattactcagtttaattactactacatgtgtcgagagctgacttcttgggtctgactgtacgtagcatcgagcaaatcagctctgtcatgaactacatgcatgttaatcattttattccattctaagagcgtacctgtatggttggttggtctgttaatttgacgtttgagatatttgtgacttgtgagtgcatcaattctcagcattactgttcttttacttgtacagtaatataatcgattttttctacgcctgtttcaacaagaacttaaatttttctccaatgtgatgagatctcgctggtttattatatagtttttgaagtaatttggtgcattgatggcaaagtgcgtgtcttggtaagggaattgggccttgcactcttgcagccgcatatgggcctgatcatcaaagaagacttggtataggcccattaaactcaactgaggcctatcccgggagagtgaaaaagagcgggaaaattagtgatgacgccggattagagggtggtcttcacactaatgataaaaaagaagtgctggtcaatcgtagttttaacaggcacagtgcacaaacagaaataattgccacaagccagctgcgtgtgtcaggactcaggagaggcaggagagggagagagaaaggggaaatcaacctgtccaggagagggctggtaataggaataaaaaaaaaaaaaccctccagtgttcgtcttcgagagagagagagagagagagagagagagaggggggagaaagcgtcttcttcgcctcttatgcgtcctgctctcctcgccgcatcctctcgcgttggtcgttcgtcgcgctcccgttccggaggtaatcctacccacctctattttttttttatttcggtcgatctgccgtgcggcggccgaggcggttgcgatagggatagggcgattctccgatcatgggggtggcaggccggagatgaggtcgccggtcacgcgcgcacccaccagtagcacggcaggctgagcgctaggcgccgagctcgagcaagactgcgcctatctaggctcgagttgggtatgttggggtcggtcggattcggctcgtccgagcttttctcgagctgtttttttttttttgggatttgctattaatcactagtgtgaaaaattttgggtttacactcaaatttctgtccacttgatctgtctcaagatctttgctgcatttgcgggttcagtccgtgtttgggccgcgcccgcttcgtagttttcgtctcaatcggcgcgtctattccttttttttttccttcttgatacgcggattctccaaacgatagctccgccggagaatctcgtcggcgatcggcaatgtctcgtggcggcgggctgtggcgacgccttggcgcttggtgagttggccgcccgtgtgtgtgtcacaagtcacaaccttgaatgaagttatcttccttggctgccggtgaggtcaagtggcaatggcatagacgccggcagccggcgagaaagccacggcgttctaggggtagttgacgaggtggtcggtttgctgctgtggctggcggcaaggcacccacgccatttgcagcggcaaccagtgaggcaaccatggaaacttccatggtaagtcacgttctttgccccccctgttgttttgctcttgttgacgaccatgagagcctggtagatctaatgattgtgtttttctccccctctaatctgttgctggggatggagttagaaggtttgtgatagctagctggataaaatgatttgtgtattctcctcagatctgcttctcagaagaatggatttgtggaggttgagagagtgtcagcagactagcatttcattttgcaattaccagaccactagatttctgatgtgaggaagtatcattatgtgaacggcaaagcattttgttgctgccccttttttatctttatgtcaaaaaaatctagtggaattgggcagcatacatgatcctaaacattagaacgttttgcatgttgaaataaatttactatcttgatttagatagggtgataatttttgggatcagttttctatacatacctttgtgtccctatattttttttcttaaaaaatatttgtttctataaggtttattttcttggaatgtcttgcctcactacaagaaacagaatgtttccaagatcaagcctttcatgcagcacttgcctgcaactaggactgtagtaacaagttactccctccattcttatttagttgttgatttgagctaaaatacactgaccaaagtagcacttaatttttagtattgtgacatgattacctctaattactctccctgctaaaatacacgttttgcatttgtgatactataagcacttgagcatggtttatttgacaaattaattctttgaactgcattctcccgatggttgtcatgttcatcgaaatttgttcagttcccaaacaaaagctttgttacatctaaactttctgttttgcttttgctgtttgccttctagcatttgtttgttctatatacgagcacttgaaacaactagctctgttagaatgttttgcagctaaaactagttaaaactagttctcgttttgttcggggaaagggcgaggggttgaggtttgacaatttctcccccttcgtagcttccttaatatagttagtattgttttctacgcatctaccaagaacaagaatacctagttttgtaagcaaatttgaattaaagttagataaggttatgttctgtttttgttattcattctccctttttatcttcctttgttaagagtcgagtgcacctgcatttacagaggttttgattgttgacattgtagtagttttgtggattgatttgttttgtttgaacaaaattagattgttttcactgaaacatgattagcaaaaacttgtttattattagagatgtgtacttcttctaatagtactttgtagcagcagaagtaggggatcaagttagtttaaacctaaaatttgttctgttaaatatttcattaacagtagaaatgtagaaatttgtgttctgtgatccaaacatggaattgttttgttatttggttctagttttacctaatgcagtggatgaagaaacatattgttttttttaaaaaaagttgcttagttttgtcagccactaaaattgcttagttctgtcagctcttaatctgaatttgatgagatcaatgattctatataatccatatacctaatttagcactgagcatgactacatgattactcttgttagcaaatttcagtcacgtggcataattttggggctgtttgatagccctatggaatcggcatctatgaaatgacacacatccaaaatttctgccaacagttcattttgtgaacaaattagaagaaaaactatagtgaaagggaacttgcagtgggggatgaagcacaaaacaaaccattttggtatcccagatcacagcacaatagcagtcctactcaatcaaaagcatcttccaatcttgtaatgtgcattttgtgttctctcttatgtttcctgtgaatcagtcaccaatgatgcatatgcaagcgcctcaagcatgctcaaaacatcattagtatcatccattagtattgaccagatagtccttgctttgcttctagctagttgacagtgcatgcatatcattgagagaacaaaatctgcttgtcttctattatctatcagcgttgatcagcaacaaatcctttgttgttacagtacctagtatatacctgttggtactgtcttttgctagtttatcttactactagttcaaatcattttgcaatccattcagtccatccaagtctattgcatccttcaatttgtcgaagttatgtcaatccatctcttcatcgtcttttctacatcaccaattccctgtcagagttggctttcatcatcaccagctcccagtcggagctagccttcattgtcacttcatcatctccacgtcggagcttctcgtcatcatcatcatcatcatcaatcagtgaaggtccgaagaacaatttgtgaagggccttcatcaacatcaatatctcatcatcagtcaaaggaccgaagaatagtttgtgaaggttcattgtcttcatcatcaacaacatctctgaatcaatgaagagccgaagaacggttcgtgaaggcttcaaggtaccgagggccgaagaacagtttgtgaaggttccgaggtccacttcattgaggaggggatacatcttttcttcttcatcatccaagaattggctcacttcgacgacatcatcaagactttggagataggctaatatttagtttgtgttctcttgtttagttttcactccaaatgcaatgttattgtatacacattacatttgagtgggggtgttaagaatatatgtattagtgtgtttgtgttaaggggtatttctatctttttgcgttgtactcttctcaacatattagcccttagggccaactcaatggatgaatagttcaatccccaaatttctctcctctctcaagaattcacaagacaatcccttttctttagaaaataaagtcggaaattttaagctacgcgggaagcctctggcagtttaggcccctctcattgtcgataaactaatattaatggacacttatatttattttgtaggatgatgaatagtgatatccaaacccgcaaagaattcttccgtaaggctacatcatatggagaatgcatagttttggatcataagcggaagttaaaggattttgatggaagtctcttggatctcagtgaagctgaatatgctatcggaccactacattcgaaatgtctcgtaaaatattttgataaagtggatcgtaaaaaggcaaatgcatattctttgctgaaaaacattcggcatcataacatcgtgtttctaaaaaacttttttgatggaagtggccaacccagatttgtatttaactgggtagatggaagcatgagtgcatgggttaaaaccgaaggtgccaaagtacttctgaagagaacagggacgggtacctgtcgaaactccacaatccgtcagcttgtaaggtagtaagttaaaaaaacaatttatggaataacacgttgaatagaatgaacaaaagatgtgttttctttcttagggatttgtgcagtggactggaatgtctatttgagcatggtatctatccaattcaaatcactgccaaggacatctatgtgaaaaaagttgggaaaaatgccttggcgcaacttcttatcgaagaaggtacctacccatatataatgcattttctgctgctctgttcccttgaagaaatttcctactgtaacacgtttttgactgaactagtttaccttcaatctagcttccatgccatgattgagttcctctctaaaatatgtttgtgcagctgaagctttgccaaaaagtgatgctaggaaaaggcaaatccaggcaaatctttggcatgaaatgagagatgcggtgaagaaaatctttgctgatcatgtggattcccccaaagacatgcccctcgtgagattccttgattacattgcagagggcaatgtgaagacgctacagaggtatccgttggattgggatgaaactgagaaggggaaatacttgttgaaggtcttgtgtatgaacccacataaggtagagcaggaggttaacaacctcatacagtggccacctgtgacctacttggggaatttaccatcccctcttcaggagatgataagttatgaccaaacaagaagccacccatctggttacgatgataagaaaccatatcactacctaaagctgtgcaaaaatataatcaagcattggtggctattgccagaaagtgttaaggtagtgaaaattgaaaatattcttttctataatttttttattctgatccttttatgtgtcttacaccttaactttaataggtggaatgcaaaacatggcaaaggctcatccaaaaaatggaaacatgggatcctaagatatggtgtaagctttacgagacattcggttgatcaagcaggtacttatgctccaatatctatataatataaccttttccaaaacttgttgcagtagctaaggtaatggaaaaaaagatggaatttgttcagatttagagagcaacaagtggatagagggctgtgaaatggaataaaatccaacatggttgtgaaaagatacaactgaatggggaaaaggacaaactcatttggactttaacaaaaaaatggaatgttcacagtaaaatcattctattctgctatggaacttcaagaaagtggctatcgttttaaaataaactgtggtaatttaagatgccattataatcaaagtgttgttgatgaggagttttgctctatctcttggattgaatttgacaatgtgtcgtagcttgctgcttgtttaagtcatctaggcagtcaggctatcagtaggggtagatttgagggtcagcctcttttctgctttgttcaaactttgtagtctcatttctgatatatggaaatgggaggggctgagctcctcttgattaaaaaaaaaagtagtaagtacttatgcacccctgttccatattttatcaaaatgttctgccacacgattccatgtaaatattatagttcattctttgttttacaggaaggcaaacgaagctgacgatgggataggcatatagcatgtttttactccagtgcagcatctgagtcgccctcttctttctttctttgtggtcccatctgtcttgaacagccagttatgtaatgttactccagaccaggatgttcgaccttctgaatctgtgttcttcttgttagtaacaccttgctttagtgttaaactaaaatgcttgacacatagtttgatgattgatggatgacttttttttcattgcctgaatattttgtgttcgagagctggaagtctggaactattcagatttcagggcttcgggggtacttatagtacttcttacttacatcagcgttatactattgctgtgctccagcatttccacgatgttattttgtggcgtgcttcttctggcgacattgctccctgttggccatgacacatgcaaattaaccggaaacaaaatacggctaggaagtatccgcggggaacagtaaatgggctaggcgatttgggcttatcgagcgggtatactagaggatggggcgcgccgcctgtaaatttggaggaacagctgaaaattattaaggtacttaggtaactaaacataccagctgacaatgagtatctggttacaaacatggaataaacctgttgatcatccagtttcttacagtgagtatgaacgtgatattttcatgcataacttactcgtacaaatcatttcatgtatacaacaaggtagaaataatagaaaaaatattaatcttacagattgctttaatgtctgtatagtatgagcattggttacaccatgaagagcgatgtcataataaaaagtcatattgaattagtgaattggtcgattcttagaaagccagacccatgcggtcagattcgtgtggatacactcagcgtcacttcatctcttgaaatctcttcagtaaaagatgaaatgagacattagtttcatgagcatcacatgcaatcaccttagtaacactttggccaagttagcacaaaaatgaaaccatgcacgaaagaaccttgtttccaagtcaatcgatgtgagtgctattatagacgatccatgtttcttccacaataacatacacaacctagtgattgtgcaaatgctacaacgaagatctatatcaaccaggacgtaccagaggagatataagaccggtgcggcgggtagacctaggagggcagacctaggagatgcgcagaaccaagctggcgagcagtgggagctccttgtccagccagccgggctctgggaatagtcgcacggatatcaactggctcttctccaacaacatggacctgcattttttttcttcttttagccatcgaacaattgacatgagccaagattcaatcaaactaacaacaaatcacacataattggatcaaataggtgccagatttgataggatcagggcataggatatgttagcatatttcaattccaaaatcgtccatatagagggcaaataattcaacataaatgatgagcttaacaacaatagggaggcaagtaagcaatgaaaggaaacactaacctgcatagtacatggaagatatttcccatcaaatgtgaccacacgatcttttccatcagcaccatgtaccttgtttttccatcagcacctacctagtcaaccgaacagtagaagtcgatagctgacatgctgcagtaggaagcaattaccctaatgcattattttttttgcaaaggatataagcatgtcgaccaaaattacacagtcagtagcctttaaatacatactattagtccgcatcctaatactcacatttccacctgttaccaattaccactattgaaagaatatagtgattgatctagacaacgaaatactgaaaccccaggggtgggtggctttatataattttttgagtgaaaggtgcttactttacatcagttctcactatatacaaacctaagcttatcagttcattaaccgtatcgcgtgactctgtattacatggacaaatagaaaatagaatgcaataggcagaaatcttacatttcattgccaaacttctcatcgataatttctttgatgctctccacaaaatgtacaacagatttattcaacctgtgtccaatatataataaaaaaacctattaatatgaattgccatcttgtgtatctaagcaagaaagcagactgatcaacataatctattagaaaacaaatagaccaaattagaatccacctagcttatgaatatgatagcaccactctttaatctatcttaagaaccgaaggaaatcaagcctagaatatagatgacaatcaaattttagacacagagaaagatccttttgttgcgtacagtgtactacgctgccaccatcacccataactttatgtgaggcaccgttgcttctagggatgaaaatggccgaaaacaatatcattactttattgtttttgacggaaacggtcgggaaatttccattttcttgaattcaactatttagtgtcaacttcaatgccactctgacaaaaattggaaaagctaaattttagacagcaacagtcagtaaaattattattatcatattagttttgcggaaacggtatcgatgtggtcggaaaatttccatactattttcaccctagccgcttcactacttctactgcttacctagtcctgactgcaagaaagcacaactacattcaagataaccaatcacacatgtcattgaattcatgatttgactaaagatcattttttttatgaattaaaatcttagacacaaagacatgaactctacctaaatgatactatagaattgcttggaacaaattatatttacgcatacttagttattagtaaaagctacagaaatgtacagcaattcaacatcaacataggtgggtttcatgacatcagtttgaataaaaaaaattgacgtagcaaatgcctatattcaaaatagtaataggtagtaatatggtggaagaacaacattaccagtgcacaaccctctccgcagcttccaattcatacatgtaacaaagcaattgtagcttgcatgctcctcttctcatcaggccttcctcgcattgcctgtcatcttgacagtgacaagaacctactctgccactagcacgcaagcctcaaattcatcggttgaccaacataggaatcagctactggattgataatctagttcaatataattatatcttatcagctagcatacaaaagcacgtagatagaaaaagacaaaagagcagataacttacaaaaaatctataaatctcttgctgcaggttgcaccacctatgatgaatggctgaggatacctataatttttttttaagataatagatgcctgtaggtagcatcctccaatccaaacatagcttttaaaaatacataaaactggaaggtatcacaaaactcaacagtaactacttcctgaaacatacctgaatcacttagtaagaaatccatccccaccacactatccaacactgaagatttaccaggattctgttgaccataccagtaaagttcaaatgtcaaattacaacattacttttccaaccatgcatataggaatgcaaacgtgcttaaaatattaatgaaagcagtaatctagttgagaaaatagcactgaactctgacaagcttgacttggagtggcttgaagctgatttccatgtctgcccggtcgtccggcaaactcaccagcttgctgtcaggctgtgacaaaatagagaacaccacaaatttgcacagtttgcatagaaaaaactgaccatttggagaaaatttgcattgcaaggtggtaaaaataggtactttggggacctggccaaggtcctgcaagaacttcttgataggatggccatgatctctttccaatttgggctcggtgttgtgatgcagttaacaggctaggaaaatgcatcaatgaatgaccctgcatttattaatatgaaagtcagttgtaatgccactttaatctttaatatctgcaattgcttgcctctgcagctcactgaatcaagttatggaaaagttcttcgcaacaaaactaaaatgttctagccatttaatgaactctacgaagcatggattctatcattaaaaagaagtaaagatgtaaactgtgtataaaaagaattgcaatacagccaacacattcatagcgcatgacccaattcactcaaagcaaacaaaggaagcgaaaagaagatggaaacatatgcaaatgcagacacatgcagcaactgaaaccaaaaaaaaaaagtccataaattggaccacgagaattccccgtcagctaacaatcaagcaaaccactgccggaatcaagcaaacattgaactggccagctctttcttacaggaattcagcaagagaaaaaaaagaaacacaaaaaaatttaaggaacacacaatgacagttttacacaaaattagggagggtaaaaggaagttatcttaattaagtaaatataaggcataaaataaacaatgtaaaattatccttgtcctgaaaaggaaaattagcattctatcgtaaatgcaacatgtagaaacttaaaattagccgcaccaaaccatgcctcctagaaaaatgactctttgacagttattggtataatacccatcacgatacttcagatgagacagggatgcaaagtataaacaatatatctacatataatagctaagctcacctacatagaatggaaaggcagaaaacaatatcataagcaagtccagatagcagtcatcacgtcaacaacattagtcatcctgcttgatctgaaaaagaaagcaacaactgtttagcatccaagaattagactgatgttcagtctcaaatgcaaggaaaaacactaaatgggttactaatataacagagcattattctagactatttccatctaagaatatattgcatcaaaacagaaacaaggtcgacacatgaataatttcttagcactgtagtgatgtaaatggaatctagtatatgacacaatgctactggtgtaataggacatcctagctaggaaatattactgctgccttctaatcatcaccgaataaatagacaaattatgtaaccttgttttttccccagctgataaaaaaccctctatacttcaaccaaaaaaactattccctgcagatgtgtagaaaaaaaactaagtagatgatacatcatgatagtaacccttttctcttgtgagaaggcgcctctgttccaatgatatgtatggacctgacattgacaatgatgcaacgcatatcatcttgcaaagattggttcaaacacaagtagcagttcttttttttagatggtacatagataacaaacaataatgatagctctaagatgccaacaagaaagggatggaccaaggttggcacaaccctttatgtgctgctgatcccttctgcccacctacgtatctctcccttattcgtatgctttttatgatctagtttttgtttggggacacagatcctctgccattgtgtgtagtagacagtggtagtagtattatcatgcacaacacatggctctgacaaaatgaatagttggtcatgttcctctcagacaaaaaagaaagaaaatccaactcttttcggttctggaccctttttgctgcctacccatgcccaacaacagaggatccttaattgcttcctagggtttgttttttttttctgttcaggattcatctagttatgcagctattgatccaattagtttgcttattgcgttgtcatcaagctgaaaaaaatttatgtaagaggtttcaggtatacaggcttacttccagttggtgaagggcgagagggcactcgctgaggaacttgatggtgagcatgatgagaaccgggacggagtccttgcgggtatcatgaggtcgatcatggtgtcagagatgagtttgtcggtgagctcattgctgccgtctccgatgaggacatcgatggcgtcccgcggcggccctccttgccctcttgtcctggatgatcctttgtatcagcctcgccatcttcttcttggcctgaccaccaccaccacacacacacatcccaggttcagatttcaaaggttaacatgtaacatctccaattcagtgtcaataaggttactgctgtaagcaaacatgtatttttccacacactgtggttgaaacaataatacaagcatttatgttttttcaaataaagtcctgaaagtaaaatgagcaatgcaaaaagaaatccagatgttttctatattgaaatgttctttttgctacaacatgacaggccttacatcaagaaagttaacacaaagaaggtaaatatgccccaaaaaattatatttccactatggtaaaatttcaattaaataatgtcaaaggttaatcagtgaaacatacaaaatcataaagattcaacctgtgaaggtgaacttgcccttttaccaacaggatgcctttgtctactttgtattaaaatacaaccattgtttaataaaattttaaaaaatgtgctactgaaagtataacaattcccatatgttgataaacaaaattgaagcagggactgccaatataataatccattcaattaatggtccaaaaatggcagcaagccagcaacgcatgccgctgaataaaaacattaaactgaaggcccagacaaaatgagcacctaagaaaaaaagaccatatgcggataatgaagaaccataagactgaattacttgggatgcttgtgcccacaagaaatctcggagccacccattaatcgtagtggaactctgtgcaaagtttccccctgtgatatgagttaccaccccttgatcacttatagtaccccaaacatccgattgcattttccaactgaaatggaaaatgactaccgaaatggaattgtacatccagaatagacataagaaaacatgatcccaggcggatacttgatatgttccccctcgcccaagccaatcgcaagggaagcgaaaaccaagatttgctttatcgggtatcaaacggaaactgcgagcaaataaaacaactttcaaaagtattaaactcaccgcaagttatcttgctccaattgttagcatacactgtgaccaattcaccctacaatgaagaagagcgactcatcaaattaacatgcatagttcctaggtgtaattactgccatagtaaaataaccatgtgtctgtggtgtggataattctgtttagaagttcaagcccatgaattaacaacagatttcaagcacactcatattatcagtgcacaagcacatagtacaattatttctctgcagaaaaataagaataggcagacattttattcccatgaacatacactgacatatgcataacaattaatcattagcagatcaatttttctatctatgttgtccttgagacatgtgtgtaggtgaacatacactgacatatgcataacaattaatcacagcatgatgtttactgtagtgagatttcaattctatgtagaaagatctacattttcatcatattggagtcaggaagggtacaataacagcagcatatgcttagataaatggataaattctggtacctagaccaacattcaaatatactagatactgggacgcgccacctatacacaattcttgttattaattgtttatacagttaaataacatataacaattagaaatgtacaaggcgagagacgaagaaaggaacactcacaattttgtgctgaacttattgaagaaaaaacatatagatacaaaacaaaattcacgagtccagcctgacgttaaaccatgtaagcagatgcattggcttgaaccctccattttcaaccaatttgtagtgatatccttttgggtggggttgggtgtgggggggggggtgcatgctgggccagccagtgtcactgacaaaacacaagtaaaatggcttgcaacaaaaaatatatttccacattttccttcttaagtagcttgcaaaaatatactctagtcagtttatctggtttactgcttcaactataagttaagtcccttaatttgtcaacgaatccgatttcatccttcaaactgaaaatcagatataacaggtatgtggcatatgaagcaaaattaacaatttaaaaataaaaacaaaatatttagacccacatgtcagtcaaattataagattaaaaataatggaccccacttcctccacttcatcatctccctttctcttctctatctcctccccttcttccccagatgcgtggcattggtgagagcggaggcgcagcggaggccggcgagtgggggcgtgacggggagggaggagcttcaatacggcggaactataaaaaggccctaatcccaaccaacacctgcatgtaaccaacaagtgcgatgaccaaatttttcgcacgaactccacagcgcttcacgatctgaaccaacatcccgatcaccgatactaaccaaaacgaaaacgacctaactgcatctccaacaaatcggcgagatctatatttccacctaaatcttccatagcctctcacgaataatcaagatacatttgtgtaaaccaagcagctgcaggttgtgatgataagttttttctatgatccttgtccttgtttgttttggcggtatttgtgattatcagtgatatagatgattggggggggggggggtattatctttatatgatcatcagcatgtccttgttatgttgttaggaatagtatgcgtaccttcaaggtcaacttttggaggagactgtctcagatgaaggctgatcacgagccgtcagcgagcaacaagagactccctgttattaaccataattacaaaaggtaattatttcaatcagcatgagttattgttggctgtgtacatccaatcggatgtagaggccaggttaatcccattttctaaaaaagcatgagttattgttgcatgaaactaattatcagaagcatatcataagagaatatatatgtaaacaattatgtatgtcgcctgagtttgataaattccttctcctccctattagatttatcttttattccactgatgggaagtcttcatatatgtaacattctgaagatttgttcttcatatatgtaacgttctaagaacaattacctctaatcaagagacagcataagcatatgttgttcaatttgcagtaaacggtatgctaccttgacgccccagatgatgaggcagaagatggtgaacaggaggacgaagcactgaagcagaggaatccgaggaggatctggcagcggcgggagatgccgctgtcgccagcgcggtccttgtccggtccctcgtgcgctcgccggacttgcgggccccgtcgcggagggtgccggagaagcggctgacggaggaggaccggagtggcgacaggatgcggccggcgaggacggcggagtggcggcgtgcggatggggaaggcgaggacggcggcggggcggcgcgatgtggaccgggaggggcggcctgcagcggggcgacgcggcggatgggaaggcgaggacggcggcggggcgaggaaggagaaggtagttgcattttttttacttacgcggacgcggaggagacagtcagagcaatgtcgtccgttggtaaaataaaaataaatcagtactctcttcgtcccacagggattttgtgataaaaaaataaaaataaattagtaatcccttcgtaccacaatacaagggattttgagtttttgattgcaacgtttgatcactcgtcttattcaatttttttttacaaatataaaaaagggtgaatagctaaaatggtccaccaagttttatctgaggctcagtttagtccttaatattccaatctatccatattagtccttcaagttttcattttaattcaaacttatctttgaaccaacaactctctttataaatgacacttatacccctcatcattcacatatataagagaaaaattgcatgcttaatttttttatagataatacacagtatattatgtaaaacgaaaaaaaattatgtactaacaagtatatacgatagcaattgcttaagttttatgtgcacatgttgaaataatgggaagtacatctgtaatgttgtttatttatgtttgctttctcttttctagtatatagatgtatacaaattaagggcaaaaaggacattttctaatagaaatattgactagaaaaagccatatgacatattaagtggacccaaggatgatttcaagccaaaacaaatatttgaaggacctatgtggacaaaatgaaacgtgaaggaccaaattgagccttcactgaaacttgagggactaaattagctattcaccctataaaaaacgaaaagttgtgcttaaagtactataaataataaagtaagtcacaaataaaataaatactaattttaaaaaaatttgaataagacgagtggttaaacgttgcaaataaaaacttaaaatcccttatattatgggatattatgggatggaaggagtaatccatatacgtagagattttttgagctggtagtgaaaagtggcaaaataaaaataaatcagtgaacccgaatggcaaatcatccaagtcctgactttgggaagatggcaattggcaaatggagtagtccaaaatcccacactcgtcaggcccgctagggtttcaggcttccgaatccgagcagctccattccccaaatcgcctcttgtctcgcgccctcccgccccgttgccggcgacgagcgctgcagggcacagggtgctcaggctgcagcttcgcctgtccccgccatctgccggacaccaagccccgccccaagtcctagcctgccatccgcccgccgcccgccagttgctgcctgactgtctcaactgttcaccgtgcgtaccctgcaggtatttgtttgtttcgtgtgtatacctttagtttttggcgcagattgtagtctgcagaatcgaccctacttgtcaatttcagggctaaaatttcattgttgagtcagtatgtgctatatttcacattgtttttttgcaccatagaataccgttgatgtgtcaggaaccaaatgattttggttcagacaaattcgaaagagattcaaatatggcaattagctaactagtaggaatcctaacacagcaaataattaaaattgtaatgctgaaattaactagaatggaaggaaatatatgtgtgcgccgcaagaacaagaggggaaattatattagggttcagattcgataaagagttacagccaaaacacggggcttatattgagtacgccctctgctagacgacaacgacgatgacgtccacagtacggcaattcttcccctctgtagcacatcgcggcgaatcagggccacccgatcttcataacccttccaatgaatcggtatctcacaatctcagccgtcgattctactacagctatcccccttaactctgaacttccaagtctgattcttcttcaggcctcacatgatgcgtgtttcttttgctgtaacagcgtagttaagatgaatcaactaccatggagtctttcactaaaatcaagacttctcttggtttgcgatgaaaatgaagtttcaaacatgtattcaattacttttgctgttctggcctgttcatggtgtgaatatcgcattgtaaatcaattgaatgacgatcattccatgtctaatatggcagacatttacccatgaatggctattttgttggtgctcgcaacgacttcctgggttatatgctccagtaatgtggaaacaagtataaaaccttgtctgccgtatgcttttatcatgttaacttgttagtagattctttttcttttttaaaaaaaacatggcagatatcaacagttgcggtagtaatttcgcttcatattattcactttcttcgattggtcatcttgagtggtttcctctttcttggttacattctgctactgtgttgttccttcatgcaagtgtactggtcatctttttttcccataatgatgtttgctgaattaactaggagcttagcctgttgtgttttgtgaatgtatgcggaaaatgaataagattttgtataaaaataatgaactgggtatttttttttcaaccttctgagtcctttcatgcaaacaacaataattgttttctcttgataacaaagcatgaactcctggttatcggtctgtaccttgttcagtgcctttcataattagtttaagaatttctaatacactggatgttttagaaccttccattactgggagttgcaaaagttaattggagataatctaaatgaatccctttattagtgttgttctgaaaatagaaatgataggccattttcttttctgcagtttcctaccaaagaaaggtgcttaacaatttgttgtcacaaaccagaatggccccaggcacatcaggtagtatgcccacctcttaaatatactgcatattttttaatgtcttagtattagtatgtacctttgcatttttgtgcagcacaaatggtgataatttaagcttccattagtgaaaatttcttgttttagagaattagctcgtatagaaaattataatgacttggttgtcattgaaactgaagttcttttaaaatttactttaggtcagccggagagcaaggggcagaaaaaaacggtacaagtctaattctacctcttttttcatataaaactttcactgaatatttttatctagcaagaaagtatgaatttgcagattaacattggttatgaactggcgcatcaagcatgggacttcaaaatacaacaaggaagttgcagggcaaaaattccttcaaatataccgcggcagtatgatcctatacagaaccttgattctgtgttaatttttgatttgatggataattcaaatgggcttcactgcttggagattatgacaaactgcctgcataagaacatattgcatgctccaattgttcagaagaaggaggatgttgactgcatttctgtatggcatgagccttacacaggcaatcttcttgcatatttggaatctactttgttaggggccaaacatatggttggggaaaaggttgtgctcccaacacctgtgctacagaatcttataaggtgtgtctttgttgccagctttacgtaatgcattaagatatataaagtcatgtaatagtattgttgttttagtcaagtttttgatggattgaagatgctgaggctctgtgggaaataccatggaaactttacacttgagaagacatactattacaagaagaatggaaatgaaatcattgtgaaacttgctaattttgaagttaaaggtaatgcaacctatcgaccgttgagatacaagatcaccatttagggtagaaacaagtagagatatgtaagcacattatttagatgacgttttcaatataattaatgtttcaatttcagatcaggtgaagtctactccagtattgcaagctaaggactgccaggctgttggtgatgcactcagaaagatctcaaagatggctaaagatcgaaaagatcttgattttgattgcagtcaaattgatagccttgctgaagaacttagggagttttccttgtaagtataccgtgattttctagagagttaatatcagtatatgttccttgtaagtatatgttctgatgtgtggttaacttgttctataatcgcaaatctttaaatttcaaagttagctatgcctattgtgaactgatgcttgagtacctgtctatagtttatctactaaacttttgctttgatttgaatcatggctgcttttggttagtcaatgctcttttatctgaggaatcaattgatgattgtgtaatttggatggtcttgagtgttcctaattttggctaagcagttcatattcagcaatagcatcttgctgtaaaaccaagaacaatgtaaatgatcattgtttcgtactttaggtagctaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3888 - DNA, 736 bp, Oryza sativa
  unsure (1)..(736): unsure at all n locations
gcggccccattagttnctcgttggtacagtagttcatcaaatggatccatggcgtgcgtcatgttgggggcgaagaccatggcgacgttgcggctgcccatcttgttgctccgctcctccctcgccacgtccgccatcagctgcaccgcccagtccagcagcgccgccttcgccgccggcagccgcgcgcacagcctcgcgcagtcgtcggcggactggcaccgcgtcacctccgccgccggcagcgagtccagcatcccgccggggagctcgcggaaccaggccttgatgagccccgccaggcagtgcacgtccacgccgccctccgggagcacgccggagttgagctgctcccggaccgcctgctcctgggcgtcgtcggcggcgatgcggaagatgccctccgccttcagcccgccctgctcgtagagccgccgctgcatcaggaggaggatgcatattgcctgatacagatccaaactgtcattgttgcttctgggacattggagctgaataaggaagcatgttgcttgtttacctcactgttgttcaacttaataatgtttttttttgataaaggaagcttttattaatctcagacgattacatcaagttgatagaaccatactaagaaaactcccggcctctgcataactaggatgcacacaggccaaacacacaaacccacaaaaagagttgtaacaagagaagggaagcagtaaaaatcagggagcac

SEQ ID NO: 3889 - DNA, 746 bp, Oryza sativa
ccagcggatatatttcgttctactgcaagtagttcatcacattcacctcagtagctagctgcatgaccagagatgctagtttcggatgttcatcaggatccatacttccaaaagcaagtgccttgaagtagtaccaaaactcttcttcggatggcctcttcaccctgatgggttgggttgtcccaaacttagcaatgtcctctgttgtacctatcactacaaccttaattccaataccgggcatattctgcaaatatgattggaattttgtccaagctgcctcatccacatcccaaatgaactcaataacaaacaaatatttcccttgagaagccttggagttaagcgagagctctccggtcttcagatcgtcttctttaaagaaaaatatatgggagaagcagttgcgcaccctctcatccaggcaagcatgttgcacaagagttttctttccaatccttggtgggccaataataggaagaatgctaacatacggatcatgaggatcattgcaaagcaagaaattgatgacttgctccttctcaatacggctgccaaacatacaattctctatgtatagatatgtactgtaaggctgacgtggtagacgagggtggctaccaaggagaatgacaaattccctcatatctgcaatcttagtttctaaaccatcaacaacatcttttgatgaactactgtaccatctgattaggcgcatggtcataagctgtttctgtgtgaaaatg

SEQ ID NO: 3890 - DNA, 838 bp, Oryza sativa
  unsure (1)..(838): unsure at all n locations
tatggcntttnttngttgatttccttcgtctgcaagtagttcatcaagaccatatcatttaatcattccaaggggaaaaaatgaattctacaggatgaagccactcagttcattctataattaattgagatctcactatgcataccaagtgtgttcaactgatgaagctggtcaagtttgcagatggaagaaatgttgttatctgcatgagaaattacagagatccagtcatcaagctaccagcagaaacaaaatacaactgacaaaacatagcatttgtgcatagcattaccatttagaatcaatgctcccaggcttgtcaaagatttgacctcatccattgttttaagtttattcttgccagcattcaatacctgtacaacaggagaggagcaactgccaatcattgcaagtgaagtaatcaggctaagatccttttgcggggcagagaagtaactcacctgcagctttgagaggccttcaacaccttttaggctcacaagcttgttttcaataaccgaaagccacttcaaattggcacagtttgatagacccttcagcattcaaaaccacaatgtgagtggaaaaaaaaaagatactctgatgaacacagccacagcaatgatttaatggaacgattagccatcaattctctacttcaatgaactcaaagaataatccagaccgaatgggacatcaaattagtccattatatgactttctaaaagggtattacgggattcatccttttaactattcaatgtttcagatgggattacccagtgcctatgcttgtagagaacacagttacaccgacatcgcatatattcatacaggg

SEQ ID NO: 3891 - DNA, 778 bp, Oryza sativa
  unsure (1)..(778): unsure at all n locations
gagggtttgtcctntnagatggtacagtagttcatcaaacaaaagagttgttttacagtccagtttggaacaggcaaagaataatgatgttccctccacctaatttacttctgaatgtttttctgctgcagttctttccaagaatcctattttcactattggtgatgctttgatgaaggcaaaggccatgaaaaaggtttgtattatttagttttgcaaaaaaaaaagacctatcagctttaatatgcactttttcctgttttacatgactaatgttttgtcattaccttcctcagctatccttatctcactgccagatagaaaaaattggttcttctctcactgcgtgtgtggaactgaaggaacttagacttgctcacaacaagatcactgtatgtatatggacttatggatagcatatgtctgggtctcttttgcacattgttttttttttctgctcgaaagcatgttacattccacttggtcactctgtaacatcttgctgaactctgtctgattcacagacaattccatcagacctggcaaaaaatgtcaaaattttgaaccttgatttaggaaacaacttaattgagaggagatcagatttggaggtttgcatctgattaattttctcccacccttctacattcataatatctttacactggctcagnctatcttttttctattctttttctttttttttgggttaggtcctttctgaattgcactacttgaggaacctaaacttgcanggaaaatctattgctgagaaaga

SEQ ID NO: 3892 - DNA, 769 bp, Oryza sativa
  unsure (1)..(769): unsure at all n locations
gagggatgtgcgnctctttgtggtacagtagttcatcattttctgctttgttcaaactttgtagtctcatttctgatatatggaaatgggaggggctgagctcctcttgattaaaaaaaaaagtagtaagtacttatgcacccgtgttccatattttatcaaaatgttctgccacacgattccatgtaaatattatagttcattctttgttttacaggaaggcaaacgaagctgacgatgggataggcatatagcatgtttttactccagtgcagcatctgagtcgccctcttctttctttctttggggacccatctgtcttgaacaggcagctatgtaatgttactccagaccaggatgttcgaccttctgaatctgagctcttcttgttaggaacaccttgctttagtggtaaactaaaatgcttgacacatagtttgatgattgatggatgacttttttttcattgactgaatattttgtgttcgagagctggaagtctggaactattcagatttcagggcttcgggggtacttatagtacttcttacttacatcagccttatactattgctgtgctccagcatttccacgatgttattttgtggcgtgcttcttctggcgacattgctccctgtttgccatgacacatgcaaattaaccgcatacaaaatacgggtaggaagtatccgcggggaacagtaaatgggctaagcgatttgggcttattcaagcgtgttactagaggatggggcgcgccgtctcgtat

SEQ ID NO: 3893 - DNA, 741 bp, Oryza sativa
cacaccttagattgcgttctactgcaagtagttcatcatttcccttcccttgcgattggcttgggcgagggggaacatatcaagtatccgcctgggatcatgttttcttatgtactattctggatgtacaactccatttcggtagtcattttccattttagtcgctaaatgcaatcctatgtctggggtactattaactatcaacgggtggtgactcatatgacagggcgaaactttgcacagagatccactacggatcatgggtggctccgagagttcttgtgggcacaagcatccgaagaaattcagcttatggctcttcattatccgcatatggactttttttcttaggtgctcattatgtctgggccttcagcttaatgtttttattcaccggcatgcgttgctggcttgctgccatttttggaccattaattgaatggattattatatcggcagtccctgcttcaattttgtttatcaacatatgggaattgatatactttcagtagcacattttttaaaattttattaaacaatggctgtattataatacacagcagacaaaggcatcctgttggtaaaagggcaagatcaccttcacaggttgaatctttatgattatggatgattcactgaataacctttgcattatttaattgcaattgtaccatagtggaaatataattgtttggggcatatttaccttctttgggtaactatcttgatgcaaggcctgtg

SEQ ID NO: 3894 - DNA, 758 bp, Oryza sativa
  unsure (1)..(758): unsure at all n locations
nagtgggcacatatcaagtatctgcttggagcaatgttttcgtatgtgtattccgnatgcccanttcatttcggttagtcattatcnatttcagttggaaaatgcaatcgtatgtttggggtactataagtgatcaaggggtggtaactcatatcacaggggcaaactttgcacagagttcccattacgattaatgggtggctccgagttttcttgtgggcacaagcatcccaagtaatacagtcttatggttcttcattatccgcatatggtctttttatcctaggagctcattttgtctgggccttcagtttcatgttttttatttcagcggcatgcgttgctgactcgctcccatttttggaccattaattgaatggattattacataggcagtccctgctacaatcttgttgatcaacatatggaaattgttatactttcagtagcacattttttagatttttattgaccgatggttgtattttaatacaaagtacactaaggcatcctgttggtaaaagggcatgttccccttcgcaggttgaatctttatgacttggtatgtttcactgatcacccgttaacattatttaattgaaatttagccatagtggaaatataattttttggggcatattcaccttctttgtgtgacctctcttcatgtaaggcctgtcatgttgtagcaaaaagagcatttcgatatagacaacatctggtgatgaactactgtaccatatagaggcgaatccgcg

SEQ ID NO: 3895 - DNA, 725 bp, Oryza sativa
agcccttgacttcagtggtacagtagttcatcactgatcatcaaagaagacttggtataggcccattaaactcaactgaggcctatcccgggagagtgaaaaaatggcatctaccatgagttctaccagtataacccgaacggatcagtctggggtaacatagtttggggccactcggtctcgacagatctcatcaactggatccgtcttgaacctgcaatagaaggaaatactccgagcgacataaacggttgttggactggttcagcaacaatcctcactggtgatcaaccggttatcatatataccggtgccgacacggagaagcgtcaggttcaaaacattgtgctaccaaagaaccggtctgatccttacctgagggaatggaccaagccaaaaaacaaccctttgatcgaaccggtcggtccgggtttgaactcaaaccaattcagagatccgacaaccggttggataggaccggatgggctatggagaatagcagttggggctgagctgaatggctacagtgcagcacttttgtacaagagcaaagactttatgcagtggactagagtagatcacccattgtattcttctaatgcatccaacatgtgggagtgcccggatttctttgcagtatttgctggcaagaacaatggactggacctctttgcaactttcccaaatgcgcccagcatggtcttaaaagagcttggattcctgta

SEQ ID NO: 3896 - DNA, 738 bp, Oryza sativa
gcgcattcacctactagtggtacagtagttcatcattcgttgaagaagagaggagagagatcgaggtaggatattggatatttctttcagatcagttggtggcttgtcgcttgagcttgacaatggacgtggccgggggctgcaaagaagtcgaggaggtggaggctgttgacggcggctatcacagacgccgatggagatcggttggcccaccgacgttcgacacgtcgaccacgtcaacttccaccgagtacatggcttgcagggccctcccgtggagctacagcccgaggtctgcggaaacgcccctagcgcaaggtaagcgtcttcttgttctccatctgcggcggccagagctgcggctgacaactgtattattattatggatatggaatattgcacaagacggtgttcggtgtgtcacggagtcgatgcactgctcgtacgacgcgcgggggaacagcgtaccgagcatactcctgctgatgcagcggtggctctacaagcatggcgggctgaaggctgagggcatcttccgcatcggcggcgacgacgcccaagagcaagctgtccggtagcatctcaactacgcttgctcgcgagaggcacgctggacgtgcactgtctggcgcggctcatctaggcctcgatctcggagctcccccgctggatgctggactccctggccgcaggggacgtgacgcagagccaattcgccgacgactgttctgagctgtg

SEQ ID NO: 3897 - DNA, 1309 bp, Oryza sativa
  unsure (1)..(1309): unsure at all n locations
cgctgtnccctttgattgtactacttcagcnnnnnnnnnnnnnnnnnnnnnnnnnnnnnnnnnnncactgcatttggctgtcaattcatctaatctcttccaaagctcattgaatttttttctcctggttctgattgcacagcctcttgaacttgttcatgagctctttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaaaggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgagggaaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagaatatcgatgacatgcgcatacatctcagatgcaacaaatgcacaagtaatgtttctgtggtatttctgaacaccaggtagaaaacatgtatgcttggtaacaactgacactgtccaataatccttccatttccccttatacgcgtgcactctctagggacaaccatctttttccttaacacaccgaacttcatattgcgacccgttggacttggcaacccaaaactctctatgaagtgacacttgaaaatgttttaccccctccttcatatcttctgctctactataaatcgctccctgaataacctcattttctttgtactcccatctcacactatcctcttcagagacgatcagcccnagaaaaaatcctcactagccccattcttgctggattaaatatncgnctcatcatcttgacgaatcacctttnctctatcacgctcatttgtcagaattctnccctctccattttaattcacaattgcaaccgacaagnct

SEQ ID NO: 3898 - DNA, 5644 bp, Oryza sativa
cctttccttttatcaaaatggcacggcaatctccccctggttgccaactccaccgggttaatgcatcttgagctactacgccccgtcctctcgtgcgttgacctcctccacagaagtctcgttaacttcagcacttggtccctcgccatcatccatgttcatttgcacacctggatccttcgggtgaacaaacggaaccaaagctagaggccacccgcgttgcaatgcattttccaaataccatctccacactcgagagttttgaactggcattagttcccaataaaaaccctcagttgcccaacttactataacattgattgttatgtcacttgtctgtggatcaactctcaagcccttcattaaccatccttttatagaaggtacactcctctcagccgatctatcaattcccctttctgatacaataaaatctgacagatctaccccagttggcccgtaagggacgtttgctggtccatggtaaacttggaatatttgtttgttggacatatctgtcaacgaaataactagatcatattactctttcatgcaataaacatctacaacgtaatatcttcttgtataagccaatgcaacggtaatgtattgattccaaactagcagatctacgaattaaccgatatctacaatacgcacttctagattagtacaactaaaaccctaaaaatataatgcatttattcaaacaaatttttaaagaatacacactatttacctcaataatcacatataggatctatgaatattacctgaaattggcgtctgaatccggcagggcttcgccccttcttctcttctcctcccctctcttcttttttttcactggaattgaggagagaagaatgagggctgggggctgggcagcagcccttttataggcagcgaggcctgccgcccggccagagggcggcaaggggccgcctgcaaaatagccggccccgactggcttttttgtattcgggccccttgccgccccaccagagggcggaagggttttcctgcaaaaaaccctccctccgtcaccgcccgttcctcccccgtttgccacgtcagcttgccgccccagaggtgggcggcagggtctatttttgtaatttttttggccgatagattatttctgtaaatatttttttaaaaaaatctaaaaccgaaaaaaattcctcaattcaaccaaggcatcttcgacatctatctagtttcaccgcaagaattaattacagccattagcattttcttacatggttgatgaaccacacagatcggggtggtgattcttgtaatactggtgtcgaccagcaatcaggtaatatgatgatctcacaaaacagaacacaaaggcgcacgctcattacacgcacaaaacagagcacagaaacatacacatgggttcattactgaaacactaaaaacttgatgctttgcaagctggacatcaattagaacataacgatacaaatacagcgcaaaaacaaatacagtgagcattacagaaggtttcttttattactagcatgcaccttgtaatttaggaagattacaacaatatacagcttcctcaactgatcaaaacagatcagaattttagccgtctcatatttgtgcgtgagttgtacacataggaacataccagaaacctaaactaggtaaaaaaaaaaaaaacatagcaccaagccttctgaccataatttcccttgcaaaccaaaaacttggtttcatgttgccagtatgattaggcaatcccaattatcagcaaaacctcaaggcatattcaagttccttctcatcagcacagctgtaacccaactgatatgcgcgtgctgttcagaatcagagcacaagtcagtaattcaatgtaatgaaacaaacgacttatgcattctaaacacagcctacaatcaccgattggtacagtggcaccacacactactattggaatccaataatataaaagtacaaacaaaacggaagatgtgcatacaaaaggctatttgctctgtaggttaaatatgatacaaaggctgggtttagttccacgccaaaattggaagtttgaagaaattggaacgatgtgatggaaaagttggaagtttgtgtgtgtaggaaagttcgatgtgacggaaaaattggaagtttgaagaaaaaagttgaaatctaaacagggccatgctgttgtgcaaggacgatttttttatattattattgaacaatgcctagtagttccaccacctttcccaacatggcctaaagttcaaatcgtgataccaaaagcctaatttcttcataatttcagatatggtggaagaagaaattttcacagtagaaaagttcaaagatattaccaaatcgtccagaacccataaatggctctgcttcatcggtcataccagcttgttgtagatcctacaaattgtgaagtagaaagggttatgaacaagtacataacctgacccccaataacacacataaaattttagcaatgttggaggaagtggttgcagatatggagaacaatatgccagtcaagataaaaacaagttgacagccaaattatttgaaggatacaaaaagaaggctatgtgtaatagacttacagtatcatcatcagcatcccactcatcatcaggacacaaccacctttcaaagcagtgcccagatattgtacaaagcagcagcccactagactggtccaagacaaattcacgacaagcgtcatcgcaaactgaaaaatagaagaaaccaaccatttcacatgtatacaaatctacatttacatgcgcacatgtgactagacactgagaaaaacaaacataccatgaacacggcctgtcttctcacaaatataagcatcaccaatctgggtgtaagagcatgtattcccagaacaagaatgccccttgaccgcatcatcagtgaggcctctgctgcttttccagctagacacctgatcggctattggtttatcaagaataaccttgtcatcgttgaccttcaaaattcacaatagtcacatttaagtcttgtcaatataatacgattccatagctatgtgggaaactataatggagataagaattagtgattacttcaaagggaaggggagcttgactcctttttgagcctgcatctggatataatactccttggattctgtaggtgtatttctcaccaaactcaaccatatcctctctatcttgctggaatttaccgaataatgaaaataccatcaacaaactgatgcagacaactagcagcaagcgaaaatgattgagttgcaacatgtaactgaacttctgttcagtgagtgcaacaaggtcacaaggaaaacaaatatcaacttttagtttgtacattgaactgtttgggtttattcttgaattggtactgaaattgcgtagccattcttagtttcaccataaaactgcagcactacaacatctgaactgtagcttgaaaaggtaggtttcggatggattacctggatgtagagtttcttccaagcgcactccctgagtttggtattgcatgacaggccccaccgcatacaataccttgaaattattggacatggatcaaacatgtgagtgaattctttttattacaacaaatgcaaaattggagcaaatgaagtttcaggtaaagcttacaggcggcgccagagggtctcgtcggacgcaaccacgttcatgaagcggcagacgagggcgcaggagatgagatcctccgatgagaggaacttgaatatctgcaagaacaactccggcgggatattgcagaacatgccgctatcgatctgaggcgccaccgacgccacgtccttctctttcccctttgctctcctcaccctcttgttctgctcctccccgctgccgctatccccatcagattcagactcctgcttcctcttattgttcttcgcatcatctcctaactgcttctccttctcatccccttcctcccgctgcaaccaattacccccaaatcacaaccagattcgcacaagccaatcacgcgagagatcgatcgagaacaacttacaccggtagggtcgtcgccgctagatccagagaggatctccgattcgaggaagctggcgaggccgtcgacgtcgtcctcctcctcttcctcgccgccgccgccgccgccgtcttcgccctcttctcgacctcgcagctcatcctcgagaacaaggtcatcgtccagacccgcggcgtcctcctgaccgtcggccatgctcctccgccaccgcctcgacctcgacgtcgtcgtcgccgacgagatcgccgctcctccccttaccctaatgggagagatattggtgcggttggttggaggatacgtgtcgctccagaccacgacgtcatgggccgaatctcaccgacggcccagctacctcatcctgtcggccactttacgcgatcacttcgattaattaggcccaacgcgattaggccccctatacaacccactttctttattactccattcatcatttcagaatcaaacaaattcgtattcaaatcgacgaaatttcgcaaaattaagataaaaatgtatagattcgacccgcgatgtaatacaagtattttattgtatggagtatttagcatggagtttgaatgaacagggtagtaaattgaagcgaggaaaggtgaaaaggaagccaaatttgcgatttgatgttcatagtggggagcaacttctgaatcttgcaaatgacccgagaagggaccatggccacgacttcacaggagatcgacgtcagagttagcgtgacaccacgatcaccgatttactccgattgctcctcctcgttgtcgctgtcaagatcgccatcgattggtgcgtcatccggcggcgacccggctgcggcggcggagacggagtccaacggcggcgagccctcgaagagctgccgccggagcacgtcgtggaggccgtcgaagagcctcttcttgacggaatccatggcccattcgaggcggttgaggagctcggtggagttgttgttgtacatgaagaggccattgtagaggtcgaagctgtcgctgcaggtgttgtcgacgaggcggagcagcgtctcgtaccccttggtgttgatcggagttgtttggagctccagcatggcgagtgttcgtccgacggtgtgggtgaggaactgcgtctcggcggcgtgcgcgtcgtgctcggcgcagctcatctccaccatgcggcagccctcgcgcgcgaagatgtcgagaaaggcctcggcgcgggcgcggcgcgccgggcagtcgccgacgcggaccttgtcgaacacgaaggggaggccgccccacccgtcgcccgcggactccgggccgaacatagggtgggtgcagatgatgtcgaactcctccgggagcgtgccgaggaggaggttcctggggaactccttgacggagagcacgtcggcgaaaagggtgtcgcggcggagccggtggacggggagcgagcggaggacggcctcggcggagaggatggaggtgacgaggagcaccacatccgggtggcactcgacgagatcgtgcgcgtcggtgaagtacgtcgcgccgagctcggccgccacggcggagtagtctagggaccagtagactacaagacc

SEQ ID NO: 3899 - DNA, 2737 bp, Oryza sativa
  unsure (1)..(2737): unsure at all n locations
agaggggntnggttatgtatacgattgactataggccgaatttatctctgtaccccccatcaaacccatctcctcggctgggaggagaatcagaatccgctttgcgagcttttatgagggtggaatcgagttcgagcggcggcgaatctggagcggcgagattgggggaagcggccggagatggaggaagaagtgacggggagtccaggggggttggggggaaggaagaagatggcggcgggggaagtggagctgaaggaaaaggcggggacggcgtggaaccactcgtacctgaaccaaaagccatggcacccgctctcctacccgaaccaacggcggaagtggatcgccgagcagatccacgccaaccgcgcgcgccgccaggaggaggtgcaccgtgagttcgcgcaagagcaggagttcttccgccagaccgcccttttttccaagaaggacaaggagaaggtataatggaaccggaaccctatgtatatgctaattaccttcttagctaactatgttgctgtatatgtgtctcctaaatcatctgctttgatcatagcttaatctgcttgtgcttttgatccgatatggccattgacaagtagtgttagcaacttagcattgcttatagacattacctaaatgtttgacatgggtttctgtaggatttctttctattcattggcatatttgctccatggatgatgataatacgtgccagtgactgtgcagccccacttttgtgccctcaaagtcaaatatatgtttgttacatgtatcagcatgggacataagtcagtaagttacagtagaaatgaggaaagatttatctgcacttggaccatggacctcaaacctatttaatactgagaaatctagttatgatgattgctagttgcatacaagaggtttatatgtttgttgcatatatcctttataggagcttttatgttaagctgtgatgaacaagtatgcttttatctaagtcttcatgcttcttttgtcacccatgaaaaattcacggttgtcgatatccaatctgtttctcaagttcagatggagataatgaaagctgtgagtttcatgtatgtccgcccacctggctacaacgcagagagtgcaaaagcagctgaaattgaagatgagaagaggaggtctggtgaaggtgatgcaacccaaagtgctgctgctgcaagcacctcttcaatgtaatgtagcatttttttccctgccgtgattcatgaattatttcacatttatcaagcttctaccaaccctattacttctgctcatatcacttctctatattttctttaactttttttttaaaaaaaaaatacaggcctgataaggaacttgacaagacccacgcaggtccagataagaaaaacaggccaaaagatgtttttggccggccattgccaacagaacaagaatttgaagtgctgaaaaatgctccaaggtacttaactttcttcaccttgttttgtgttaaaatcttgaaacaatcactacatgacagtatgacatacagagtttctttttccaaacccaaacaattacccttttcactttattttcattttcacctttttccaatctcaaatgatcaaacatgacattcattttcattacatttttgtgagttatgggagtctaagtcacagggaacgtggaacttagctaagttcctcgctccggatcgaggaactggaactaggcggaacttcgttccgaaaatgggtgggttgtcgttccagtacacggtaggaacaatggaggaacttagcaggatgatatgagggaggaacgagctacgatgagcaaaatatgggaaaggcaatccaaaatttccgaacagaattcatcgctccatgggacgaccgctgcttttgctctttgcagctcgctgccatcgcgcctaggtgcatatatgagcgtgcgctgcactgctgccgccatcgtgaaggggaggatggagaaattgaggcgcgctgcgtgtcgcacccgcttttctcctccatcgctgtccgcggcagcgcagtgccaagccatcgcgctgatcttgccgtcgcttcgagccatctgccatcgcgctatcgactttgtatgaaaaaagaagagcacaatccagggagtcaaactaggaacaccgaacatgttccttaaattgggtacaccgttccggattatcgttccggaaaaactaggaacatgttccatctatcgttccatagttttagaagaggtatacccctcttgttccatcttttttaaagatgacgtcccacgttcctcgatccatcgatctgggaacttttgtgacttagatgggagtaggcttagagcatcattgtgctgccttgagataactcttaagtagcattttatgatttaatatgtttttgttgtactctcaggttggagacaggtgctcctgcgagggttaaaccatttggagttgaagttcgtaacgttagatgtttaaggtgtggaaactatggtcatcagagtggtgaccgagaatgcccactgaaggatgtgatcatgcctaacgaggagagccgactgaaaagggatgatcctcttacagctataatggcacagactgattcaagtgaggttaggttttttttgtcaaaatgttttccctgttgcaatttacattcaaataagcttcctgtccaaggtgggtcagaggtgaattcaaaagtngtaaatcaattnnggacca

SEQ ID NO: 3900 - DNA, 1750 bp, Oryza sativa
  unsure (1)..(1750): unsure at all n locations
tttctattttggtgggcaaaataagaaaaaagatttggaacgagagacgttcctccaaacatttttaaaaagaaattataagtgtgtttggattgaatacgggatcttagagttgaaaccgcacacctcttaccattaccactttcatttgtgctgaccaaatttcatccgatggttgctggtaactcaaagggattcggtgacatgtacagtactacagtgtacacagccagcaggcatattactgaacaaagtcggacagatgattaagcatgttttatttggacagtacagaattaaacaactctgattcaaccgaggaactgatcgaccggcgaagaacagcaatctacagaagaaagaattttgccaatacaatcctatgtacttcctcatcatatagtagtgaccaactagcaaacttgaaactgctcttctggatcttaattactactgcgccatgatcgtccaccagatgaagctgaagcctaccaaggacgatgcactgatcaagctcaggcgatgcgttgcgcctccgctcgccgttggcttggccgctgcaagattcagcaaacaaaagagaggctcagttacaaattacagctacatgtctgtgaatcactggaaatttctaagcaagcttgaaatgatctcatacagagaggttttaatttggctgccagttcatactgtggaaaactgaaacataatctgaattgtgatgttctgagttgacagcgaaaattgttgttctaattaagcacaggtacctgtagatgcagcgtttccagtggaagctgaagaagcagcagtgctacctgcagtgccggcacctgcaggaattgaagagagttcagatcagcatccctctgtaaatgatcatatcagttttttgtgatctgattaaaatgccagagatcatgaattggaggccatgattaaattgtgatccatgattaatttgcgatctctcaattatcaggtgcctcggattcttgtgagaccggagagacaactgcatgctttagctggcactagctagctagagttggtgcatcaaacgacaaactctccagcgaggagaggagcactgttagtgttaaactaagcaataattcagaccattattactctagctaggagaaacaaacaaacaaacaaacaaacaaaagcagtagcagtcaaaccgcatcaaccactgtacgtatgtccactgcaattagtagcagcaatctagccgcatggatcacgccgtgatcgtcgacgagaggaattaattaacgagatcaaaacattgaggaaattgatggaattatgtgtgttaccggcggcggcggccgcggcggtggccgaagaagaagccgacttggcgcaagcggaggcgtctgtggtgacaccccaacgtttggcgaggaggaggccctgcttttgcgcgacgccgaacgcctggagcgcggccttgttggtgaggatggcgcacaagcacgccgtctcgtggcggcggcctccctgagcgggccgcagcacgacgccggcggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3901 - DNA, 3115 bp, Oryza sativa
  unsure (1)..(3115): unsure at all n locations
cgcggtgnnnanagtaggacaanctgcctcgnacccggcgccgnggtggcgttgaggtagccgccgcaggggaccagcttcgacgcgcacgacggcacccccgcggccgcccccgtgtccaccgccgtctgcgccgccgccgagctcgaggctgcgcccacgaataaggccgcgacgacgaccaccaccacggggacgaacgcccgcgccgccataggtgatcagagcgatcgagtgaggtcgcggtgatcgagcgagcgagtgagcgaggtggtgtgggtagagtgtacgtagaggcgtttgtgtgtgggttgggttggcggttggtgcatgatatatgggacgtgtcagtgtgacactgccagggaggtttagttggcggcttgtacgtcggctagctggagtacgtttctttctttccacagctaattaagctagttagatactccctccgtttcaagttataaactttgataaaagtaaaactattttaagtttgattaaatttatagagaagagtagtaatatatttttaacccaagacaaatttagggcatgttcactttgacgtcaaaaaaaaccttaccaaattttagcaacttgccaaattttggtaggatttcttatatagttaccaaaatttggcaacaaactaaatgtagccacttttttgacaactttatcaaaatttagtaaggttgaaaatgacatcaaagtgaacaggcccttaatataaaaatatattcaattattgatttgattaaattaatttagtattataaatactattatatttatttataaacttagtcaaacataaaacagtctaactttgaccaaagtaaaaatatattataacctaaaacggaggtaatagaactcatgcgacgagtaagttataggcattacgctgccaaataaatatttcaaactaaatttaaaatttattgatagttaaagttttacccatttgattttagtcattttttaaaaagtcaataaattatggaaatataatatattattgtactctctctaaagttgaaagtatttaacccatcttgtcgaccgacctgtgtgtttggaaaaatcttaaaaaaaaggtcgatcggaatcggaatggactccggattgggcttagctggatcatcacagaaaaaagcccaccttgttgctccaggcgaacgtggtagagattgtgcagtttttacggccggcgagcagttgaaacttgaaagttgcagggcctcgctcgtactttcctctattctaaaataagctcatttctcagcttacctacacatatcaataaaaaagtaaaaaagataaaaatatcattactgtatttaatcttaatgtaatgattcctttctttatctactttctctgcatttattcagtacttatacaaattctaatataatgattactaaaataaaattatttaggacaaacggtataggctaaaagaacttaggatgggggagtataccgcgggtagccactaaaggacctgttgaggttgtagctaaaatgaaccttactaaatttttgacattgctaaaattttagcaatttaataatattgctatgttttggtgggattttttatgtatttttcaaagtttagtaaaaaaaattaaatgggtgtgcatatttgacaattttattaaaagttgataaagtttatttcggcttgatcaggcccctaaagctgcatattcgtttggtcgcaggctactcgcgcgtgccgggcggtcgtattgctgtccagtacagtgcgacgatctcgatcactgataagatgagcatgcatgtacagtagaggatggttcgagaaacaccacacgcatgcatatgatcgatcgatagcgtcgagggcacgcgcgtaggacgtactctgatcatgcatgcatcccctatcggaaggacaacacagaccagctacggcatcacatcggaatccaatgcaaaactggagtgagtacacctcggcggtctcctctgcagtcctgtatgaactctctctctcttctataatataatggattttagaagaatgtgatacatcctaatcaataacggacacacccattagacagggtgggtcggctggtccagctatggtctatgtagtcccacatctccaaaccttattttagtcctatttctaacacattagttgctagtctactattgaataatcaggtaaatcaagtattttaagtaggaacaaaaatatttatgaaaattcgtgtataagtagtaggatgtgtctattcattgtactaggatatgtcacatctacccaaaatttgttatattataggaccgaacagatggagtataatattgttcgacgaaacatggatatgtgaggatctgtagtaccttttccgtttcatattatacttcttctgttctaaaatattgttcgatgatacatggatatgtgagaatctgaagtactccttccgattcatattatactacttccatttcatattacacatccggtcaaaatctcttatattttaagacagagggagtaagtcatttgattttttccaaactttattaagtttgatcaaatatataggaaaatacagtaatattttcaataataaataaatatatttgttgaaggcatatcatgagaaccttcgaccaaggctgccaaaacctggtgggctcgatcgggcgaagcatagggggttcactaaaggccaagacacttttgccacctgagggcccataacaaagcccatcaaggagcccaaggcacaatagactctagttaccctcacaaatgcccatatcataagggtattcatgtaaattctccttactaattaactctagggtacatgaaccctgtactcattaactttaggttgcatgagtttgtactaaagctataaatagtccatagggcatgtaatgggggattcaaaattccacaaatcaatacaccctgttttactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtagtcatcacaannaaccac

SEQ ID NO: 3902 - DNA, 1912 bp, Oryza sativa
  unsure (1)..(1912): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcacggcaagtgaaaagtgtgcatctctggcttccatcgatcgaccaaagctgctaggagggacctgtccacagtccatcgtctggcggggtccgggtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtgccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtaaggcgagctccatctgctgctgattctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattacttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgtnnnnnnnnnnnnnnnnnnnnnnnnnnnnnnnnnnnnnnnnncttcacccngggacagc

SEQ ID NO: 3903 - DNA, 1972 bp, Oryza sativa
  unsure (1)..(1972): unsure at all n locations
cagcgatgtcttaaatgactacttacatggggtggaatgatttgttaaataaatatttgtcctagaaacaagagaaataaacataggtgagagatttatntatnanccctcnnccncccacccccgcgtgnaanggtagagcacatcttgcagcacgccagcacgacgatactagaggacaacagtagtttctctttgaataattgcttcactttacaaaactggatgcttgggtaatgactaagttggtgaaatatgtgcacgagacggttcggagcatgcacgataccttatggcgcatgcacgaatactttctggcgcaccgatgcagcctcctttattagcgtgagataagagtatttgaccggcatttggcgcatacgaacaatgtaactttcggcgccgatcatgcatgtatctttcggcgccaatcaggcatacccaccataccccaccacgttcacatgtcaggggtatcactcgattttttgcgcctatataagtcgccttaatgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggggatcgatgccaactaatggcttcgaggaatcctgatattcgaggaaggcgcttttttaggtgccctaactatgaccatgaggtattttattatttgcatatgcttattcattccgtatgggcaatcgctttattctttgtaatactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttctttccataaatcctacaacattgggtcgaaggttctttgtttgtccaaatattcttgacgacgatttcatggtaagaatattttgattacatgaatccttattttctcacaacatttactaactttgcttgctttacatctattctttcctccccggaaccaccaaggagatgtcaatacagagaatggatagacaccagaagggttctaactccacctagccgtgttgtgcagcttgaactaccagagcaatacagggttactaaagcgcggtttgagagaggaaagggatcctcacataggggttagctattatcggacaacttggcatattgaaatttctattgtcatgcttccttgtcccattactacatcgtcgttgtgttcaactattgcactacctccctcctagttcgaatctaatatcatctatgtaaccgcaatgcaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3904 - DNA, 1598 bp, Oryza sativa
  unsure (1)..(1598): unsure at all n locations
ccttgcgttgttcctaaatgctttcggccgtaaaccccttccccatcggcaaaattcttttcaacggcattttctaatcccaaatagaacgccgcgacggggtaccttttcagcgccccggcgtttgcgcctacttcacggttaacaagggtggggccccccgcgctcacctccaaagaggacaatcccgagtcgtccccgccgtttccgctacctcgtgggcctcgtggacgacgaccgggaggaaagcccgagcgcctctcctcccaaccgcccgcacgcgcgccgccctttcttgccgcccgcccgccgctccacccaccgccgtcgcgtcggccgtccccgccatcaccgtcgccgcaacgcccgtccccggccgccggccacaaacgccctcctcctcccgccagttgactcagaagggagagagagggatgaggaagggacagaagggagagagagaggaggctaacgtggcagcctgacatgtggggcctacgtgggtccatgctaattcagccgccacgtagcataaaaccggggtcaaaaccacttaggccaagtgctatggtagatgtgactaccatctttaaatttatctattttattcactcatgaattaagaggcaacacatacaatgtatcacctctaacacacaaataccaatatctctaatactctcacacacttcttgaaatttgtgtggaggttgcctcttgatttaggggtggctcatcttctctctctccacttctctcctccacctcatcacccaatccaatgtggcattcttaggggcaacatatgagatattatagtacttgtcctaaagtacttattgtgtccggttttggttagttaagggacgttagatacctatttttgcgcttggaggacgattttgtaactcgatgacaagttgagggaccttcggtgtactttcctatggcccatactcgcacttgggccgtaggacgcggccttgggtggctggtggaaatttctccacgtgacgcaacgcgatcccttctcttccccatttgcgttcgtagcgaatcgcgattccacccaccaccaccaccaccaccactgagagaggcggaggcgctgaccaatcgcgatgcggccgccgtcgccgccgcggccgctggccttcccgacgctggactcgctggcggcgttcctcggctcgcgcctgccggcgtcggcgctggcgtcctggggcacggcgccgggaaccaagaccctcctcaacctctttctcgagctctcacagggggagtgcgtnctcatctncgccgccgccgncggggggccggcatcgcagcagcagcaacagcattccgtcgtccgcgccgtccacgtcgccagcgttcggatccgcaacgggcgcggcgcgctgctgatggagaccgggcagctcctctccgacggcacgctccgctcccgcggcgggctccgcccgctgtcggagaagatgcgccccggcgagacccccgaggccgcggccgtccgcgccgtccgggaggagctcggcgagcgcgtccgcgtccggatcctgggcggcgaggaggcccgcgtggaggagcgggactcg

SEQ ID NO: 3905 - DNA, 4549 bp, Oryza sativa
accaaatttttttcacagattgattactgtgtgttattgttgaataaaaaatgaaaggtccatctttcctcgtcagcttaatttttggattaaactgttcggtgcatgcaatttaatatgatatcaaagtaaaaggtaaagtaaaaggtttcgagtccaatttatggctggtgtgcaactaaataaaaattatagtccatttttatttcacgctaaaggctaatccacttttatatcacactaaaggcttgaaagggcctcgcgtaaagagaagtgttggaatataaaagaattaccatctcttctcaatttaaccttttcccaacgttatttcttgctgatgaactgatgcctcctttcatggttgattgaatctacgagaagttgacaacgttgcttgtgtcgtggctcctgagtcctgacgcggtgcgcgtgacagcgatcatcgtgtcggcgagtgggacgtgggcggttgttttgctcgccgtctcgcgcgaaatctggtggtcgcgccgcccgcccacggcgttttggtcggctaaacaaaacacgtcatgaacaggtgctaactgctaagccaagcgttagccaagtcgctgtacgataaaaacatgtacactgtttctgaaatggaaataaaggttatgggttattaataaaaaaaagtcgctgtacgatactaatacgaccgattattcatcggattattacggtggcggtgccttcatcgggttcaattcctcttccttttccgcgacctgttcacgccaagaacactagcaattcttctatacgctgaagaagaatggagaatctgtccggtcagccaaccacggctctcaaaaccagataaccgggcaaaaattttgaagagattacgccatcgagatcctgccaattgagacctcaagaacaacagctcaaaccaacgtgaccacgtccaaagagagccaaggggaacgtgcaatttcagtggactacctgtccgaaacggcgagaattttgttacttaattacacagtacgacttaaaaaagattaaacatcactcaaactagtaccccagtggatccagcaaggataccgtcgtgtgcacagcaaagccagatcctgatcttacacaaatacagtagaatatcccccggcgttcatgtgagggtagctagctttaggcacatgcagaatcaacgcctctcgtaattaaaacaagaataattatcagattcagtttgagtgtgaaataacgcaagatctgcccatttgatagtcaaaaaagcgtcatatacaatcgttttcaaaatattagaagggcgtgccatataatcaacattctatgtatacggccacgcaagctagagaaccgaacaagtgggagggagagaacattttgaccgttgcttaaaaatttaattagcaatttaaatattggtgaacaggagatttaggcgtgagttgacagggagggttttatatcaaattaccaattcacgtgaaaaccatgggcgaattttatataagaaaaccgctaatgacaattccaaaatctccataagagataggagtgttgtattaggttgtgatcggaggattaaggcgatgcttgtgatacattaaaatggaaatgaagtgagcgcacgcaaaacaagaaatttgttagcacatggattagttgagttttaattattataaatttaaaaattatatttgtttgatattttaaaacaacttgtacaggaaacataacatttggtggtttaaaagatatgctaatagaagttaagataaaatctgtattttaattagaagagatggtagattttttatttttaaattttaaaaataaaccatttgaaatgttatttctaagatatgagcattgatcacgccagtagaattggtatggtaaaataacactaccacgccaatctagctggcatgacaacattatttggtcacaccggtctggctggtgtcagtgttatttggccataccaccttggatgacgtggcaagacaaaactatcacgtcgatctggttggcatgacaacgttattcggccacgtcactctaaccatcatagcaatacaaaactgtaatgccccgcgatgtgcggcgttagtattattttgccacgctaggtgggttagcatgatcaaaatgttttgaaaataagtttcaaaagtatttatttttaaaattaaaaaaaataaataatcaagaaggaaggcgtccaattacccgagcctcgtcagcatagcatgagaccatgagtccagcgcaatgcagtgcagtggactgtagtgcaggacgaggagctagaagagatagatagtggtcgaccagatcagaatcagacaggctggtgcacaagggaagctagtggtgggctggtggcagacgacgattggacacggccgcacttgcatcgcttcggcgcgcgggtcgccgtcgtcgtcgtctctcgtcgcggcgggccttgcactcgtagcgtagcgagcgtcccacccgaaggccggaggcccacgtcgtctgtcacgccaccgcacgaaacataattttttttcatttttattttttttaatatttacaaaaatattatacgggtgaaaatattcatagaaatagatccgcgctcctcgagagcggcagggtgacgtgtgtgagcaagcgctagaggtcgctgagcgggcatgggaattttgcatgcggcgaaaattgcattttgacatcggcgccgtgtgccatgtcaccttgctgccctctacttggacaacagggtcttttttttcaaaatatttttgtcggtataatattttttgtaaatattaaaaaaaattaaaaatgaaaaaaattccacgaaacacgcgtttttgcggagtggcgccaggtgggctcaggagttgtggggccgcatgtcagcgagtgggtgccaggtcgcgggtgcggtggaggagcccccacgtaccgcaatccgagtgtccgactactggactgcttgttgtcttgtgattttgctgtttggtgcccggcccggtggtaaatagcaccaacaccccttgctctattttccttccaagtactacaagtttgaaaaagattattgacctgattatcatagtggattatgtaggcgaagtaaacttggcaaatagtttagatctaagctaagcaatgcagaagataaaatctggtggagtacagctgaaaagaacatagccgactccactgatcttttggaataataaagagaaacccatcagagcatcgcattagaatgacaataaacacttacacatatattctttttgcatgctgttgcttgtgctttataagtcttcttttaagtgtacgtatatatcttgtaaaatttggaatacggaaaatgcaatctgaaatacaatcgtaagattaaatatattgtcctctagaatatggaactcagtgacaaaaataaagtggttaattttgaaattttttgaaccgtagaagcacgtatagcatatgtattattctcttttttaccaggcacgttagcattcttactattccaccctttgtcacatttgattattcccacatttagagttaatctagcatgtcacatcgaaaacttcctgatttactccatgttataaactgcacaaaaatctacaaacggcaacgttgcagtaattggtaaaacaacaggctctatcatataatgtcagctttcaaaggctattaggattacgtgttgaaagactaatttcatctaaattaatcctttagcatacaagagggaagactagagcatccacgtccacacaatcaaagctaattcaaccttcacatataagcattctttaaacctctcaattcaacttaataaggacctcaattatttatttataaacacatgtgaagagaagaaaaaacttttataaatcagttaagaaaagagaccaataattttcttttaaaaaatagtactagcagccaccgaccactcccttgactataggcaacgcgagaagaaaaaaacccagaaatgcgagggatagaacgcaaaaataaataaaggatttatttgaagacgattaaagaaataaattaaatagatttacgaccacaaaaaaggaacgtctccttcctcctcttgctataagctttcgctttcataaaagccattactccctctcctccattgctggcctcccgcctccgcctcctttcgcctcgcctccgccacccatggcttttcgaaaccctagccccgcctccctctccacgccgctcctctccgactccatctcgcccacgcccaccaccaacggccacgcggggcaccataaccacgacgacgacgacgaggagtcgccattaaaaacaaggaatattagaagaggagactagagtccatatagaaatacaattaagaaataactgaaattcggaattaaaaacaaggaatattagaagaggagtatagagtccatatagaaatacaattagaaaatgggtaccgagctcgaattcggcctaagataagcggatcatcaaaggggcacca

SEQ ID NO: 3906 - DNA, 6032 bp, Oryza sativa
  unsure (1)..(6032): unsure at all n locations
gtggcntaannattgagattcacttttnacccgcgatggcggaggagggggggacccgttcgcgttcctatcggaggatcggccggcgtggtggtcgccgcggggggtgttcccggccgacccgttccgcaacgggacgccggggtggtgcggggcgtacgagctcgtgagggcgctcgtgtgcgcgccggtggcggcggcgaggctggtgctgttcgggctctccatcgcggtggggtacgccgccacgtgggtggcgctccgcgggtgggtcgacgtgcgggagcgggcggcgcaagagggcgccgggcccatgccggcgtggcgccgccgcctcatgtggatcacgcggatctccgcgcgctgcatccttttctccttcgggtgagttctagtttccgctgttcgtcgctcggattagcatccctctcaccaaacgcgcactcagaatcgagtctggatcgatgacagatcagaaattagaacaaaaaaactttaatccgatctgcatcggatgatggattagccgctgttaagtttatagaatgaaattgaggtgattagattcgggtggtgagacgaagcactcgaaatctgtggatggattgattcggtggcgcgattggtttcgcggaattttggggtttggtgatttttggggcacgtgtgtgtgggcgtggctttgctgcaatcatttgttaggtgggcgcaacgtagcgtatggaaggtgaagtgaagggtccgtgtgtgagatatgttgtttgtttcgttttctctgcactaattgcggctgggaagagaccgacaacgaggggagggtaccacggtggttcagaagaggttagagactgatctctgcacggcgcctttggttagcttcactacaattgtggatcgaaacgagatggactagcgatgaatgatgatgccttgtctactaggtggtttgggaagatagtgagaaagagtaagaaagccttcctgaaagtattctgaaaattgttggcctttggcgctgataattaattaagttgaggcactaatcaggtgggctgttgtgtggttggatcgaaaatgtggctgctacttagttcaaattggattgctgttcacctgggaattgctcaattggacactctgcacacaaattttgagacgtttgaagtttcaattgttgtgaaaagaatggtgaaaactgcgagcgaatgttgagtggtcaatgctgagaaagcacacacatagcttatcatctctgccaatagttcttctatgcagtaaaatgagaacttgagaagggaactgcccagtgttggtggtcgtgttctgtaagcagttgcagaaatgaacgttttgttcaaacttcaggggacgaagaccacttggatgtggattttgttttatactaaagttttcctttgggccatgatctggagttttggtttttaatctcacatatggattttaatgggaaattttgaaacaactcacttttgctccttgtctatgctgggatatcctgactgagtgcctactgtttgtcattttttcttcttgcaatacaactgtttactgtctgatctttgctaaccacttgttttctactgtcagataccattggataaggaggaaaggaaaacccgcgcctagagagcttgcacctatagttgtctcaaatcatgtatcatacatagaacccatatacttcttctatgagctgttcccgacaatcgtttcttcagattctcatgattccataccatttgttggaacaattatccgagcaatgcaggtatatccattatgttttaaaagccctttttcccagttactttctttgacactattttgcaagttactttcaagtttcaaatttacaacaaatgcataggttatatatgttgacagattctcgccagcttcaaggaagtctgctgtaaatgaaataaaggttagaatgattcctcttgaccccactgttgctctgcatacttttaattaactgcatcaaattacatgtgctttttccttaataaagtgatggtctcatggtgtcaggcatcttttaattggtgatatgcaagttatcctgttgctttctgttgcctatagctgttaggctgtcaaattatcattactgcacacagtggacttctggggtagaaagaataataggcagaaaagaacaaagacaaacttgtgcttgcagccaccatttctgtagcttcctctttcatctacaatatgcaaatacaccacagttgatttcaggaagcaatgccatgcaactcatcctagaatagtgcaaagcatgattttctgttttgttatcttgttcatatggtacatactctctaggatgtgatttcagagaaaggcggcttgcaatagcttcccacgtgtcttgttattcccggaaggcacgacaacaaatggaagatttctgatttctttccaacatggtgcattcatacctggctaccctgttcaacctgttattgtgcgctatccacatgtgcactttgatcaatcatggtaagttatctggacagaaataaatccttatttgttgcctcaatgctttatttatgttcattttctgcttcaggggaaatatatcattaggaaagctcatgttcaagatgtttacccagtttcacaatttcatggaggtgcacactctcattccattcagcctagaatgtaaaatcttcatgtctttggtaataactacttacacaataaggtccttacatgaaccatactttttacaggtagagtacctccctgttgtttacccacctgagatcaagcaagagaatgcccttcattttgcagagaacgtaatccttcttgactcaaaataattacatatttggcatatttttgcgttccataccaatgtaatggacaaagtactttattacaactattgaattttgcagactagctatgctatggcacatgcacttaatgttattccaacctcttattcatatggggattcaatgatcatggctcgagcagtggaagatggaaaggtaaaaagggcaatgtcgtagtgtgatcttcatgctgaattcatgtccattgttttgactgtgtttgctggattccatataatggaacgttgcatagtgcatagatatatattaacaaatagctgccattaggctgtcttccatcatctatgaatttgatctctaataggctgggtttaacatttgcaggtgaactgctcaaattatatggtggagatggcttgggtaaaagaagtaagtcttccacattcgcactgttggtatatgcatatcaatatgggacctggtctacagatatactccctccgtccctaaatatttgacgccgttgacttttttaaacgtgtttgaccgttcgtcttattcaaaaactttgaaattgtattgttgttgaagaaaatgttgtagtaggacttggtttgtgcatgatttatatgcgaactatttagaggtgtcccacccactatatagataaagcataatcatagccgtgttactgtgtttttttcttttgccatgcatggttttcttttgctcattggtgcttttgaggcattatagttgctgctccatcaattatggtacctgatgttttttgttctttttcagacatatggtgtgagcacatcagaagcaatggcactcttggaaggctttttgtgtatgagcccagacaacgagtaagtttctcatcctcacactgacaaatatgtgctctatggcagagcacataatttggtcgcgaagtctaaaaagatgtcctccatttcctaaaagctggtatcatgatttcacagaatcatgacaaatgacattacttaactggttaacccttgcagcggacgtgtgaatgcgcaagatttttgggctcattttggccttaattgcacccctctttgcaagaaggtactggcattctcctcgcgtaaatactgccacccttaattggagttacagtacacccttcgctgaacttgtgcatctgtttttcagatatttcagtacttcgattttgaagccaaggaatccatcacattccgtcaggtatcaacttgaatacaatcaacataataactgatgccttgcgcttactaacattcaaggacgtgatgtatgcagttcttgattggatgtgcgcacctcaggaagcagccatcgtttcaggacgcctgcgaaaccgcgtttgagaggtgtaggaatcccctaacatctcacatcggcagggagcagctcgccgatgtcctgcggtcaagcatgcttgagctgatgaccgataatggggtaagtcgccagtttgcttcatgcaacatatctaatcacctatcttccaacgccatcacccagtttcgactcatctgtcattgcctaccgtttacattacagatgatgaagctgttcaagacgttggacgtcgacgatgacacggaatcagcaaggatgacctgatggcatcccttaggaagctccccttcatgatcgcgctcttcgcgggccggatcaacggggaagtctacatcgagatagtttgatcgactggattgatcgcaggggagagcaaaaatggtggatgggagtttgtaacgcggtgggagacgacagacctccgtctgtttttagagggatggtttccaacgctttcaccgtccatgtagctttctcaggcgtgttggactaaagtggctaaccggtatagtgcgcaattttgtttcatatcgtaaaaatatatatttatatccatagaaaagctgtcgcgtgatggcacgctggattgtgcaatgtggatatgatactgtacaacattggtccaactgggcgtgcacatagaaactctttttttggtttggtttggtttggctaactggatggatgattacaaactcctttttggctaactggatggaagtatctgtttcgtatcgtccatcccaatatcaatcaatatatgtctttaatttctttctttttctttattttttgagacggaaccaaatgtgtcgaactttgaggctatcgaccatcagtccatcaccatcgctacgcgtagtcagaaagtcggaatgagtctctaggaaaaagagaaaataacagccgccgggctttctactgtattattattgtgatgacgaggagggtgagatgtactatacgatgaaccaatcacatcgcgttggagggctatcatttgacagcatctgtttacgttttatgacttctttgaaggttatttacaccagggaagaaaaaacacgcaaaatgaagagcgctcaagattgggaaaagtggctaaaaaaacaacaggctgctgctatgccgcggcactaaagaagaagagtagacaagaagattctttacagtatactatgtgatgctccttgtccccctcccttttcctttctcctgtcccgtctccgatatgttgtatctttacatcacgatgcacttctctttcttcggcgtcgtcggctgtggagcaggtggcctctgaacaaagatcaaaccactccatattcagatccatcaaacagggtatactagttgtataatacggattggaacaagtaaaaccacgtgtcctcggttctgacacgatcaagggatcaagcaatagatgaaaataaggggaaaagaacgaaaacgaaaagttcaaccccatgatctgcttgctccttagaacatgttagtattaactctattttcctcttgatataacatcataacgacagtttgtgcagtaaattagcttgttggttgggttcaggtgtatactagagacaaaacaggtgattttctgatattttagccgcaggatgcaggtttcatgagtttttaaccttgcataaaagtatacggagaacatatgttctgcttcaaaaagactaatcatatttgtggataattcggcaatcctaaaaccaaattgcatatgccagtccaaagcaagtttaaccttataaactaaaagcccagaagtacagagtgaattcaaagggacca

SEQ ID NO: 3907 - DNA, 4407 bp, Oryza sativa
  unsure (1)..(4407): unsure at all n locations
tccagaacagaagaaacaccaacacacatatattagaccttactcaccttatgcacacgtgcagaaacaaaagcaataatacctaaaagaaacaacaataggaagtgtgtcgatagtattaaatgaaatttagccacggtactagtgtgcaggtgcattgcacaattctcttccagtgtcatgcacattttgttaagatgtaaagcaaacttgttgactggattgtcataccaaactgattgtgcattaactataatgtgcttgtgagataagtgaagactgaacttaattaacctcatgcacggggagcatttgtgagcatgtcaacttcaagtaagataaagatacattcacaataagcaggcatatgaactccatgaaccatatctaaatattggtcaccaggagagtggtaaatgattagtttgacaagaatttcaagattcccagctatcacaaactaccaaggaactgaccatgggaaatagcatcatacttgggttgcaacaaattatcataaaacaaaacagatatccagaacctacagacagcagaacaccatataaaataaaagctgagaacaggctagagagatattctgggttcaagtggcatcaatatagctgaatagatgtacttgcgttgacaagcaaaatgtcattcaagagacgcacaacaccatagaggtcaaaacagcgattccagtaacacctactctctgactgaccaatacatcactacttaaagaaaaacataggtaggaagggcatactttccagacgagtgctgcagggtagtattgtcaaattgagcaagatagtcctgtggacagaatacaatttgaatcagttaacattatagaaaccaatggagataacaccagcttatcgatgttgcacatacagcggtacttgtcatagcctgctgttcattccaagaatcatttctcgggttttcagccttaaatggtgtgaaattgctggtcagaaaaactccatctccattcacctgatgaatatcaattgcgaacagaataaatcagtaaaagaacccttatttcgagcaaacaaactgttggaaatggtgtggtgtacctcatccaacttttgccatactaaatcactttggctgaaaaaaccctgatcagtggctaagagatataggcttccattgtactgcaccaaaaaagaacttaagaacttaacttgggtggcttattaaagaaactggagactataacttaattaatcatcataccttgaacattgtgttgaaatgattattacggaagaagacgcacagctctctttcattaagaccctcttgtagacaaaataaactgtaatgtagaaatttcgcccaggcattagttaacaggataaataagaaatatacacgaggtttaaacctatatagtaagtacgcacccatagacagttagctggctagcagtgttctgaaggaaattatctattagttcccctgcaaacaaataagaaaatgtaatatcaaacattatgcactggatattcatgtgtgtttgatcttcaaacaaatacaaatacataatagatgacaggacaaacaaaattctcacattgatgttctgcaggcccatcttgcatgtcctcactacttttctcagtcttgtcagcttgttcagcaagaaccacctctccctcataaaccggctcctgattttcatatgccaaatttccagtgctaagtatgtgctcttctccttgatatattggctcactttcctgaaggtttaagatgataggctcaggactattgccatcttccccatccagctctttagtagcatgatttggggtatcttgactagctgcagttgttagctcagagctaatctcagtgtcagaagcctgaccatgaattttctcagtgtcagaagcctgaccatgaatttgcaagggagcttgttcttcacaggattctttatcaacttgcccaagggcaggagcagcttggttgggagcagaagactcatgagaggaacagtcaagcacagactctgaaggttgaatggttatatcagagtgctctggcaagatattccttttcccatcgtcttctagttcattagacgtcaaaacctgttgggattcctccatcccaacttcattaatattaggagcagcatttgtggtgtcctgtaacatagggccatcgctcaaagcatggctgttgccatgttcctccttatttgttgaatccatcgcctcgactgcctctaattggaagctctcagtgtgtgctgtctcctccatatttgaggatgaatgagactgtgaagtgtcaaaggaaccagatccatcaacagcattagcattttcagcttttgatagactaaggactctccttagttcctcttcttcctcacgatcgcctcgtcttatgtgcaactcaactgggtcagtgagtgtattttcatcaaatgatatacctcgagaaacactaggagaaggaacccctagtgctgcagtagttgcagcagcaaaatcaacagtttcttcctcctgtacatgtctattctcttttgttgattcccccgacttaaattcagcaagcccagatgcaagagcattgtaagactttgatccaatggaagtagcagtgtcagtatcctaaaaatatgaaacaatcagaattagcatgcaggtgagaattgcagacgtaagaggcaagcgaaatctcttatgcatccagcatgtagggaggtattgactatgctgttcgagcatccttctggctatcttaacaaattgtattgcacaagataaataaatcctatattaagttttggttgctacagaaacttatcatgtctagacacaagtatacgctttttgttggagcatcacatacaatactcaaatcaaaacgcaaccatagagccagtccgactgtcttgcttttactcctaaaagaaactactgatcagaagttgtagtttgaagaccatgtcaacatagaaaacagcatatatttgtgacacgaggaggttcaacactgtctggattgcaggttggagcatcttaactagtaaaaagttggaaaacaacgtagagtgattgtcttgcttttactcataaaagaaattagtgatcagaagttgtagtttgaagaccgcgtcaacatagaaaacaacatatatttgtgacgaggaagttccgcactgtctgaattgcaaattggaggatcttaactagtacatagttgggaaacaatgtagaaaactagcttaattaaatgtgatacatatttgcgaaaccaagcaatagctgtgagtgctaccagttatcaaatagaatcaccacgtagctacttgatagagctttcaaacgagttttcaaaacaatggtaaacattgcccgtataaggtatatatcggggggggggggacaagtacactggcatacatattacacttcctttttttattgagtgttgttgcagatggtaagcatgaacacatggtctctgttctaaataacagaaactgtgaatggtatacacatgaagttatctccaagcacaagaattattgtattccatgtcgaaagaagtacagtaaactctaacccgcacgccgatccagttgtctagatacagaagttcaacatggctaaaccaaacaaacatgccataaggagatgcatacctggggatctactatccacccatggtacagcgggatatccagaaggtcaaatatggcacgttctcgggtgaactcaaagtcatcgatcctgcaacgcccacagcccgaatcatatcagaacatatagagcaccataaacaacaaaccgctaaccgacaaaccgaaccatggactcacttcctgaacatcacattcacatcaatgccggtcgcgaggcgcggcaaaaggtcaatcgcatccgagatgttctgctcccggttgcgcacatactcctcgtccttaccctgcgaatcacaccccacaaccaattcacaaggcaacacaacaaacaacccccatctctaaccccacggggaccgatcgaacctgcacattgctgttggagtcgatgaggcgctcggcgacgagcgagagcagcttctgctgcgacacctcgcccgcgtccgggttcaagctgatcacattcttcagcagcatcacgttacctgcagcaaccaaaacaaaaccccacacatcacaacgccgcgcgcgcgggggcgaattgaaacccgaagggaatctagaaggtggggggattcttacagatggcgaggagagggcacggcccgttgtcgttctggtacacgattggggtgcggcggccgaggaagcnacggcccttgtttgtgcatcacctcggttgctcaagcggccgcgccgaagccgcccgtgggggactc

SEQ ID NO: 3908 - DNA, 5465 bp, Oryza sativa
  unsure (1)..(5465): unsure at all n locations
agagggcaatgagagaaaacagatttatgtgcgaccccttcccagcgttcgggttcaacgggataacaatcctcgcaagaaaacgttacttgcagcaaccataacaaaactccactcattcctacttggcgagacgggaaaaaacttaacccagaggggtttcaacgtagggggtattgtgcagtttataagagagggcacgtcctgttgtcgttttggtaaccatcggggtccgacgtttatgtaactccacggccctcgttgtgtgcgtcacctagggtggctcgagcgccatcggcggagtcggctcgaggctgaactcggggggatccacctccacggcgccggacgagcgcgcggaggtcggaaggtgaggctggtcggtggacatgcaggagaggacggatggatccctcgcgcgatcgccgggggtgggggtcgccggaaccctaaccctaggtggcgtggatggcgtcgcgcgcggtggtcgccaccgcgaagggaggaggaggcgcgcgtgcgtgcgtgcgttgcggtggtggatcagacgacgggagaaacaaagcgagaaaaaaagagaaggaatgaggaatagaatacgagacagtgggtgtgggtacaagtaaactgcagattatgtcgttgtttttttttcccgattcggtccccgtagttgcacgaattgtgtttttttcattcttaatctttgtctaacagcatactagtgattgtactttgtgctagtgagcatttgaattttgaagtagacgaaagatttcgaaaccgatatggggttgctgtttgcaatccttttttttacataaaatttgtggcagttgaatctcaactgttaatttgcaacgttgacatgtaaacaaagtagtgtgggaatattttctttacgaaaagtcaacttctttgttcgaatttaaaaagtgatccagactaaccttaggaattatttttcttaataatggaaatagtttaatctccggtttctggcaacttatgaattatttccaacagaaacattaaatgaacatagataaaattaacgggagacgtttggtttctacttatttgaaaacttttgtcgcattctgaaagtgtccttacataatcctgtatatgcaaactgataacgcataaccactctatcgacgtcaaaagcatatttattaagcagatataacaataatgaaatgtagatagagacatatagctcgaattggtaaataagtacatatgtatatacacatagccacataggacatggacacaacacatgataccctcttaaaaatagataatatgacatgatataacagctgaatatgacatgcactcgttgtcgcgttcaatttcttcgtaaccgtcgaacaacgcacacgcacacattcgttttcggatagattctcaatacttcgcatggaagtaacacggcacgcgtttacttggagtggttcgttggattagcgcgttaattaattacctcctttccctccttgtattaaccgacgcttctgccctctagttgtaaataggagagatcataggtagcatagtgcaaaagtaccagtggatctctcatctcagccgtccgatggccggccaccacacgatccggccgtcgagccaaagagtacagcacttagcacgtgaccacccctttttcaatttcttttccaccacgcgatctcgatgcgtcgttctagcagcaagtaaaataatcaaatttcctttttgtgtgtgattaaaataaccaaattatcgtcgaattgaccggcaacacgagcagtcaaattactaaaccagccattttttgtttgatgggagaaatgaagcaaccactccaacggtaattaagttaagccacactcacacacctaaccacatgaccgaaccgacaatcgcagcaggcagcttggaatgattaatagattagctccaaacaagttgctaaagatttaatcacacgcactcgtaacagaaagttcaagtcgacacctcagctaagcttaaggcttcgtttttttaaaactataattttctaattgttcgttagcatgtttttaaactattaaatatagtatattttaaaaacttttttataaaagtttctttaaataattaaataaacttatttttaaaaaaatataataatcagtactaaattatgtatgtgctaatgatctatcttttttgtggggcgctgataagttaaattaagttagtaattaacacaagcccttaatgtgtaccccggtttcctcccgtgtagctgtgctcagtgacaacgatggcgctgacacggcgtccttcttcatgcgcaactctgatgcgctctactttgaaaaccacctgttggcgctggcccacggcaaagtcgcttcgggtgggggagctatatttcgtgatgtcaaaggcgatgctcgctcagccactgtcgagcatcaacatgggcaggttggctgttcgtgcgagtgtggcacttgccggtgagaggccacaatgaggttcgttttaggtagaaccgacagacgaggttcgttgcgatagaactggcagacgacgacgacgacgctgactgcggctttgcatatatggtggcatgttggggaggaggaggagattggacagggagacatgggtccattgtatttttttttaaaaaaaattaaccagaccgtcactgatacatgggtcccatagttttttttagtttaaatgtcacgtcaaatgttacatagatgccacatcagctgaaacaaccatctaaaccatcttgagatcttattttggttttggaagttgagtaacgcgtcatttaggtattgcggtttaaggttgaatttgaaagtcgacgacaaattgagtgagcgacctaaagtgagaacttattcctttcccctgcaattgaaatgggcctaattgtcggtcacataccgagtaaatgggcttttaagcaggcctggagcatggttaggcccaatggcccatggaacgaaacccgcacacagaaacagaatgcagttcacccctggctggcaggcacactcgcagtccccactccaaaagccggaggaggaggaggcgattcaccgacatcccggagcggatcgcggagcgcgacccctcctccctccgccaccgccgccgccgccgatctacctccgccgccgcgccctcccctcgccggtccgtcgatttcagccctggccgtgcttgatttccgccgattgtgtgggcaatctcgttttaatctcgtgcgtgtttttttacttacgattttgttttcgttttggggccagtgcgtggctggtctcgtggattttgagctagattgggccgggaatggcgggggctcgcgcgatggctttcgtcgcgctctgcgccctcgccgccttccctgtcgccgtcaccggaggtgaggagtttcgtttttttctttctttccagcgtttgtttctctagatgagatgctcagattaacacctacagtgatgctgctgcacttttatcttgctccttgtggaatgtggaaatttttggctttcgattgtcaggctagggtgaattcgcgttttatgtgcatgtgttgatctgtccgcagctcagctactctaatttttaacagctgccaaatgcgaccgtatattgagaatatcttgaaatttaagtggagactggagagcggaaaatttttgtcatgcaatatctgttgatagacataatgtgattaccattctctctgtcatgcatgggaaacacttggtattaattgtatttttactcggtatcttgtgtataaagtgatacagtacatattgaactagctgtagtagtttacacttcacacgcaacattttagatatacgttactgtgctctggaagtgacggttgatgacatttgcacaatggctaggaagagccatttgtgtccatcaacatggctgtgtcataagtaagcctttataaattgggtatccaaatggtgcctacattgttgtttcaccaggtggattgcattttacccagccatccggcattgcctagataatttagtgaaagcacctactgaatatttggccttaccaattgattatatgggtctactagacctttttctagaacagcatgctctgacaagttttagggtccatacccgtcaggccatcactgtttccaacgagaacatgatatttatagggaaaataactactggtgtcatcttcgtaatgcctaggaacattttgctggaatttcaggcatataattttatcctagacataagtgtttgttatactccacgcaatttatagttttcatgttgcatcccagtgacatatgctgacaaagttcagggtttatatatatgctcgcgttttcttgtgttcagagttaaagttaatcagtttactcaaacatataggattcgtgtatgacctgaccacattaccttatcattacattttttctgtacggcattgcttgccatttagttttggaagcaatcaattctctcagtttttgaatattgctctcacctgttaagaagataatgtcccttcatcattctattaagttctctgtttaaagtttaacttactttggggttggacttggaagtgattgataaataaactttaccccttctgttcacaatttatacgcttgtgttagcttgttaggaacaattttctcatgaaatgtttcctcattatacctaagccatccaatcaccttctggacactcgtgatggttttagagcatatcccatcaagtcattctaataagtgttcctgctttgtgcagcccaagtggacccactttattctagtaaacaggtttgaagacttatccttcatttctacatctttaattggtgttattgaagcatgttttcttactgccacaattttgtgatactaggtactggactggagtagtcaagccaacattaaactacagaatttctccttaactgaagaaggtgataattagtgaacaatgacagatctataattctatatgattgcatctactaagatcaatccattcaatgtgggtgctttatttctcaatgcagatggacttcagctgctggtaagaccagaagaagtaactcacagggtaactttcttctacttaaagcccttgcaaattaactagggatattctagcttttcttgtattacaattccgaacagaagtgtccatcctttttatgccatttcttttagcattactacttgtttccaaatgagaccttatgtttcttaagcatttttttatatttccttactacagaaattgcgggagagaaccagaataaagaagaagattgaaccagtacagcaggatgatgaagcactagttnnnnnnnnnnnnnnnnnnnnnnnnnnnnnnnnnnnnnnnnnnnnnnnnnngggtaccgagatgagactctaatnnnnaccccac

SEQ ID NO: 3909 - DNA, 2537 bp, Oryza sativa
  unsure (1)..(2537): unsure at all n locations
catgtgttganttacngaccntcntngtagcangccngcaggtngactctagaggatccccagcaagccaccacagcaataatgcacatgacaggggaatccaaaggatggctatggttcttttgcgcaaagcaagttttataattcttttcacaagcctaagacctagcgtagactgatcaagttttaataccagtgttcacattaaacaacgatggttctgtccaccatccattgtaatcccaaggatagcttcccgccattgagtcgtcatgattttctgaggacgtccatattcccgcctctcaggaagtggctccatcagcataaaaatcatcatgcaatatcccatcccacacaagttaagaatttaaagtctagccaagtgtaatacatgttccggtactcattaaccgcgagcacggctattcgaatagatttggtttactcacactgcagtggatgtacactttacccgcactccgcgactgtccaacacgcctcgtcccaacacatgagacgcgtcacggcaaagcttttcgataacctcgcattggcagtacccgctccatgaacttaaatccttatgcactctaggcgtccatgtttctagcagtgagaggagttctgacgctcccgggaaagagaagtctcacacatattaaattatggttcaagttaagttctctctcacacactcatggcagtcctaccaatggcgacaccgatatagggcacgcctctcggccctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacaattgtttaattttatttctcctctcacaaatcatatcatcaacgtcatggcaatgtggcactcatgtctccacatgccgcatctcaattaccttcccaaaggtaattgcccaagcatatagcatttgataaatatgagtatgcatgattctagaatggcatttctaagcaattgtcataattgactagggactcatacgtaatcatggttacaaggattttaagggtaaacaataatcaaggcatggcataatcacaagtaagatgttcatcattgcatgcaattttatttataaacaaaataatttcgcaattgggatcaatatattcaaagaatagtgatgacttgccttgctcaaagtcttgcggttcttggtcctcgcttggatccgcaactccctcggactctaaaattacgtgcgaagaaacgatttgaattcggttaaaattcaaataaagatccaaataaatccaaatggaagtcgaatgcgaaagttgattcttttatattaactttactattcgcgaactagggcaaatctaatttcgatttatacatcctaaactatttttcgggtataaatattttgttatcataagtttttaatttaatctacccgagcattatatccatataataggttagaaattttctatcgcgagctaaatatcggacggaatcaaaaaattatcttataatattatacgatttaatttaccctatgactaaccgattaaatataatatacgtctaaaattcctagtgattaaatccgaacttctaccgtgaatcgattacttatagagatttatccgaaaacctaatctataatagtctataacaattcatctaattgtttagtcgttaattacatctaaactactaccacgaattgattttttttagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttctttcttttcgctctttctctttttctttcttttctctctttctctctttttctctctgccggcctctcttttcctctctctctctctcgggtctctcccacccaagcagcggcggcggtggacgccagggggaaggagggcggcttaccggcggcggcagcggcgacaacggcggcggcgatggtggtgcacggcggcgcgggagtggcagcacggcggcacgggaacggaggcgcggcggcacgggagcggcggcgcattggagagggaagaagggaggaagggtgagatggggtgggggaaaatggatagagggcgcggcgttttctttggggtagtgtttttgcggtgccttatcgaccttccctttattcccgcccccctaaaaaagggctccgtattagaaacgctttttaattgtggcggtgttaaaacaaaggcgctctttaatcatacgag

SEQ ID NO: 3910 - DNA, 5391 bp, Oryza sativa
  unsure (1)..(5391): unsure at all n locations
cgagtgattagtacccacgtgaanaccagcgacngtttgttggaagagccgcacgcgcgaggggacngtcacgccgctgtttgaggctcgaggcccactttttttctactgggacggcgccgcaacaggtggggcgcgcgctacaggcgggcgacgccgcacacgccggaagggagggggcggggctagggggaccacgatcgaacacctatgccgcaatgaacagtaacttttccctatttatcccgatttttgcccattttctatttaaatatagccctataaattctaatttttgcataaatgaagtttgctccatatttgtgttatcctaattaaaaattcaccctactttaatatcactcatattttgtttatataatttatttgaatttttaattagggttaattctcattccatcgcactaaaatttaattattgataatatatggtcgcgataaaattttatttatttccaatcccacctaatctttattttaatttatattttaattatttatttagccaacttgatttttagggtttattcctagttagttattcattattcgcgattaataaattccgagattaaaatctaatgaaataggcgaataaaatcggcatgatgcaatatttttggtgttttgatttcgttggtcgaattttcagggtgttacactggtgattcattgaatgcatcaacatatcaattgatcctacggtctattttggaagaatcattcaggtgagcatcaactaatctttggtaagctaattaatttcgaattttgttttctaagactaagtttagatacatctacatgttttataaaagtaattgtgaaaagagaattgggcaacgaaatgacgaagacgcgattaaaattaattctaaaagttaaggacagttaaggacgcgattaaaataaagccgtgcctagcaggcaagaatcctcgtgcagtgtaccgagataaatcattatcgaataaaagagtactaaatctcaaaaaaagaataaaagagtactccatttgagaatttatatcttgtcatttctaccatgaatagagaacaatgcatcaatttgctccaatggaatatatattctgaagaacagaatcttgttacttacattatttgactttatgtcactgacatatagatacatactgagatgcagtcacatgacttaacaccagagaatccgcatccatatttcgatgggtactctctacaactccccggtactataaaagaaagaatcttgtttttttatcgcaaaacattaaaaaaaaaggaaccggtgaaaagtgatcttgagtgatcaattttaaattgcaccaaccaatttaactgaataaatttgccaaggggtagtgaaaatttccagtcattttttaagagctcactgggaagaaacgtgcatcaattttcgcgaccaaaaatagctactagcaccaaagaaataagataggtagaatctgataaaacctgctcccgaataaacatttttttcattaacctacgaattaaactcactaaaattgacgaaattaagcaagccaataggtcctcgacttttaaagctcattgttgaagcaagaagcacttgcataaatctgcacaactaaaagtatgttcaaatcccagacttttatgtgtgcttgtatttacggacgattattttttctgacagacgatgtacccgttgataccggggtgtttgtggattgtgataattttatcaatttcaatatattggcctggactttggagatgcttataagtgtacaatatgcatatgtgtacttatgatgagagtgcttgcgtatatatgagagcctatgtttgcagtgtttctataaaaaaaagggttacagagagaactggtactgcatttagcacctactctgtatcaactgctatcttgattataaaagcatggccataatgatccatgctcttaaagttatatcaactggctggcaacttagtactactaattttcagtaaagtgttgttcctttcaagaacggcaagggcgatcagagcgtcgtcttgccgatctgcttgccctcatgggcaggttccagctcgatgtccaaaccctcatcgcagagctcatcttctgtctaaatgcaattgcaacgcatgtgttctactgttcttgtttcttcttggttcagattgtacttaaatttgttggtgtcagataacatgctggccctctagttcatcccacgacgcagagtagggactattcctattgtgttccaaaaaaaaaaaaattacatacgtgctattcgttctctacattttttcagttctgtgacagagtgaaacttcctgtgagcgagtaaagcttattgtacaatggtagagtactaaattacttctctttctacctagagacaaacatcaactttctttttataaacacattagaaatggagacgctcacacacacacacacgtgcacagtcatctctacgaacagaccttatccctatgagcacatcagaaagattaaaccaacatatctttatattaataaagttattacaaacgcataattgttgataggtacgtcgactaccactgagacattaactgatcttggtaagaccttgttatggtccaaatagtataattttgatttttaagaataactttaaatttttacttactgtcttagcaatcataaaaaagaactgagcaacaaatatgacaaaatgagacctttaaaattaattccaaataaaagttaaagttcaaaaccacctctgaagtatataatataaagccgcatgctaagccggcaagatcctcgttctgtgtaccgaggatgcaacaagatggatttaaaggacaggccccatggaactttccgatatgttctcttgtgaatctatcttctcatttctccttcatgtaacatgaacgtggaacaggtgcgtcaaccagccagcttttgaatgtaacatattcagacatgaacattaaaacagagaagaatctgcgaaaaattcatccaattcatccatgaaaattaaaacagagaagaatctgcgaaaaatatggtattggtcctattggataagctgtttgtatttgaaaccatgaaccatactgaataaaactgatcagaacaggtcaacagatcctatacttttttaaaagctccttgttgaagcattttgcataaatatgcacaaccatgagatgttactgaagaaataagacaagtagtactgttcttcacaatactctgaaaacaaccttcttggttactttttttagacaatgaccgtaatgatctttggtctaatatttatatcacaattggccagcaactgttagagaaaatgacctcaatgatctttggtctaaaaattatattgtgtcactggtgtcttgtagcctcatcaccttcccatacctaacactatcccttttaaaatggtctcaactcttctaaaactagcaatgtggtactcctaacactaggcatggagtattaccgaattaatattcacaagcatgtcttttatgagatggggctttgtgattctccatatgggctcccatatataattccaacatcctctccattccttgacttcgtcatgtttgaatctcctccttgaagtttctatttcaggcccaaacaatggaaaagcaacaggaatgcagaccaagcacgcgattctgaacaccacagcagtagtagtgaaaccgagagatccctgtcgctggtatagtttgctgtgctgccttcaactaagcaaggccacagaggcctagtttacttccaaacttttttttcaaaaaacttttctatcacatcaacactttcctatacacataaatttctaactttttcgtcacattattttaatttcaacaaaattttcaattttgacgtgaactaaacatacccagagtgatcagctgctgggcaaaaccgtaaatcgaaacgattctgaatttctggttcaccgggtcgactggaatcatcgtggtgtcgtattaatatagtagtatttaactgcactgcactgtatcagtttagtgtgaactttacagagagctatactagactacgatacagagagaatgacagattggcccgatcgatttgttctccggcatgggcgaccctacacaaaatgcttcgttacagatagccaggtcgatgtgccggctcctttgttgcttttcaccttttctttttactcaggctcacccagacacagacagtctcacatcacaagtcagtatgcatatgcctccaatctctgcagttcccagttggataggaggattcctagataatctcgcagagttcagtcgcacggctacagaatcggacattcagatcacagttgcaagcaacagatcacatgaacaagctccaactaatacagtttcagttcaaccagtccaatgcatacaggaacaaatcaagaaagttccagctcaccagccagtctttagtgtcttgctaccttcttcaagttccaacacgtacaaacagaaagggcaatccagatctccctgaagatgtgtgctttgtgatgaattttttataatcttttttgaagaataagctttgtgatgatttattaatacctgaaactcaattaggttctaaagcaagcattgcaagtagaggctctagagtagcatgacatgaagaggtagttacaccgtgtttagttccaaactttttttttcaaactttcaacttttctatcacttcaaaattttcctacacacataaactttcaacttttctgtcacatcgttctaatttcaatcaaactttcaattttgacgtgaactaaacacaaccttagtaccttgagcattcaaactccaaaaaggaagctgcttgagagagcaaagaagataccaaaccctcttctttccctatccccttccctcctatgatcctatcctatcctagcttccattccccctcaaccttgcacattaccatcctccccttaatgccactcctcgcctcgctggtggcggcggctcatcgcattctaaagcattgctcatggcggaccaccaccaccagccggcgaccccaccacggggccatcggcgtccccatgagctgtccatggcggcggaggaacgacaccatgggacgcaaaccgcgatggcgtcggatgacgatcgccaccatgatcgtggcggctggatcagtccggaggacaagcaccggagctcccgcgtggcgtgggcgctggtgatcctgtgcacgctgctggcggtcggcgtgatcgtcgccggcgcgacggtgttcgccgtgtannnnnnnnnnnnnnnnnnnnnnnnnnnnnnnnnnnnnnnnnnnncttaatntcaccca

SEQ ID NO: 3911 - DNA, 3984 bp, Oryza sativa
ccaggtcgccatagccgatcgccattgattccaattcctccatttgattcgttcgttgcatctcgacgccatccgagacacgtacattactattacatcgcaccattacagatcatgtttcacttgtcatacttgtacagccaaataatgctggtacagtagaatctctgaatctacaagaagagtttattcaaatttagcgcgaaaacaaacacatttatatttgtaattctttattttttctcgatcagtcccctgtttgtactctgtaccaccaaattacgaagtcgatcctaattcctaaacagtgtgtatgaactacttcaagtgtcttttcgcttcgtgtcattgtcaggaatcagaatcgataacatcatcaactaatctcttcagtgttactactgcaaatccgatgaacattctctgacaaaatcagacgctgtctgtctactgaaaactgataatacttcaccattgggctgggcctgaattaccagattggactttctggcccaatatgtaaatccgatgaacattctctgacaaaaggaaaaagtacatcgaaggtccctccctgccgccgcgccaccgtgcggcccacgatgggccggcccgcacaaggagaaaagtgagaaagagagaggaagaagggacagaagaggggagagagatggtgatggcgtagtcaccctgccgtatgggttccacgctaactcagctaccacgtcggataaaatcagggtcaaaatcgtccaagtatccaaagtgacctggttttgtaagttgagggatggtatacaattttataatccgatgacaagatgagattggaccttatggcccaatatagaaggcccacctattcttgggccgaagtctaagcccaacaaccggtcagcgagtcgcgacggggagggagtggctgggaatcgccggagaagaggaggatgacgccgtgacacgggagcacagcaaggtcatcgtcgtcggttccgtacgagactaggaggagaagtggggattggattgccgcggaattatctccgtcgctgtcgccaccggccgtggggaaacagcgcgcggcgcggcgcgggggggagagtctcctccgccaccgccagcgtgggcagtgggactacctccttgccccgctacgcgacgcggcgacgtcgccgtcggcgtcgtcacccctccgcacggtgcactgaacgtggcgcctccacttggcgcgcgacgcgacgcgacgcggcccgccttcttcttctctactgctacttaaccaccagccgcgcgcgaagtgcggcgagcgcgcaatcgaggtcgaacacttggccggcatgaagcccaggcctaccggattcggggccgcggcggcggcggcggcggaagttttggtggggggcggatgcggtggatgggcgtggaggccgaggccgaagccggcgacggtggcctccaccgcggcgatgtcggtgagggggcctggtactacccaggcggccgcggcggcaagcgccgtgcactcggagcgccaccgcggcggggtgcacgggctgcagctccctccgctgcggctgcagttcaccgccgacctggaggcgcggatcgagaaggtgatctacgcctgccgcttcatgaccttcctcgccatcgccggctcgctcatcggctccgtcccctgcttcctcaaggtcgatttttatctcctctcttcaggttcgatctactcctagcaatttgttgactgtccaactctgcagggctgcgtctatgtgatggatgccttcatcgagtactacctgcacgggggcggcaaggtcaccctgatgctagttgaagccattggtaactaactaactaatctccctaaacttgatgctgttctacacacttcagccatgagcaattaaccactttgtatcttcagcaacacagattagcagttgataacacgggagcacaagcaccaaaccacaaattgcatcgttgctacatgcatcctagtggagttatatgtagtaatttctgataactgaccagtgtgcatttcttgatttacctcagatatgtttctggttggaacggtcatgtttgtcttcgggacagggctatacgagctgttcatcagtaacatggacattgcaaagtcatcatcctatggctctaacctctttggcttgttcaggctcccggttggttcacgcacttagcatccctctaaatggtgcggtaactggggaatttccagtatcctgatacctctgtttctatctgcaggaacggcctgagtggctcgaaatccagtcagtgaatgatctcaagactaagctggggcatgtcatcgtcatggttctactggttggcatctttgagaagagcaagagggtgaccatcacatcatgtactgacctcttctgctttgcagcatcgattttcctctcttcagcttgcctctacctgctctccaggctcagtagcaagtagaaaaataggaggtagcgacacctgaatggctggagcacaaacaggtcttgtacatatgacataggcctgttgtgtttcctatgccgtgcaacacctcatgttatgtttacataatgtaaaattagaggggagtttgcacatctcacgtactctttgtatggaatggaaactactttgtatagtggagccataagacattattgtcaccatcactgtgtaccacctggtactgcaactcactgcttcgatgataaatataaatagttactgctatggcatgttatgaattgattagcaatgctgccttttctgtctgtgattcttttgaagtttttagagcaggattactttgttgatttcttttatacccccaaaagtataaccaagtgctagttaattagtttagaccaggaggagttgcacctatttcttattcttatgatgtcttttatgaacacttctgaatgatatgtatgttatgctattatatgccaaacatactacttgccttcaaaatcattggtgtgatacaggaatgctctgacctccctctttgatattagtagttcctatttgatcacaaggccctggtgaagcttgccaacatagtgtttccatattatcgcttattttcttacacacagagtatatttgatgaatggagtgttgtttggtgtgactactggcttgtgaatgaattgaaacctgcagaatctaattacgtgttatgtatccatgtccttctttctaaaaaaaaatataagtgaagctcatgatgtactctttgccgtatgttgaagcttatctgcgtagctatcgcccttatgagtaagaatactgaacacgatcattaatttgtgaggttataattctgagcaaaaacttgcttgatgttgcagttttatgtataactactaaagctgatgtttcagttctgtgacctacgtccggccaactgtccttcccacacataagatttggatgccagattatctttgaggtatgtttctgaccttcagtatttgcaactgttagcatcatgccatgatctgttgatttctgaattggatgcgccaatgtatggttgttgccttgagatttgtttctgagttctcacctagtatttgtaattcttaagaccattcaatgatttccgagttgaatgcatgggtgctttcctttgaggtatgtttctgctatcaagtattttttaaactgttgcaacattcagtgattcccaattgggtgcaccaatgcatgtttgatgcctatactaacagcaattgacctattcctaaaagtatttcgtagagaggcaaaactgctctggcaagaacgatgaaaattcctatgctttatgaactttggttaagtatgacaccttttctcttaggtgatcaaattaaaggagaggaataataagaagagcagcttgtattgtgccacaaacgatgacagaacctggaataaattattcaggagttccaagccaaccaacgg

SEQ ID NO: 3912 - DNA, 5909 bp, Oryza sativa
ttgcttgcggtatgatctcttttctatatgcagccgtgagcaacaaaattagaagctccaacttgctgttgtttcatatacataatagattggcagtctctgataggtcagtcatggttgcttgaacttgatgggaacacacaaagtgttgcacttgatgttttaagtatgcaacttgcatgcttaattaagacttgaaagatatatttagcccattataactttgttgctgccaaagtgtgggttgtcgagtattatctgttagatttattacaagtggatcaacttgtctattaaacttacattatttagcacacattttgctgggataactgatcatggtaatgagcagatgttttcatgactggatcctcagtccttggtaacatttggtaaaaaaagaaatgatagttcgctttcctggcaaaataagttgaggatgatcatggtggtaagaaggatgattttacataaaagcattatcctgatacatgtcaggttggcacagatttctcttagacctacatattcccatggtatcaattttttattactaatctcactctatacagtgtctattaggcagaagaagcttagatgtttctaagaatcaaactgaactgggaaaaggtgttccctttggctaggattaataaagtactaagattttgagacatccaaatcctaaacaattggctggggattgctgttatcaccacccgggtcctcccatcacttaactcctccaaaagtacctttcttgaactaaattaatgaaacaatctgcatatataaagaagggagctgctcaggtggtgaaccatcttacctgtgacttagtgagtaacctctgagttcttctcttccaatctccagctctattttgcttgttagcttcatggccatttcgtcgaaaaatgttgctgtgttcaagttgcttctgagtgtcatctttttcatgcagcactctgtgccagttcatgcaaggaagctggtagtgagggcacctatgatctgcatgcatcctccatgcacacggaggaatgccctggaggtgccagctgaacaagttgattcaaccactccaggccatagccctagcattggccataacactcctcccaactgagatgatctgatgctgctactgtgtcccagcctgaaatttgtaactcgggtctgtgaaaactcgggtctatgaaactcatatggtgtttcctggagcttctatgcatttgttcagaaaaggcgtaaagcatgcgactgaagaagctcgcgaagattttgttttccttttttcttttgttccccaagacttgtgcatgcctgcctgcatgctttcttttgttacctgtgtgaaaaacttttcctcaccttgtcttagaggagatctacagatctgtagcctgtaacagtgtgtctgttgaaaattttaactctccatatgttatgaacttgagaatggatgttgtaaggcgaggttaatcggctattttcttcaaaattttactagtacaatattgtaaactttaaagaggtacaccatgagtggtcctttggttttctacatatcctttgttgagcatgtaatttcgtccatatatacatcaagtttgtgtaaattgatcaggatttttaaagtcaaaattaatttaattaccttcaaatgagactgaacaggaccatgtttttcttcagaatggtgtaggacagcggtaacattttttcttaccctttgttgaaagataaattaacgcttggggtgtacaattgtataatgctgatactattacttgacaagtttatggcacccctggagctctaatctaacatgtcatctcattgttgtgtctgttttcttctggcaaagtgtggtatttttcttacaaagtttgatatgtgtagaacagttttgttatactgggtactaaaaaaaaaataattttcctttgttcttcacttgtttgctacataatactactaagcaacactggccccttaatttttttgatcatttagtatgaggcaaaagaatgcagtggcagtagaactagcactgtgatgttagtaaaatattaagccaacaaatggtgcacaaatcactttctggtccagttcataaacaaatcacagtgtcctaggtagtactccatgctaatgcatctccttttgaaaaaaaaaagaagcatcattgttgcaaagaatgaccacaacaggtagtgactgagaaagatatttccgaattaaggcatgtgtgggaactgagaactgataggttatttttaacacatcttctttattttattttttttttttcttgattgatagagaatctgcatcagccatcttcagcaaacataatgcagtttgttggtatggaaatagtgtgagatatcctatgcaagttataaaccagtttctttctcttgccattggagagaaatttcatcttgagctgtcacttcaatttatggctcccctcagacactgattctcaatctattacattatcaaaacagagggaaaacaagcgtttaccttttgctttcatgccctataaatttccatgtgaataaaagaaaagaaataattccgaattattgattgtagtgcgggtccatattataactgtctagattagaaaaagaatccacatcaaatacagttcaaatgataattgaaatttggaatagaatgaaggaacttcagaatataaaatgaaataaaaaacaaccgatataaaagaaacttcacaataaatactaaatagtacttcttccatttttaaatatataacgttgttgaaatctggacatttgatcattagtctcaaaaaaataagtatatttattttattttactatgacctttatcatttaatgcactttaagcatgtcctatattttttatatttgcatatatttttttaaatagtacgaacaatcaaacgtatgtccaaaactcaacagcgtcacgtattaaaaacggagctagtaataaaataatctatctactttagaaattcccaaaaactgatggttcgtgcaattgccaagtgtcagactccagtgacgccgttcagaagaacaaagagtaatctttcagtaacccatagttaattgaaacactttatccggccgaggtatgagcattttcacagcgttgtcgatgtctctctggctgctggtgaatcaatgatgaatcatggtcaaaccgacgacaatacaagagctgggcatctgcaggtacagattagtgcatctcctttacaacaaagaaaacctcagtgtttttccttaacttgaccagcagcagctagtgcctgacaaagctgtttcctaacttgggtatgtgactaagcagtgataagatatctgaaaaaaataataagtagggtgattatattaattattcttaacaccttcactactaaccttttgttttttggtggtgatcaggtcactgcaattaagcaagtgatcaattgatcaaatcatcactagctaccctgcattctccaagataatcaatacagcttcagtgtggcaacaaattaaagctgctttgttctcttttgcagatcaatatctgtgcgcatgcttagttcatcacgaataaatataaaaaccatcacgcataaatataaaatcattcatctgttggtattgggctacgtggttgaatcgagtgcttattattttctgctaagttgtatttctgtgattgtggatacttagtgcaattgtgcagctatctgatcaaacttttctctctttttttaaacttggagtctttgagaattcagatatttgcctcccatctcaattgataagtacgaggtgtatacagcttgattgcctcaccggctgtcaggtggtttaattatctgtgggctttccactttgtgttggaaaagtggtgatatattatccatcatttgtatatatagatggatgaatacttgcaggttagcatgactagtttaatgacaccatcagtgttggacagtggatctcatgttcttgctatcctctatgtgcatcatgccatcatgcttcagaattttatctcatttgttgtgagaaaagataattaagtttcaggtcaggcatctcgctcaacgaaatttaatgcaaattcagatggaactgtcttaaatcttaactaatgtatcccaaaaccatttatgaaaatgaaataaacctcctatttggctgagccgctaatcagtttggaatttcagaatgcttactaagtagctcatcagttccatgcctgttttgccttctcttcaacgaattgcagagccgggacagtaaatagcttgcaaattgcaccaaacatgcaaattttgaagcatattaaacatattaatttacataaattgtacccttcttcatgaaatacagcgatgattccttgttgattgagctctgaatgatagataattcactcaattccctcatggctacgcaacagaaggcatcaaaagtaacgctgattgcatcatctatcaccaagtagcagtagtactctgctttgctgacaccatgtacagatgtactcgctccctcacctacatcatcttcagagtttaatgtagttgacagaaaaaaaaaggcttaagtcatccaggcatcacagaaacgccattcacattttttttttgaaaggaaattaagcaccagggtgataaatttccaacctgaacgtcattttttgttgttctttcagatatttcaaccgtttacatatcatcttagttatttgctgtatctgttctgtcaaacttatctctagtttggaattcaggatgctaattatcccagttcatgatttcaagtagatggtgataccatgggtgttctaagaaaaaatgagtttgttctgggacatttgacgtttgaaagttgcagtggttactgccaaaatgagttacttccaatcttgaatgctgacgctactccctccagccaaaacagaagtgccgtcatatagcttgaatatatcaacagtatcatatgaataatcatattagccatagaaaaccatacaaatatgattaatttacagttcgagattgtgtcttgaagaccatatgtagatgtgaagaacagcactcccattatctaaaaaaaaaatgtgaagaacagcactcgttttgctagtatttgcaatttcagggttcaacaagtaagcaatatataccaacattttacagagaactttctacctcttcttggatgaaaaacgcaaaatatcaaatgatcattgaagaaaaactagtaacgtggagcatttggtcaagtagcaagatgatcattgacaaatctctgttccgaaacactagcctccgatcaagaacacatgacgagtgtgcatatatctatcttaatttctcaacccgtggctgctacctactccattgatacatttgatcactcgcataagatgaattgaattctttgcatgacatcaaatcatcaattcgatggctccagtgggcagatcagctttttgagctttgaccatggtgctcattgccggcgaggtcgtaagcctccttcgccgagcgaatgcaagaatccaagaacgaatttattgcagctagaggctcgcggcaatctccctttttaaggggctcatcagctgcggattcttgcacaacacatcgaatttgcattcgcattagcattcgcatcatcgcttgttgcctcagagagaagagagaaagaaagctcgagctctcggctcccatggcggcggcggcgtcatacgcgcacctcgtcctcgctgccaccctcgcgttcctggtgctgagctcgccgccgcagtcagcggcgaaccgcgtcgacgtcttgaaggaagtagtagcaggcgagccaccagctgcgggcatcgaaccagtt

SEQ ID NO: 3913 - DNA, 4958 bp, Oryza sativa
  unsure (1)..(4958): unsure at all n locations
cggacgattagctcactcngtatgccngcaggncgactctagaggatcccccgtcgagaaatctgtaaatcagtttcattttcagttgataatggaagcattttcttgctctctgattctgccttttcttcagttcttaccaaaatttgatactttgattcatctctgtgaagtacttgcattgttgataattgatgtggaagatttttgaaacctcatgtgctcttggagaggagatgaacaagtacatccataattttcagatacagccatctagtttaggtgcaaacattaattacagatacattcatggcgcacgtcaaacgtagcaaaggaaataagaacaaaaaaaataaaaatacagatcttgataaaattaaccggacagattgatggacaacggcatggtataattgggtatcaagagaaaatatcacggttgatgaagtatatatggctatggcgtgcaagtggaggaaggggcatccaatcctgcttccagacacccataaaaatacaatcaacaatatgtagggtgccatcctttggcatattggtgaaataagccaaacggcatatttgcaaacgaaaaataattcgtgaataaaacttttatatgtgtgttcttagcaatctaaaagcaaatgctggaaaataaacttcgatgaaaaaaccccaaaattagctttaaatttaacgttgaaaattcaaattttggctgataagcatatgaataatcgtgacatgtacccacaacccctttgtcccctagcagtccacccctcctccctctcgtttttctttttattttcttttgtaatctcctagccttgggttattgtacagttttttcccctactttaatacaaatacatcccacggggttaaaaaaaatgaaaatatcacggtaagtgatgctttggtaagacaacagcattcagatatgcatatactatgaactcttaatgaaaatataggttagtttaacattcaagaatgtttaccctgacccagccaacggttgggaaacaactacaaacaaaagactgcctaaaatgtcaaaacctaaaaggtacaaaactatatagcataaatatattataaaccgttagggttcgaccagctagaacaccatagccataaataagaagctacgccatgtcatgtgtcaatgtttgatgtctcgactacggtatttggacagtatggggatcgtcggtgctaggatatacgcgagactgaggaaaaagagatggagacagggatttttatacaggttcgggcccctgagctatcaggtaatagccctacatcctgttggctggagccgatgttgctttttattcaccataatcacaccagtacaatatgtggggtagcctatctaactgttgtcgacatggcggtctgaaggtctgactcatagtcgacaacagggtagccttcctcctcgagctcacgcccgacggaatcagagacagtgctagatccctacggccagcctctaaaggtaccggatagggtcgatccaggcgtatctctgatgtcgatattcggcggcttgtcttggcgtatgtaggcttgtatgttgtggcttctggtgggtgttgattgtctcttcatggtgagtgtcgatcgtgttgatcgtcttatatcatgggtgtcttccatggtggttctccctggtgggtgtcgatcccccatggtgggtgtgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatccgaaggttgtttccgtataggacatggtatgtggtgggtcctgccgagatttagtcaactactattaggtatgtggtatccataaccatgacagtagcccctgacttcgatgcaaatgaacgaattcatattctcaaccacgcgcagacattggagtaactgttatcgagctcatgtgatcgttctcggtaagtttagagataatgttggacttcctttgtcagcctcgtgcgggcaccgaaagggtttgtctaagtcaatctctaatgtcgaccgagaaagtacagagcgtacgactaagtctcccgtcttgctgtaatcgagaatttggattgaagtcaagaaactttatctcggcgggtacaccatctcttcattccgtattccttgtcaagatccagcaaccgttctcgagcgatcgagaaggcgtagagtctgcgaaggagctttgtcaacatttgtcgtactcgccttagtcgatcttggtgtagaaccatagagacatggagtcttcgtcaatgtcgaatagaattttcctgaaatcaatactcagaaaagaatatcaaatagaaatagcccccgagcgaatgcccaaagggtgacatgttataatatgtatggtaaattgaaaatgaattaaatttatcgaccaatgttttgtgtatgagcgtcttctctcttaccgacttcgatcagttagtttgtagagtcatacactctccctagcccccagccttatcgtcggagaatcgttctcagaggataatgctcttggacccttgacctgccttggttgaataagcactgatcctagcccccagccgtgaagttggaaagctcagtttctgattacacggcttggttaatacgcacggcgagaactcttacacgaccagatcttacatggtcttttgtctctacaggatccgacaaggccttatcggctctgggcgtccccagccaaagttcccttaggttcctcggaggtcttgtcaagacggcgtaaagggacagtaggataggtttcaacgctaggtgtcgtcgtggtaagggatctctgggtaaaacacttggcgatattgtgtacctgctatcaactttgttgaaatagaggtagtaggagagtcgctacaccgctggtcgaggaccaggtagtagtcgtaactcgaccacttaaagtggaaatagtgggagaaacactacatcgctggtcgaggaccaggcagtagtcgtaactcgaccacttaaagtggaagtagtgggagagacgctacatcgctggtcgaggaccaggcagtagtcgtaactcgaccacttaaagtggaagtaatgggagagatgctacatcgctggtcgaggaccagacagtagttgtaactcgaccacttgaagtggaaatagtgggagaaatgctacatcgctggtcgaggaccaggcagtagtcgtgactcgcccactcaaagtagaagtagtgagagaaatgctacatcgctggtcgaggaccagacagtagtcgtaactcgaccacttaaagcaaatgtacgagagatcactacgatcaactggttgagaaccggtgagtaggtgtccctcgatcatttggagtcgtggtacgaggaccgctacgctgccggtcgaagaccagttgtagctgttcctcaaccatctgaagtcatggtgcgaggaccgctacgctgccgtagtcgtacctcgaccatctgaagttaaggtgcgagagattgctacgtattggtgcgagaaccagtgagcgagcagaattatctctcgaacactaatggaagttgcggtgcgagagattgctacgtactggtgcaagaaccagtgagcgagcagaattatctctcgaacaccaatggaagttgcggtgctagagttggtttattgcaatttgtatctcatgtggccagtatgactcacgtacccaacttatagcatatccggatgtccgttcgcaatcatgtcgagtgatcaagccaacgacgttcacgagagattatccgttaacaaccttttctcgagtagtccagccatggccggtgctatgagataggtcgtcggtctttattggtaggttgggtgcgataattccgcatttgtcgagaatgttctcgataatggagtgtactcgaccataacctactcgagtgctcaattgttcctgaaaaatattttctagaaggcaagacatatagcagagaatatcgagtatgtactcaaaaactgcgtggatcttctagtattatcaggatataacgagcagatgtaaatagcaagcattatgtaaaccgtaaacaagcatgatttatacagaagaaaatagagcgagcccccagcgttagaccgtagttggcctaacatcggaagcactcgcacaacagatattgtataaaaaatatgctctaggtaaacataataaattatagatctgacaatgatgtatgatctgaataggtatgataaattgcagataaaatattgcgtacctttgtagatacatgccggatgtatctatgaaattagtagaacaatttgaaaaaccaatctaccaattaccttattgcgtactcattcgacatcatatgatctgacatcttttggtacgccgcgtatcttgaggcttggatgatctcgatagaccgagttgtcgatgacgatgatggttccgatctggtcggaagatgtacttcagtcgggttagatcttctcacagccgaagtcgtcgagtagcttgttgttggagaatccatctcttgaacccatctcgtcgaaatactgaagcaccaaaatccccctacctggcgtgccactgtcgacgtttgatgtctcgactacggtatttggacagtatgaggatcgtcggtgctaggatatacgcgagactgaggaaaaagagatggagacagggatttttatacaggttcgggcccctgagctatcaggtaatagccctacatcctgttggccggagccgatgttgctttttattcaccataatcacaccagtacaatatgtggggtagcctatctaactgttgtcgacatggcggtctgaaggtctgacttatg

SEQ ID NO: 3914 - DNA, 1104 bp, Oryza sativa
  unsure (1)..(1104): unsure at all n locations
agttttaccggagaatacctccaaaattcgaaaggttggtttccgacaaagacaatgaaattctggtggagttccgccgataatttagtccactcctatttggtgatcacgagagcgaaatcttcaaacatcctactggaaaactgttagcggggaaaggaattgatcaggaatgaccataacctttgacgggttatacgggataccgtcaccggtgaggcatctgccatcggcccgtcacaggtatcccctcacctgtgacgggccgaaaggaaaacccgttagaggtataccagtgacgagttttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatataccagctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgnnnnnnnnnnnnnnnnnnnnnnnnnnnnnnnnnnnatgaaggttgttcaccaacc

SEQ ID NO: 3915 - DNA, 11839 bp, Oryza sativa
  unsure (1)..(11839): unsure at all n locations
ggctgcccttttggagtggnanaaccctccttnnnnnnnnnnnnnnnnnnnnnnnnnnnnnnnnnnncttcttgggggagaagccgaagcagcacgcctggcgcggcggcgacggtgagccgtcgtccctccccctgttcctctccctcagcgtcggccggccgcgccctggcctgaacagcttctccaggtcctcctcttgtcgtccgccgccgccgccgtcggaacggtcacggccggtggaggatgagcctgcgacggcggcggcgaggagttctccttctcctgggcttccttggcggcgtcttctggtcggcgttcttgtgccgccggtgcagggggcgcaggcggagcagggtccggcgtctccgatggcggcgggtcggtgtggtggggcggcgcggtggcgctgcggcccaggaacttggcgggcgccggcggaggcaacggcgcggcggggagggacttgagcttgcggaagcgggactcgaggctggaagggagcgcggagtcgccgtcggcggcgaggtgggctgtgttgagcttggcgatctgctccagcgcgacgaggtcggccgcctcggcgaggatcgcatcgacggcggacagcttcccgccaccgccggagtacgccatgaccggtcgccggagcccgcggccgcacgacggcgagatcagccacgggaaggggggacgcaagtgagggagtgagctagcccggtgcagtgtggacgggatggtcagtggttcgagccggatttgtcgttgcgtgggaggggaaagagagagagagagatggggggcagtttcgtcacgtcgggcgcgtggtggtgggccagcctcggatgctctgcgcttttgaccgttgtggccgcatgaaaagcctgccgctgttaacaccggcggtggccggccgctgctccggcggccgcgaaagggggtcgactggtcggggcttttatggtccccgccagcggcaggctgatgaagatttggaaagatcagaggatgattaatggttataaatgctgtcaatatgacaaaatatggcagtataaatgctagtattccctccgtccctaagaactgaatggacattctactgcaacgaatatgtatgaattcgttcaaattcgtttatccaatcctagattacatattttgggacagagagtagtggtagtatggtaaatgatcctgtaggcgatccaccatccatggaattagatcgttggaaggagtttttagtacgtgacgggtcggttttatggcaagatggggtgtgttgtactgattccatggggttcgaattcgcatgatcgatgattctgcctgcggaataacttcacccctaccgtcccttcaactttacaccgagtttgattgacatttcttatctttaataccaggaattttcacccaaccatacaatttaagtcacatagcagtacaaatgcttggtttcactgatgtggcaaataaaactaaaaacaatgtgggtcccacatgtaagtgaagtgagaagaaagatatggggcccacatctctttcttttttcttattttctcctcttcaaggaggttgtcagtggcaaattggggcgaggcagccggtcgagctctgtcgccgcaccaacgcgcacatgccactgcggccatctctctgccccctttcccactgcccgctaccacgctcgcccgccgccgccccgcgcggacatccaccatggttttgtactcctgggttgtggtagcggcggcgtgcggagtagctagcgaggggagaggcggccgaccgcgccgacgggagaggagaaagaggagggctgaggggcggagcagccatcggtggagagccaaggccggcgcatcgggaggagtccaagacggaagcgacggaggaagtggtgaaggtccttgggcggaccgggcgaggcagatccagggtggcgcgtgggggcggcatcgacgatgaagacggagcagatcggaggatggttgtgggtaaccgtcggcctctacagggtgctttgcggcggcggagctcccccgctgtcgcctgcagatgaagatccctccgcacccgctgccttgcccccttcagccaccggcgctgttgccacctccttatggctcattccctgcgctttctcaccgccaacgatgtcacgccggtcgcctctcttccccttttccaccgacgcggccggcatgctctccccactatcctgctggcaccccccctccccttgtcggcatcctctcccccctctccggctggccttcccctttatataagaagatggggctgataagtgggtctcacattttttctcctcatttcacttacatgtaggacttcattttttttaattttattttgctgactatgatgccacgtcaacgaaaccagatatctatggaacctaaattgcacggttttatatattttaggggtgaagatttttaatactgaggataagtgatgtcaaacaaattcggtgtaaagttgagggacggcaggtgaacttaatccttctgcctacacatgctataaaaactccgtcacttcgtcaaaagaatagtccaatatggcctgttcagcttctggcccgattatttgttcgggtccagatggaaatgcaactatggccttctgggccggaacttcctatacgggcttacgatcagttgggaaggcaataatgatgagacaaacactagccaagtatacacaaccccactactcaataatgatgagttgtgaaagaatcactcaatttttgtactagtaccaacttttgatcatctggtcctgcataaacaaccacatactccagtatgctataaattctgagccgtgcaactgtgagtacagtagagtaggagttttatgcatgcaaagtggctcctctgtactgtctgggtcttttattactcggaactttagtggttgaactcttatcagcacacggtacactgccggccttgcacgagagaagagaagagacaacaattaaacaaagcacaccaaagcaccactctatccgtagccatccatccgtttcgtcacgctggaaacacaagagatcgccgtcggctgtgctggctgcaaagtgcaaacggaaaacgtgacagttgtgttgcttcattcacattttttttacaggtaccatatagtactatagtacaacaacaacgcgttaggtagagaaaaaaaaagttcctgtcattgataatacttattggttgtactatcatttttattataatacatatagaaatatcatcaaatatattattttattaaagtacttttttaatactaaaatatgtatggttaatattttagaatttaattatagttaaaaaaataaaatttgatgttagcttttgttcaaaacgtgagcttttgttcaatacggcttgttagggaataaaaacaatttatagacaattttttttatacatttgttcgtagtgatttaaagccaatgttgaaaataaattatgttgaagtatcttaaaatcaactttaaaatcaagtttaaaaatttaaattttagggctacgaattattaacctgagggactacttttctgtatctcgatggtttttggaggagaaaacgatcagttgacactggggagagcttggaaattcagtggaaacgaagcagccacggatggatcgagtagaagagcggtccaaaacagtggtgctcctccgctatttggttccttcctcaactcctccttccttttctcctggaagcttccagtcttgcagacattgaaagtagaaaaaaacaaaagttccttactagccgcacgcacgcgcacacgtactcgttgctctagtcgtctttaaacaaaaaaacagttgttccgggtttcgtagagtacatggctgtactttgttggtttagatcagtgattgaccaaaatactgttcacatatcagaccaataactttattttggccttcacgtgtgcaaatataaaacaacattaaatttttttaaaaaattagtaattcacttttcattaactattaaactagaatatatactccctccgttccataatataagggattttgagtttttgcttgtaaagtttgatcactcgtcttatttaaatttttttgaaattattatttattttatttgtgacttactttattattcatagtactttaagcacaacttttcgttttttatatttacaaaaaaaatttgaataaaacgagtgatcaaactttacaaataaaaactcaaaatcccttatattgtgggacgggggagtattatgtttgtttgatgttgtgtatgttgtatcgttaaattcgcatttaaaaaatatcatcatactacgtttcttgtataatttgctgataaaatcaaggaaaatcaatggtattacgagttacgactgcacagccgcaacactgctaaatcgttggtaagtagtactggtacgtaatatagccgcaaccagctctactgcgcagagctgtcatgctgttaatgatcctcataaatatacaattaagaacaggtggaaggtgtgcgtctttacggttctcttaaacctgatttcgtattgatacgtcttgacgagtataaacatgaatgcaccaaatctcttcccctgcaattataaaaattaaatatgtttttactaatattttagtaatttcagtcggtttataatttcattcgcttttaaaaatataaggcatagtataaaaaatcatttaaaaaaactcatgctcatttcagatgagagtcggacttctaattgcttcaaagtttctgccgagccataagaaaactatatatatggctcggcagaaactttgaagtccatcatcccaactgaaatctgaattaggtaccaataatatttttcctatatacttttaggaaaaaaaaatgattacgcatgaaatttatatagtaaaaaaaaaacagaatgaagacgactacacgaggcgagcagattggaccggcctgaccgtttggcgccgcggctgtaccagtaccaccatccacagcagttgttgcgacttgacctcttcccttcctcctccatttccaacgccctcctccttcccttgttaattcctcctcctcgtcgtcgtcaacctcccgatcgagttcccaccccagccaacgacccaaccccagcttctcctcctcctcctttcaaatcacacccttcgtcctcggaattctttgcgctgcagcaccagcatctcgcaagtcaaaccatccttatttattctggttttcttgccttgctgctgctgctgctgcggttgattttgatcttggaagaggaggaggaggaggggttgggttggtgggggtagcagcagcagcagagccgccggtgatggaggaacggcaggcggtcaacccggcctgccccaacgccgccaaccccttccaccgctgcgccgactactgccccgtccctgctcccgccgccgccaccgccaagccgcccccaccgccgccgtcttcccgaccggcgcagaacgggaccgcggcgccgcagaacgggacggccgcggcgcagaacggaatcgcggagcagaacgggagcacgcacagcgacggcgagctgcaggcgaagccgcgccgccgcgacagggccggcggatccgggggcctccccttctacgtcttccgtgagcacctcccttcctttgccccccatctcttcgcagcaactttcagaagaaagtatgagaattcgattcgatttgggttttggtgctgtagtgcgcgagggagccgacggcgacggcaagaaggtggacccgcgatgccccaacgcgcccaacccgttccacgtttgcaccgagcactgcgccgccaagatggccgaggtcagccgctcgtcggagggcgggaagtcccccatgtcccttttctcccgccacttgggccgcttcttcttctttgaaggtttctgtctttctttgctcgattcgttacttgctactgattggtaacatcatatttgggatttgttgttctttgtattatctgtcataacaattgttgaatggttgcgcagatggcagcgtgagatcggggagcagcaagaaggtggatcctaagtgcccaaatgctggcaatccattccatgaatgcactgagcattgtgctgccaagatgaaggaggtgggtcagcagaataagactgttaagaagtcgtcctcacgcaagaaaggtagcatattctagtggcctcccactgctgattgtttatggtttcttagcttccccaattttgatgttagtgtagattaggggataaatggttagttgttttaaccctaaacctaactaaacatatcccttaaatgcctctaatggtacaaacaaattgatatgcactgtaaatgtagtgattggtatcatggaagcaaattggaaaaaagaaatgtgactgagttttgctggtttacgggaaaggaaaattgaagggaccaaccatgatcatgggaagatctgttcaccataatgtttcgcagttcatgtagtgcttgttggtgggaaaaaagcagcaacacccttttgctttattacattattgtaataattattatgttcctccctatattaaatgcaaaattataagaaaatcttaaatgatttgttccactactttgaaagaattggatcacctacaaacaattgttggtaccataaaagggcccatgtcttaatcttgtgaatttcgaatggaatggtggcattatgataatgatgctaccaacttgcttatcctgaatatgctcaattcagattatattttgtaccttcaactgccattcttaattggttttgtttacgcctacagggggaaaggagatctctgttgtgcagaactggaaggtggatccgaggtgcccaaatgcgtccaacccattccatatatgcgcccaatactgctttgatcatttgaatgaaacgggtcagaaagatacaagcaaaccaggtacatctagttaacccaatgagttatcatggcatgtgtatatatacgagagctttggcagacattttaatgcctactatctctctgtttacagactcaaggaagggcaaagctgttgtgaaagcagagcaaacaggagaaatcaatcctgattgtgtgaatgcgtccaatccctaccacaagtgtggggaacattgtaagagaaagggtgacaggtagataaggtaatgaaaattctcttttatgttcggttatccttgcgcattgaagttatctgtacttcattggtttgatgtgtatattaactgaacatatttcacttaacatgggtggcatgttatcaagccatgatttggtacttgtaaagttcatctagctaaactttttggaccaagtaacccttcatgaaagatactagttcaataacattgtcatttagtagttatatattgtcaactagtcagattcgtttttcttgagtcacatgcatcatctagtaaaaatctgtcatctttcaacaagtttctagatttcattgtgcacaactagtaactcagctgtcatgacctagctatgggcacatcaacttacatgatcccaagaaaaccattgaagctctgtaactacttatatgtattttttaggtgctgattacaaacatgtaaggcaagacatatgacggaaaaaaagtttttcgtattagttttctttggtcaagctttgaaaaatcttatgagctgtaagcatctggtcaacatatgtttttctttcccctagccagctaatccagtgtgttgtagatctgcaatgattttgaggggaaaaaaagatattagttggatacaaaaaaattaacttgatgaacataagcagcagattttctttaatcatacaagtgatttctttttttattattttagttgacagtatctccttttgtggtcctaggctggcgatacaaggtttcctctccagatgatgatggtgaaaaaaaaagtatatcccgacaatagtcctgtaggtttcaatagaagctgtgtttccatcggctccgctttttattgtggctgcagcatcacaatctttgctgtattatcatgtactttctacacactttcttaccgccattcactcctataaaagagtcccatattctagatctagtagtataatttattccgtgaagattgtaaaaatagaagcgtgttgtttctttttttcccccttctttttgtaagataattgcctgcttatataagttataattttgtcaccaaccaagtggtccacaaaccagttttttcattcattttctttccatcactgtccatatttgttatataaaaagatataggcggatcgatgtttgttatagcagggaggttcttctgaaccaagatatgtggccattaatttcccttttgttttatcatcaatgaacaagggaaacccatcattgatatcaactctttgacaagtatggctgctctttctggttggcagggtctggttgtgaatcttctagaatggagatggagccatttggtcagaataatacagcatcatcagtattcagtactactgtacacgtcatgttacttatagatgaggaatgcctggggggcttggaattttcagactcgtcagttgtttggtttgagacgtccaattcgtgcctgaaaatgtcttttgacctgaaaaaaaaggagaattttccagtgtttgcagcatagctgatgtgcgtgatgatgtgatcgacattcaacaaaacgggtggttgcacgttctgattatatttatggttcacacgtaggcgacaaaaggacgaaaatgaggtcgctactcaaaaccttcgtgaagaaagtaggcgtcagaagtgaaaaactgcaccgaaccatacgaccaatcaaagaacctgggaaacaaaaacagaacaattgcaagttcatgtgtctgttccaagagaattgggatccgggagacaggtgatgaaattctactcatacagaatttgacgtaaatatgcaagattgtggagcggaacttgccaacttggtagaattcttcaggaggttggttgatgagttgtcttgtttgaaactttttgagttgaattgttgaacgctttaaaatagaagtaagccgtcctccttttttcatgagtttaagcatcttgagttcaaatcctgactaacacgcaattatcaaataaaagtttgcagcctaatcctattccacgcttaagatttagagcgtttcgcgtgagagaatgagtgttgcaacattagtgaattacccgtctctactcatcaacttaagctttcgggttaatttggttattacataggagtatatttcaatagaccaattgaagcacaagcatctccgaactgctgagtgctgagtgctgactggaagcagacaagaacttctctagaaccaccatttccattttccaatcagataggtgaccgtcgatgtcgtcgacgaccgcgcgtcgtcgacgcagaaaggacccgtaatcccgtattgtgcagggcgcacttcagaatcgcacctccggccaatcaccgccgctgtcgttgcgttcgccggcggcggcgaagggagaatctcttgtgcttgtcgatctcatcggcggtggagaactggagatcaatccgggccacgctgactagacgaggaggagctcttcgactctccgtcgaggagcattgtacgactacctgtggctccgcatctcgccgtcttcaactccggcatcgtacgtacgccgccgccgccgccgtctcctcctcgcgcagtctcgccggccgcgaagacgacgcacatatcgcggtcgcggcgatgagtgggccttggcccaacggctcgagaaaaataaatgggcctcgcccgcaagcccatcacctgctcggcccagttagaatcttactcgcaaacgaggaggagaataatactaataatgaagtcaaatagagaaacccaccacctcgctcaatccaaaccccaattcacacgcgttgcggtctccgacgagggcgaggcggagctaatcgtcatctagggcaaggcggagctaatcgtgggtccgatggagaagccgtcgccgccgccgccggggaagtcgcggccggattgcgtcaactcgtcgaacccgtaccacgagtgctccgactactgcctccggcagatcgtgaagtccagggaagataatcatcggtggtcgcgcgtccatccccactgcatcaacgcctccaacccctaccacgcctgctccaacttctgcttcaggaggatcatccacgccaaaccctcaccttcaggtagtaatcctgaccctgtatcgatctatcatctatcgtctgcttctgatcaattacttctgcttctgatcctgtttctgatctgagcaattttgcgccacggatcgtcgtcctgagctagcctgtatcgatcgatccatcgtgtgcttgtgtagtttctcactgggtgttattcgttttagggttggagcgtccggtgcaagagccgcctgcgtccgaagctgttcctgcccaagctgacgacgatgatgatgcccaaactgacgacgacgacgaggaggacgctgccgcagacgacgacgatggttacctgaagatgacagtgacagagaatcagaagctagtatttgagcttcgggtgcggccatcgacgattctgcggtttgtggtagctgctgtgtgtgcactcctggttattcatctcctcggcgtatctctagttgtcgttgctcacgccctcatttgattagacaaagagaagcatatataattgagggaaaataggaatcaaggtctattgtacaattttgatactataatttgatacgtatggtataggatgaaatttacttttcttatcagcatttcttaaagatatgtttgttgtagcagggggtgaccaccgtccctccatattcggcccaaaacactgtagagagagattgggtgagattgagtcattattgtaagtatccgagtggaaatgaccattcgaacaaggaaacgataaaacactattcgagtcggaaaataccgttcgagtaaattcttgtcactaagtcttattatccgttttgaatgtttcctaagtcagtaacaggtcagctaccggataagtcgaaaagggtagtcgaactggaaaagactatttgccatggaaaagacccatggtggtggaaaagaccatcggtcgaggagaagacccatggtggtggaaaagactcttgatcatgaagaaggcgacttagacaacaaagatgccaagagaatattcccgaggaccactcaaccacttcatctagctggcaccaaaagactataatgacctccataatataccaaaatgcccttagggttagctgatatagcaagggcataattgtaatttcatgtgggcccaacaaagggtgcaagtgtaatctcacatgtaaagctgtgaactatataaagcagacaaaaagcctgtagcaggcaggatatcttggaatactaaaagtcttgtcacttagtatgtgtttatttggtatttgggctcatttcttaggataggcgggaaaagggggttttcccgtctatccctaatcttgtccgtgaccttgggtcaaggtcacgacagtggcgccgtccgtggggacgtgtagtatccttggagtgggcttgaatagtaaatgaaacgttcccaaaggcaaaagtcagtgccaatccgctacaccgacacttttgcaagcgcagcagcagcnttgnagggtccgagtggagtcaacaacaannngccccg

SEQ ID NO: 3916 - DNA, 2279 bp, Oryza sativa
  unsure (1)..(2279): unsure at all n locations
cacagtatcaagcctttccctttttttcactcgcaccacccagaaccaacacaagagcaatattgcattccacaaatgcccaatccaaacataacccagtttgccacacaattccccaaccgcataggccagttcgcatcagcacaatcctattttcaaccggcgagagcaatcgatacctagagccccctgagccaaaatctgcaaatggcaccttggccaatacatctcaagttatcaaacatcacaaagtacaaaggtgatacagatccaaatgagtatttgagggtgtatgagacgccggtagaagcggccggaggagatgacacaacgaaagcaaagatacttccaaccatgctagaaggagtggcattgtcgtggtataccaccattccacctatgtcaatctactcgtgggagcatatgagagatacttttcgagcaggtttcattggtgtatatgaagagccaaaaaaagcagatgacctatacgcactgaagcagatgccgggagaaaccttgagaagttttatggtaaaattttcaagaataaggtgtcagatcaggcaggtagatgatgagatgctcatagcatcagcaaaaagagctttgttgcctggccctctccgtttcgatcttgcaaggaataggccaaagacagcaaaggacctgtttgaaagaatggaaagttttgcaagagaagaagaagataagctaagggtgcaagcagaaaaggctgcattattggaaaagaaccagacaaagaacaagcaagtttctttaggagaaaaccaaaaaccagaaaccactgcaaaaccatggaaaaaattcaagaacgattccaagcaagttcagaaaaaccaagtaaacttcattgaagatgactcaaataatgtagaaggaaaagggaagagacatttgggggcaatctgcaaaaggccaaggacaatggtggaattctagcaaaggtagaggacgatagtggaataatgccagaagcggaggacaagaatatcagcttgatcataccaagttttgtaaagcacatggtccaggtggtcattctacggaagaatgttatagcaagttttgccaaattcatggtccaggagccctttccactcaggaatgtaggcccatggccttcttagtgaaaaagcatgccagtctatatgagaacaagtatgagggggcccgagatcagcgagggcaaaatgctattgaagcaccacaagtcataaaaatctataagcaatcgaagaagctccaaaaagggtgataaatgccataacaggaggctcttctttgggaattgagtcaaaaagacaaagaaaagcatatgtgagacaagtaaatcatgtagggacaagctatcagtcaaatccaccagttcattccaagacagtaatttcctttgggcctgaagatgcggaaggaatactttttccccaccaagaccctttggtgatctcagtggaaatagcacaatgcgaaattcaaagaagtttggttgatggaggaagctcagcggatgtgttattctatgatgctttcaaaaagatgcaaatacccgaagacagattgacaagtgcaggagtgcctctgcaaggttttggtggacaacaagtacatgcaattgggaaaatacgtttgcaaatagtttttgggaaaggcaacaatgcaaggaaggaggaaatagtgtttgatgtggtagacatgccgtatcaatataatgcgatactcggaagatcagcaatcaatatcttcgaggcaataatacatcacaattatatatgcatgaaacttcctggaccaagaggagtgataacagtccgaggtggccagttgggggcaagaaagtttgagctttagggaatgccaaatgtcaaaggagtccatgtcgttgatcaaaagcatggagaatactctaagttgcagaaaccagttcctgaaggcaaaactaggaaaagtccagttagatgatgatgatcctggaaaatacattttgttaggagaaaatctggaaaagcatgttaaggaggaaatcttgaaagtagtgaaaagcaacatggatgtctttgcttggtcaccagaagaactgaaaggggtagatagaagcctgattgaacataacttggcaatcaagcaagagtccaagccaaaaaatcaaaagttaagaagaatgtcaacagacaggcagcaagcagcaaaagtggagctcgagaaattgctcaaagccaaagtgataaaagagtgatgcttcctgattgtttgcttan

SEQ ID NO: 3917 - DNA, 3505 bp, Oryza sativa
  unsure (1)..(3505): unsure at all n locations
ccagcgttaggattagcanatcncgaacccacaacaaggcgagatagattgaagagagccaattctgaagtatttggttcgtgaacaacttccagaaaaggaagaagaaacaagaagaatacggttaatgtcaaggaaatacaaagtgatagaagggtagttgtacaagagtggagtcactgcccctttgctaaaatgtgtaacaagagaagaaggaagagaaatcaccttggaaatgttagacgagataagagtggaagcattagacaaaatggcacaaagcacaaaaggaaccaaaagctattatgaaaaaagagtgaaaatcaggcaaatagaagaaggtgatttggtcctcaagaaaacactcaatgaagtggctattggaaagttggaatcgaaatgggaaggaccattcatagtaaaaaggaagttagaaacaggagcatacaagctggcacacctcgatggagaagagttaaagcacacttggaatgctatttccttgaagaaattctatgtgtaaaaaaaagaaaaaaaagagaaagaaagaaaaaaagaaaataaaagaaaataaaaggaaacatgctgcttgaagtgtacaataccgaccacctttgtaagattctcttttcttctcgatgttaacacatataaacaggacgtagggttgttatccataatgaaggcccgaacctgtataaaaagttgtcttgtgtgattgtgaatcgggaaaatcctccgcacgcttcggagaggaaaatcaaactcaatagcaaatcgagaaaatcctccgcatgcttcggagagagaaaaatcaaactcgatagcaaatcgagaaaatcctccgcgcgcttcggagaggaaaatcaaactcgatagcaaatcgagaaaaatcctctacacacttcggagaggaaaatcaaagtcgatagcaaatcgagaaaatcctccgcacgcttcggagaggaaaatccaactcgatagcaaatcgagaaaatcctccgcacgcttcggagaggaaaatccaactcgatagcaaatcgagaaaatcctccgcacgcttcggagaggaaaatccaactcgatagcaaatcgagaaaatcctccgcacgcttcggagaggaaaatccaactcgatagcaaatcgagaaaatcctccgcacgcttcggagaggaaaatccaactcgatagcaaatcgagaaaatcctccgcacgcttcggagaggagaggaaaatccaactcgataccaaatcgagaaaaccctccgcacgcttcggagaagaaaagccaacttgatgacatttttcgaataaatttttaccttagctattttgtatcagaaaagtattcggaaactgttttattaaagaccacacgacaaatttacatctgattgcttgttaaaaaaggaaaagaagaaggaaaaatgacattgagaggagaaggcattcccgtgtaagagacaattgagtagcgcattttccatattataagttgacgctcagatggtctaaaggtttgccaaaaattaatgctgctcgaagcattattcgaacgtcgttttctaaactcgacgacgaagtcacgcaaactgccatctcgatgttctctttgccatttaaaaaaaattaaaagaaaaaaatacaagtgtcatcgtaatgtatttccttctcttcatcatcacaattagttgcttgagaaaagagcaacttctcatgtgttcaaaatgcaatgtgcttcatgtttcgagttgaatgatacttgctacggcgaaccacaacttttcggttcaaataaacgcataatgattatcaagaataaccagcttcgaacttcaaaattttatatcctagtgttttttcaaccgaataggaggacggcggttctcccctagcttttgattcgaacacggtttcggtcgaaaacacacatcgcccttacccgtgaggggctttttgtagcagggggtgaccaccgtccctccatattcggcccaaaacactgtagagagagattgagtcattattctaagtatccgagtggaaatggccattcgaacagggaaacggtaaaacactattcgagtcagaaaataccgttcgagtaaattcttgtcactaagtcttattatccattttgaatgtttcctaagtcagtaacaggtcagctaccggataagtcgaaaagggtggtcgaactggaaaagactatttgccatggaaaagacccatggtggtggaaaagaccctcggtcgaggagaagacccatggtggtggaaaagactcttgatcatgaagaaggcgacttagacaacaaagatgccaagagaatattcctgaggaccactcaaccacttcatctagctggcaccaaaagactataatgacctccataatgtaccaaaatgcccttaggtttagctgatatagcaagggcataattgtaatttcatgtgggcccaacaaagggcgcaactgtaatctcacatgtaaagctgtgaactatataaagcagacaaaaagcctgtagcaggcaggatatcttggaatactaaaagtcttgtcacttagtgtgtgtgttcatttggtattcgcgctcatttctcaggataggcgggaaaagggggttttcccgtctatccccaatcttgtctgtgaccttgggtcacgacaatgttttctggacgcgactacgcgtcgctcgccggacagggagcgggtgaaatcgggtgctgacgtcagcgtccgatttatgtgcaaaactactgatttttctcttaaattacttatccaaatcatgatccgattgcaccattaaattcgttgcaattaaatcttcaaaacatgaccacacatggatatattccgacgaaaaaatttttagcttattattgaatttttttaaatgttgcacgatgttccaccaagtatatcggaattgtttcactaaatagatcgaaaatgtttcactcgtttaaatcggacgttgtttcaccttatataaaaacaatgtttcagcaaatagcgaaagaatgtttcagttcactgcaacattaaatctatatatagtgaaacattgtgaatacactaggtgaaacatttttcgatggaacaaaaaataaaccaaatttccttaataggggatttccaaaaggaaaaagtacaaattaccccccccccgaactatcgcggtcgttcgaattaccccccttaaccacaaaaccgaacattctttacccccatctatgcaaacccggctaattaccccctttctccaatccgcgttgtttttaattttgacatttcaatcctccatctattttttaaaaaaatgtcggacccaccttcataacctctatctctctctcccttatttatttattaatcctcttctcctagacacctccttaacttccaatatttctcatattcctaatcctcatgccatatttcacaaaactaccttttccactcgtttcctctttcaacctctatatatccct

SEQ ID NO: 3918 - DNA, 7964 bp, Oryza sativa
  unsure (1)..(7964): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagcggtagagctcgaggatgctggccatggcggcctcccgctccccggtgcactccccggtctcctcgtcatccgcgtcaagctccttcaccgcgaacacatgttccgacgaggaggagctcgcctcgggcgcgggagacgaacacctcgtgcgcgtgcgcgtgcatcgcggcgtccatgtggggcggaagagccatgagcgccgaccgcccgtctgcccgtccccgcgccgccatgagcgcccatccgcgccgtttgcgtcgaccgctcgcatgcccacccctgcccaccgcccgtcccgcgccgccgctgccgcttgacccgcgcgcccctgccgaccacctgccgtctgcaccgccgctgccgcttgcctccgccaccagcgagagagaggatgagtgagagagagaggagagagagatgagagactatgacaggtgggtcccacatttttttaataaataaaatgctgactggactgccacgtgtacgccacgtagaccaaaaccaccgcggattgggtcgaggggggtaattcgtccggtttgcatagttgagggtgaagaatgcccggttttatggttcaggggggtaattcggacgaccgtgatagttccgggggtaattcgtactttttttgtggttcaggggggtaattcggacgaccgtgatggagtatttcagttcactgcaacattagatctatacatagtgaaacattgtgaatgcactagatgaaacatttttttttgaaaaaaaaccaaatttccttaatagaggatttccaaaatatgtgggttttttttttgcaatagagctgtttgtgtgtggacacgtggtgggctaggtggagcgcaggcatgcgcgcacgcgcgggggggggggggaagcgcccgaattttcctcccccgcccggtggcccgaacggaatcattatccatgttttcttatttatgtttcgcaacaggatcttaaattcttaggcatagggtagtgacggtacttctacattcagttcgtcgaagaattggcatagaatttgcaattttcaagatttcggagaggaattgaacttttgctcaagttctttgggagttttggacctggatcctttattttcgcatatataggtggtgttcttttcttccgaagatgaagactaagttttttacacaaaacgaggtggtattaacgtatgattgattaagttttaattattacaaacttgaaaattagattaatatgatattttagagcaactttcatatagaaagttttcgcacgaaacgctgtttagcagtttgaaaaacgtgccacagaaattttaattttcattcaacttttgttagagaaaagaacaacttttgctagagaaaagaacagaaccatatagtctactgtttttttacaccaaccatagagtctcctcttgctagactttgagctgaacgccatccgactactccgcaatccgggggggggggagatggtgacacgtgggctctactgtttgttttgtcgcgtagacaccacgtcgattttgctatatatttgtcgacaaatttttcccctaaaatttgacagatataattacagtacaatcgtagtgtaattacactgtaacttgcatgtaattacactgtaactatagtgtaacttgtatgtaatttttaaaaatctctccgtaacatgttatttcggtaaaatggaggtcgtgggaacaaattctttcatatatgtatgtgctatgatttgttttcttcctcaccaaaacaaatcttgtaatagatctaacgattcaaaattatgtgaaacttacatataagttacgctgtagttacacgcaagtcacaatctaattacactacgattgtgctataattacatttgtcaaatttttgaggaaaaatttatcgacaaatgtataggcagtcccaaaatctctctcaaaacggtgtggggaggtaaattgattcgctgtgctcgattttgccaattagagacgaaaatcaaactcagccaatggttgagggatccgaaataaacttttttccttctgtaggagttgatcgttggaccaaagagaaagtatcttaggcctttgaactaactcctgggtctcatgggctggctgcgatgcggaatgcatgggccttgggaaatgggtgggccaatgtctcttcggcccggtttgaagcccaccacaccaccttatcttgccgacgccgcatcgtcttctcaatccccaattcgcacgcggagctaattctcttctagggttccgacgaatcccgagctcggaggccgatggcgtcgtcgtcgtcggcggcgtctgggaagtcgcggccggagtgcatcaactcgtcgaacccgttccacgagtgctccgactactgccttcgcaagatcgccgaggccaatgagcgcatcgaggacgagcagcggcccccggtggaccgcaccgtccaccccgactgtatcaacgccttcaacccctaccacgtctgctccgagtactgcttcaagaggatcgccgacgccaaatcaggtgctagccccgcctcctcctctcgcttctgtacgtattttctgatcggagcaatttgcgccatgggtgatgtccatgaatccatactatagtggtaattctaattcgaggctaggagtaattcgattcgtcctgagcctgtattgggtgcttatggagtgattcattggcttcgatttagggttggagcgtgcggagcaagaaccgccttctgcagacgctggcaaatccgacgctgcccaagctgagggtggtggtggtgatgatgatgcggagcaggaggacgccggctcagacgacggttacccgcagatgacagagaagcagaagaagctatttgagttgcggctgaagatggtgcggtcatcggcaattccattgttttgtcatagctgttgtctgtgcagtcttgggtattcatctctttgctgtttctcgtgctgcagaatgaagctaggaaggcaaatcagcaagcgatggtggcagagaagaagaggatggagcctcgcgctgagagtagaggtgtttctaaacaaaagtggctggaagacagaaaaaagaagatcggaaagcttcttgactcaaatggcctggacatgacaaagtcttacatgctcgatacacaggagtcggccgaagcaaaatacaagaagtgggaaaaggaacctgcaccatatggttgggatggtgagttccatctctcgaatttcttcattcaatttatattcagaggcatattctgtagctttggtgaatttcgacacatccgtattcatattgctgtctctcatggccggttgtcgttgtggtgtttattatacgtgttttaagctaattccaaatgaattttctgaagttacttgaataattgtttgtcagtttgttacctagtagtatatggcatgttgttcctttcccatcagggtctaggttgtcatatcagtttctttgttttataagtttaacctgtgctttgcaaactttaccaacatatgtttctgtttttcctgcatttaaatattaaacctgcaagtgtaaattactgatgttcttaaacaagattatatgttatatatgctcttgacaaatgctccctataatttttgcgtctagccttcagcaatgcaacatctggttagcatttcttgttacatagtgcattgaatgtctggcaccatgagatgtctacttacatgattctttatatctggaaatccctgatgcttatgttatagtcagaaatcagaaagcatcaaggtagccgccataggcccatggttatagcttgttgtttgaaacaatttgagtttggccatgaactccctttgatctttttaatttaaacctcgtacctctatataaatgggggtgttctcacttgcagttttcaaccagaagaccttatatgatgcatacaaaaagaggaccaagaacattgaggttgacatggaggcatacaacaaagcaaaggaagccgatcctgaattttatcgggacgcttcaagtctccaatatgggaaggtacttgccatcgtaccaaactttgtactaattgaatttaaggcccttctgtcatggagtccttatcgatggcttgtgcgttgaacaggtgtctaaggtcccggaagaaaacatagacaggatggttaatgagcttaaggaacgggatgagaaacggaaagcattcagcaggaggcgcaagttccatgaagacaaggacattgactcgatcaatgaccggaacgaacacttcaacaagaaggttgagagggcatttggcaagtatactcttgagatcaagaacaatcttgaaagggggactgccttgccagattagaaactctgcacactctgctggtagagagtggacatgttgtctgtttccccagctgtcttttgcttgtaagttgtaacctatcaacaatttgcttggaaactgtaactgtaagaaagccaactcggatgtaatgtcgtgagaatatagcatattcgagaagttgtgtatccaaaatgagcggaatcattaactatagtgattttgcaatgtattcaaatgagcataatcattaactgtagtggggtgctggtgccccaaatgtcttgcaataagccgcacgtccgaattccaattataacgccggtctgtctagggatggacgagactacaaacttgtccagacagtctagaagatgccttaattgtagctaattgctacaattaaggttgatctagacaaggtcacgaacaagttgctgagcaagagaaattatcggtttgtctgttgccattgctatatggagtatatgttggtagtatactgctatcggtcaagcaagccagtgggtgtaaccgtgtaagaaagtgactgttcctaaccttaattttgatttggatgatggtaattcaagaacgctaattaggccggttgaggtagcagcatcgtgcggcagtgttgggaaatgatttgccttagcatatattggttggctgttcagtcacagttgagacttgagccaggtgaggatttcattttcaggctttagtgtcttgcttactcttcactactataacagtttagtctttttttgagtgtcctgttagaaatatcactctcttgttacagttcttgcgttcacctttttctaggtgatagctaacaaaatgaagatttcactttctaggtttattttacttgatggcacatggtctaagcaagcactgtactctctgcaagctaccaacatactcctacacagcaagcagctcaagttgttctctgagaaacgcctgaaatctgattgaaatcaagttggcacttaactggccaagaaaccggtcatgatagttggagtagtaccattgcttagtttctgtcacacaattgtctgaaaagctttctcctttttggaaggaaatgaaagggaaaaaaaaaagaagtcttgtctgaaagtgtgtgagaatcaggccgtcctgaagccatcactttcagagcatctgggacttgaagaatttggcaagtgaaaaaggatgtagagggatgtggattttcatccctcgaggggatatcccctcattatttacatgtcatttaaatttaaatagttatcaaaaaattttaaaaacaattaacaacatagattaatacgaaatatatcactccacaaacatgcaagaccaaattcaacttatacaagttgtaacaaaaataacaaattaactgaaaatagttatcgcacattcgcaattatattgttatttttgttacaacttatagaagttatatatttcatattaatctatgttgccaattttttcatattttttattgactatttaggtggcatgcacgaaacgagcagatatcccatggagggataaaatcactttcccgatgtaaagataaccagaaagaagaaatgacatcaggcgtgagcgaaacttgccggacgagtggccatcgcaattagttaccagtaacacacaaggaatcatcgcatctcgccgcaattaagggtcgcccgtttttggctcgtttccaccgtccgctagctttgttccatcctgaccgacggcggggaagagctataaacacgcaaatagctcgttggccaccgcgcgcgcgtcgctctcccgcctttcgtaaatgaatgagctataaactttctcacacccagatttttattttttttgccccctactcttctttctctctcttgggttgcgtgtgaccatgcaagcgagagcaagttggcatggacgacaggtgcctacttttcgagctatcggtgcggcgttatttataaccgacaacaagacaaagaggacaccagagccagccaatgtcgccgtcaccatgacggcgaataggactcggtccgtgtggacagccgggtccttctccggtggaaccacggcaaccacaccctatctgcagtggccgatctagaaaaataattcattggtatcataacgtgtctatcgatattataattatagtattgtaatatatgaacaagcagtttaaccataacttttatcgaaagtcgtcggtatcgtttgacaccgatgttaatactgtagattcgcccatacctgccaccgccggtggcgaccaaccaaaaaaagttcgccggatcgatcgatcgatcgacgcatggcccacgagcggatcgatatgatgatcacagacagcatccacacaaaaagggagatgaaaagatgcgaggttctttcgcgcgcgcgcgcgcatggccggagatcgacggcgaaagcagcaaatcggtcattcgccgccgccgttgccatcgcccacggggatccctaccactttggtcatggcttttgggacgaatagaatagaacctaattttggagctaaagcagtaacaacataaaatggaccacggtatccaaaaacgctacgaacattcacattcagattttttgtgtgtgtgtgtgtgtggatcgacaaaaacaaattcttcgctccatcgatccatctcttcttcttcttttgttgattgaaatgaacagaagcatgcatgattcaaagcttttggggggaatttactccaaaaatcaatataaaaaaataatcgagcttcaatctgcggcaaaatcaaaagagctctcgtttttgtacagtgctgtgctgtgttacgtgtaccgaatcgcatatccatgcggagacgagcttcgcctactcggggcgtgtcatcctgggcagcacgtgcagcgacaccacccgcttcccgcccggcgccgccacctcccacatgcgcggcggcggcggcggcgccgcccacgattccctcctcgctgctggtggcggcggcggcggtggcgttacgtccacgatcaacaccttcccaccgccgggggccaccacgcaggccttcccgccggcgacggtcatctccgccgcccccttgaggcggtcggactcggctaccgtcctccagcggtcggcgccccagtcgtaggcggtgagcgcgccgcgctcctcgtcaacgacgtagatggtctcgccgtcgtccgggggcgacgccgccgcggggcccttccagccggcgagcatgccgggcggcatgtcctcccagcggccggcgcggaggtcgaacacggcgccctccttggcgccgggggtgcggaggtttcttcatgcgcaactctgatgcgctctactttgaaaaccacctgttggcgctggcccacggcaaagtcgcttcgggtgggggagctatatttcgtgatgtcaaagncgatgctcgctcagggaacgagctcgtctaaccnngggacat

SEQ ID NO: 3919 - DNA, 12217 bp, Oryza sativa
  unsure (1)..(12217): unsure at all n locations
aaggaaagcgcgtcccagcgtccagccaaggggtcgtaggcggcaaacgagacgccggcgtcggcatccgcgtcgtcgaggagcgcgtacagagacaaaaacggcgggaacgacggcgcgtacatgagccgtctccacggccggcaaacggcgtgcaggagtcgcggcgggagcggcgagaggcaaaactgcgccaggtggtccggcaacccggggagcaacggctgcggcggcgtggtggtcgtcatcgtcggcgggggggcggcgccaccgcctcctattccatgccgccgtccatgggagcagcagctggtagcgaagggcggagccgcttgtgattctggccggagaagaaagtgatcgccgtcgtggtcgtcgtcggcggcggcggcttgcagtaggggcgcttagccgcggccatcatggtcgcaatactactatatcagaggaggaacccgagttgcttcagcgagcacggcggtagcaggagcagtattatattgggggcgaacgcatgtgcgtaggcgaggtggtacaattaatccggaaaggttggggggtgcagtgcaggggagggggaaggcttgaccacctcccccatacggccatagatatgggaacatgagaggagaggtcactggtcagcttgtgtttgtgtggtgctaagcgaagctaacacagcagcaacatgtatgtacagccaggctgcaacgcgggtagccgcgacgttgggtcgccgttgcctccacacaatgtacagagcacagctgcacaggcccatgcggctagcttttaggcacgtacgtgtacacatgcatcaggggactcaggatcactcatcgaactagctggaaattattatagcgttggtcgtcgttgcaaaaagcaaaagaaaacgaggattttttttccgtgaacgcttaaaagaattacatgttaatatattataaaaaaaatctgttgcaaaacgcaatcagccagattggcttttgccaagggaagagaaaaaaacacaaccaagaaaaagggaagagaatactatgacagctaaacgcaactctaatcagttgggagagagacagagtcacactatactcccaagaaatttctaaaagaagcaacgccaactaacgaccacagatgacccttcgagagaatggactctacaaccactgagaccgaagagagcgcagagtcgaagagcctagaggaagaacatttagtattacctttcttccaaaatatatttttttatattataaatctaagatacatatagttgtttagatttatagttagatataattatattctgggatggagggggtagtacttgttagttttagttttcactatttacgtctacaatgcgagatcgagacattcagctgtgattaagtcatctatatctataaatataagtattttctagcatccaaaatttatttataaattcaaatatttctctattactattttcccagtccaacatctcccaataattccatgtatttattgatgtgtccctgagcatgatcacttctaggcaggcaaacttctatgagcatcaaagtgatttcacttttaaccttagtgcagaggaaccttatattgattgatggatagaggaagtgcgtcattagtgcagactgcaacaaaattaacccgtacgtcagctgtgattaacaaattaaggataacaaagctagtgcacaactgtgcaatgatggatccactttatgacaacataaaacgaactacacgtcagttaacttgcgtggtcaccatccaccagaaaggaagaaaaaaaatgctgtaaaacgatcgagttgacgaactctagctagcagctggtacacatatacaatctcatttggctgctgctgatgctttttcattctgtgactcaaaagctgcacgatcgggatctcccctgtatcttctcttctgctcttgcactttggacctctcgttgtgctatcatcatacagcaaattttcaacgctgggaaagtactattagaattctatgagtctgatttctttgacaaattacacacttacctacgactcgagattgcaatgcaggtgcagaaagatttttggagaaatcataccttgagaaaacgggcatgaataatttgcatataatctatcagctataataatcttataatctaaaaggaatgaatgaattatagtagaacaggccgctgactggcatataatcataacaatcttgggatcattttaggccaaaaataattggcaggccaccctttggaatttggaaaagaattcacggtaaagcataggaacacaatctgattcgacatatctgagttgggatattcgatggtggagcagatcccattcaaagcaactttctgctctctgaatttggacattcacattctttcctccttttgtttttcccttctcgtttgatatatacggctccctccatccctttattttttaaaaaataaaataaaatttgtgctacaaaaattggcactctaaagtacttgtctcatcaattatctctcattcatatttctcctaaccccatccttaccacatgtcatttaataaaatgttttatattatttctcatgaaactttaatctatgataaccaatttaaaacggtaaccttttagactgggagagtatactatctactcctccctcagtttaatacaacgaatcaagctcaggtatgtgaaatggtcgggtgtgtttagcgattacacatagactttttagttaatcacacatagacttttccgccggccgacggagggacgatgagaattgatggatgatgtatgtgcgaaaaagtagggagcaaccagccaaccgacgaaccaatgggggaggagtcaatgtgtaaaggcagggatatgcatacacttgcaaatcagatcagatcagatcagattgattattgcctgctcctttttggatgctactgtagcaaacctaccagcaaaaaacccaatacctccatttatggaagaggagtacacttgccttttcaagtatttggacttttgcactgttgctttgcctgcaatttgcaaaaaagcttttgtttgattatgggttgtggcacaggcactaaacatcctcaaatatagtgctactccttttgatttaaatctgtagataatactaggtcggcatggttcaaacttatggaatcatgatgccactgaaattttttttggatggaagttgtaaaagttgaaactttatcagtggtgtatgagcaaagagatgtttcagtggtatctttcggaatggttgtaccagtccaattttctctttgctttgcccttatcaagttgatcggagcgaaattatgctcaaacatattataggctatattttaaggccatgtttagatcccaccctaaaatttttcaccctgtcacatcgaacgttcaaacacctgcattaagtattaaatataggcttaaaaaataactaattgcatagattgtgactaatttgtgagacgaatattttaagcctaattgctccatgatttgataatgtgatgctacagtaaacatttgctaatgatagattaattaagcttaataaattcgtctcgcggtttactgacggattctgtaattagtttttttattagtgcccgaacatcccatacgacaccctatataatatccgatgtgacacgccaaaactttacaccactggatctaaacatcccctaagctaaaaaaattcactcgaaacaattcagtttatttttggttgaataaatatcaactttctatgtactgtatcatttaggtaaacagctcttttgaagaaatgaatagcaaccagatatctcaggataggaaacagatcccctgactttgtgcagtttgcagttgtgccactgacatgtgagggcataactgcaaactgcacaaagttaggggatcctcattcctcaggataggagggccatgacgtacggtacagaaagcacagctggaaatggcatgaaaaacattgggaaaaaaaagagagaatggcatacgtgaggcattatgggatagagagagaaagagatggaagaggacgacaagttgttttggccatttgctcaattgctccaaatttttttttttttttgcgtgttgttggttattgaattgaatatttgaatggtgcgtgtagacgtacgtagtgggcaggccactagcagacggtcacatgcgtacattgcgtcaccgcggaaaaggcaccgttcgtccgcatttttcaaactacatatacgtacatcagagttagctaggagtatttgccgactacattcacctcagttatttccgggttttcttattttttgtcttggttttctttaatcattgggggccatgggcgaaggacacgctgaacgcttttaagaagattgctaaatttcgaatgattaaaattgctagaaattctagtcatatttattttatttatttatcttatttaacataaagctagctgaaaggatagctagatttgcacataagcccctaaaaaatgggtacgttataacttgagaacaaaataagcagataaggactacaaaagataagaaaaaagcaatcagggtcttagtcttgcttcttcctctgcatcggttcctcgatcgatgacaacaacgacaacaagtttgcaagaaccatggcaaactgcagaatgtattgccaaatagaaaacccaggtggggcatcttggagatggagattacagttgccttagcaccatataagagcgcttcagttgctgcttcaagacctgtcgcgggagacaaagaagaggaccgaagacaacaggaagatcgccgaagaaagagaggacgttcggcgctacctgttagatgttgggattgaggatgaagccacccacccaaacaaatcaactgctcatttagttgctgacatcttggagggacccaacaaatcacagacaagacgacctcactggaaagaagcctagcaagtacctccatggccagagttgttgagacaagggagatcggatgccgatgacctccttgcattgcacaagagtagaaacatgatgtactcgaaaaagggaaaagcctgactaaacctaggactacctagtagagaagaaatgttgatccctccccctctcttcattggcagcgaaccaccaaattggaggtggaagagggagaggagaggattttgtttatctgcagttgcctggtttcgcgagagctctctcgaaccctcaaattttagtcatctttagcctactaattctctttgggagcggactggagggagagggacaaggggaggctgggacttaccagcggtggtgacaacagtcttcttctatggcgacgagagggaaactagtgagacctagtggctagcagcattgtcggtaaccaactaccctaaattcgattcctcccttctaaaaatatattcgggggatgtctctcccctcgaatctcttttttttccctagcaacagtgagctccttctcttttctagcgcgctgatgacacgccaactctattggagaacatatgaataagggtttagagttggggttaggatgaatggggtgttggtaaaggaggagagtggtttcagcaggcttagaattgatggccgtggtcagcggtggacagcggccacatgtagggcacaaaggtcgagtgggcattaccggatccaccaggttgtaagaagacgcgacgtggatgctaaatatgaagtggataagcagcatgggtgcaagagaagatgtatgataagatggggggcactttgtctaatgcctggcttgcgaaggagaatagggcgggatgaatagaatgacgactgggttgcccttgccagcactagtggcgcggcggggcacaaaaacttcaatatatgtttttttggtttcaattttaacccaacttttatgacatatttgtccacacaaacctgaaaaatttcataaccaacataccctcctaattgctacttacaatactacacaaataggagtattcctgggggcagaatgatcacaattaaatccagtaaaagatctactactactcctagttgggtagttttgtgtggttttagtagtaaaggtagggggagaacttgtatggaggaaaagagctgcatggccattgggggagcaacaccaacaccaacatgttgtcaagttggttgttggtccgatggatcctactggtatggtacagctgcccacgcgctcgagagcgatccaaagaaaagaaaacagaaaacagtcggtgtgattgtgatttttttcccctttttttttgggtttaaataattcagtggtatttaagaggttgctgtgcgtccaaaaggtagcttttggcctttatgcacgcccaggggccatcacgccaccactcatctgattgcgattggttttgtgttatttatattagcctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaacaaacacattcacacacacacacccatgcatgcttaattaatactccattaatcttgtttgtttaatttagtcgatgtgcaacagtccatggaacgccttttcgcccggattcgttggcacatggctgctgcctcctgctgttcgatcctgcttccttcgtatcgtacgatcgcatctcttcgtttttatctttttaataaaatttatttaagtggaattaaatttgtaaaaaaaatagtaatattatcaaattagatttattaaatgtaagattgatacattttgataatatgtttattttgtatcaaaagtgttgatattttttataaagttgattcactaggaaaaaaatcaaaacagaaggagtagtaaaaacatattccctccctccgataaaaaactatctagtattagatagtacgttttctggtgcaacgaatttggacaggttcaaaaaaaatgtttcatccaatttcagattagttttttttttttagaaacggaggaagtacacagtatggtacactgtatatggatccaagacagcttgcagagttgttgcagctgaaacgtcgccaccaagtctcacgtgctataaataatcaaaaccactaggggcatgatatgaattatggaatggaagcatttgcttttctaggtaaccatttgttgtacggcactagcacaattttattttgggtttttggtttatgttgagcgataaaaactttaacagccaattggatgtcctatttgatttacattattgagagaactattgttgcaaagtactatccatttaatctagtaaaaaatgaatttaacaagtggtctaagcaaaacatcataagagcattttttttacaaaaaaaaacatatattttttaagtatagagaaataatccattgatagattcagattaaacagttttccacaatcaaataaatagttgtatgtaggtgtcgtggaagattctgatggtcgggacgtgagcgacgatcctgtggaggagaaaggaagaaggatcatgattatgggagtttaattagcagcgttgacgataccgacgtgttcttcaatcaaaccaatgaggtgggcttaatcaattcgctagccaaccctattttgacgatcatgttgatccaggttattcgtacgtagattttcctgaagcttccccagattaagtgtgggggcaaatcagtctcaaacatgtcaagatcaaacaatgcaaatttaatttcctcgagcgaatccgacttgaaatttgactgtgttcttgtcccaaattaaaaggaataagaagacggtttcttaactctaatcaaattctgatgatgaaactagacatgatgatcatgttcagatttatcctcaggatttgaattattattattgttttttataaaaggagtacattgtagagaagggatagaaatgaaactgaaaaattatttttttcctttaaaaataaacaaaagggaaaaaaggcagatctttcggggatgaggaccatgtggatgaatgtgacgatgttggtcatgaggcttatcaccttttttatcatgacaggatacccgaaagaaacagctaattagctagcaaatcgatgcggtcctgtccccagaacatgccaaaattagcttttcggcaacttgccccacatgtcaaacagttgatgagctaggcgtacttaacaagttaaccactaattaataattaggcagatgtgtttgaccaatcatatatttgtttgcctttttttttgggagcatgtacatcatcacctcctatcttgtttgagagattaattagtagtcaaagctcaatggtctgcttaatttgtttggaaccacggtgctatatatgcctgctgctgtaaaaaacagcctgcaaaaagtctgatgtgcttggtaactccatcatacatattgtgtgggcgcgtgcttttttttttctagatagcatgcgttaagctgaaagctagaatatttgtttgtcatcagatgattaagagccaaacgcataaacaaatattgaaaaattatcagtaaagcaagattaccatgattcaattcactgcaatgtcaaaattaaagaaagtcaagcatacagaattcattttctgccatctcctaagctcagggaacttaattagagaacagctaccctgtgccatcaacaacctcaactattgacaagctaggggaatgctgtttgtatatgccaacacacacacaaccaagctaaagacccgtgtgttgcaacgggtattgtaaaaccaaaaaacaaaaacaaaaatgacaagtttaatttatagcatagttagttggttagtcatataatgccatatccaaagaaaaagctatatgggccactttggattgatgccaaaatgtgtcatgccaattttttggtagtttgaatagtaaatatgatggtttggtttgaagccaaatgaatggtaatgaccatgcttaatttggtacaattctagaactttcttcaccataatataaaatttggcttccaattggtattaatccaaacacattacctagtattctaccctaccaaaatattggtagtgccaaaatatgcctaggttttggcactaccaatgttttggtatggccctaaaccaaacaagcactataattacaagtttatagcatagttaattgattagatactacacatcagctcgtggcattgaaggcagactcgtacaccacaccactagtatcatttaaaatagaatagataagtacatgcgcggatgcgcctagctagaacctaggtaccatatattagctgttatataaacgatgccggccgcatatgctattaacaaatgcagcccatgatcgtaatgctcaacaaacaaacaacaaaaacggtccaccactccacattatttgcaagggatgattcagtgaagaaaacctgaaagatcaccagtgctagggttatcaaaactgagtggtttcgtaaaatccgcctggttttttgaaaccattgttggtcagtttgtagaaaccggatggtaagttatcagtttttacaagttttcggttagatttcggtaaactgattaggagaggtttttaattaaaaatcaaaaggtaaaccctgagtagtgctgattgatcagtcaatccacaaacaatataatgtgcaggccggccagaccatgcatagataggggggatttgtaattataacactgcaaacattaatctttgctataatgataggataatagtagtgttattatatcgtaaatcctggccggccaacaaataaattcgtcgtgatgcatggtgcattcaccctgtacgccacagtgctggtaattacaccatgcacgccacagtgcatatatattcacaggcctgtttgaaacagaattttacacaatttttttacgcgttgtttacttgattaacgtgataaatcaataaatagtataaccaatagaatataataattttttcaagaactgcggaacaaataatccgtggcaaaaatgaaaaaaaaggtttaaaggaacaggagcttaaagcgacattttctctgaactccccttgtccatattggccggcgtctcactatcatgtcgcacgaatagctcattatcataccattatctaaaaaggtgataatattattgtggggctattcgatatggctagatggctgcctgcaaatacagtaacaaacatacaatctctacggtaaccgctgcagcaacagcgttggagagcactgcagttgggtaaccgaacaccccgtatgtaatgtgttaccggctttagtcctttaaatctcttttcacgggtttttgtgctagtttttttttcttgttgtacctcccgctttcggcgtacgttgcattgtgtatcttaaattctgttttcttctaatatattgatatgtaattttttttcgtgtttacgaaaggtatgtaatgtggatcatgtacaaaaggtacatgtcaatcaattttggcctgctctgtatgggccagcccataggagaagaagacgactagtatgtttgggcctttcggacggcctagttgccaacctgcatctgcaccggcaaggctggcccgctgcacaggcaggagcgggcttaagaattcaacaaaataaggccgggctaaatatctcattgtccaaaaggcccaataataagaaaaagaaaaaggaaaagaaagagcgcctccctcccatgtcggccatggacagaatcctgcaattccagatgtgtgctgcagaaagccggccggccaacatgcatcatgccatcatccagctgagttggcagatgttaactgcacgtggccacctaagcctgccacgtcgggtcccacatggtagtaagtagtaacactaacatacacataatctttgtgctcctttcaaacgcaatattctcaaaccatagtggccattcagattatagccaaaataaatcttaccaaatttttgtaagatttattatatatttactaaagtttggtacttcttttgtcctaaaatgttgctacctatgatgggatttgacctatcataggacaacgaatctagacagagcttcgttgtcctaggatgacccatcctaggtagcaacattttgggacggatgaagtaagaaactaaatggatgcacatatttggcaactctataaaaaaataatatggtttgaaatggcatcaatttgaacaagcctatagaaataagaaaagcgggattcaaatgtcattgaaccttgaagatacagaaaaactacatagacaaccgtttggatgaagtacaggaaaaacacagtatgtagaagagagagaaaaaaatccaaagcaaaaaaaggaattccattaaacatgtcattccaaagcaattttagggatataatcctttcttccagaggtcctcatatgaattgctcccataggattcaaatttttcctgtagaattcatctatttgtcctttgtttcaaaggagacttatgtacaagctgcgcggcgccactgtcaatccatctaaaatgcaaaaatgctccctcatcagtctccctgtaagtattttaccctcacctaccagtaacaatgcacgctttgcttaatcagcatcagaccgatcatggcaacgggaatccgagaagaatgctgacacaaaggtcccatttatttgggcatactactgttcttctgcgagggattattcagagatttaatctaaaatttagataaggncgtcggaagcgagtagcattcaaatnnncaccac

SEQ ID NO: 3920 - DNA, 1779 bp, Oryza sativa
  unsure (1)..(1779): unsure at all n locations
agtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactatttctgtacatgcctcgcacatataagtgagccgtttcacttgctgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgtgtcgatgtgtaggtttcgcccagttcgctatgacgcaggccgcccacttttcccaggctgcagggtcagcgacaaaggcagctgtgtcgacctcgcactcagcgcagttctggcagtacaccgggacttcgtcacaggcagccggcacgtcgagtcagggtccaccactggaccatgctgggacctcgtcggaccgcttgctgccttccaccttgctcttcgacatcactgacttcgacttcgcttcaggctcgacagaggacgtcattggcccctcacagctgggaggcgcaccgccggtgcagacgcaggaccaggcgcaggccactccttcgcaggacactcgtgctacccgtgctgtgccaccggatcgtttcaccttactcccaggaccacgtgcgagcacaggcccgaaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgataccttttggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcatacccaccataccccaccacgttcacatgtcaggggtatcactcgattttttgcgcctatataagtcgccttaatgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3921 - DNA, 2685 bp, Oryza sativa
  unsure (1)..(2685): unsure at all n locations
cgaactcttcttctaatatccctggttttattcataattcaagtagtttcgtcatggtgttcagaatggcctcaagtatcctcttctaataagtcctgatgttgatgcccaacttcagttagtttctgattgtatttagataggggtactatactcctcttgaaatattccgtgttttaaattcggaatatcagttatttcttaattgtagttctatatgcactctagtctcctcttctaatattccatgtatttgaatccgaatttcggttatttccgaagtgtatattgtataaggattctaatttcctcttctaatattccatgtttttaattccgaaatttcaggtattttccaattatatttctataggggctctagtctcctcttataatattcccggttgtgaatttcgaatctcagttatttgtaaattagatttctatatggactctagtcccctgttgtaattttctttgtttttntntcnncccagatgaaaaagtacggccgcaagctctttatgggcggccaaaattgcaattagccccttgccgccctctgtatgggcggcaagggcctaatcgcaattttggccgacgccggcagacggcgcggtcgacccaccgtctgccacgtcagcttgccgcccaccattagggcagcaggggctatttctgcaattttttcggtcgatagattatttctgtaaatataaaaaaaaatctaaaaacgaaaaaaattcttgaattgagtgcctcggtgcaactgaagcccggaagaacagtcaacaagattgatgggtggggttcaatcttccatttgcacaagcacaaaatgagcatatcctatgatgatagttgtacacatctaacaaatgccagcttatctctgaatactctgctggagatgatgcacaatactctcctatctgccatgcagaaaccatgctaatcttgctaggttagtgagaatcaagctactcatgctacaaacttccacacggccggtcatctggtgtttccctttcatgtaccagatcatgctgaactatgctcttgtatgtgtccttttagcttgcgactttggcaaaggcatgtcctgatgctcactcatttgctgatatttcgcagccaagacatcatcaaatgctttctgaagtgcagcctttgcaaccttgtaaacttctggtgacatggctcctctcattccgtatgtcaaaccgtcgagagagagatcgttgtaccaagcaactaggcgctcaggaaagctaactccagtctccaacgatcgctcgtctggtacaacactactcacagcatccattgtccacctcttcatgatgtattcctccggtagattccgaaccccgaccatgaagaagattcttagcgcatgcctgcataatataccagcgtactcaaacttgcaacatgtacactctgctttcctgtccagctggttgaaagagactatatagccccggccattttcttcctcactggccacattgtacttgaggataactccatcctcaattttatcagcatgatagcctagcgattcgataaattcctcctgaaatatgtcaaacactgcccttgtatagatggccgcagcctgcctttcaattacagaaggagttttcagggtaggctttgaatatgctgtcacaaagtttgcttgagcttccttctcgaaactcaacgccatcacttgatcaaacctagagataagaacaagcagtggagtcttcatgttgaaatgcgtcttaaaaaacttgttcagcctctcagatctttgcgacttgagtaactctggaaagaaggatcccttctgatacacccaagcccattgctgccgagtgtcatacaacgactgaagccaagtgttctcctcgagattatacttatggatgacatagtcccaccgagcctgaaactcctcaattgtctcagcctcaaagacacattccctcagatcagctttcaggttgatgtgctgtatatacacagcagacaacttctgcttacataggctcaaaatgttccgctggcagaaacgatggcgggtgttgggcaacaccctcgcaattcctgcttccatcgccttacactggtctgtcaccagcagatcaggttggcggccacccattgcagcaagccatgtatcaaacaaccaggtgtatgaactctttgtctcatccatcagcagacagcacccgaatatgatcccctgcaaatgatggttgattccccggaacaccgcgaacggcatcatgtacttggtcttcctgtatgtggtatcaaatgtcactgcatctccaaagctcttgtatgccatccttgcctttgcatcagcccagaacacattggtcacgcaattgccgctatctacctgcatcgcgtagaagaatcccgggctctcggcctgcatcttcctgaggtaatcgagcaaatcttgcacctcggcacgcaccccagctggattcgctctgacgagcctattgcagaaggatggccctccattgggcgccccattgcccactgcagcaggagctccggtgggttcgtccgagggttcggtggcggcttgggtaggttcatccaatgctgcggcgtgctctccggcgagaccatcggactcaccggcgggaggagggcgggggcagagcgggagcgaaa

SEQ ID NO: 3922 - DNA, 1176 bp, Oryza sativa
  unsure (1)..(1176): unsure at all n locations
attacatgcaagttacagtgtaattacactatgattgtactgtaattacatctgctaaatttttgggaganaatttgtcgacaaatatatagcaaaatcgtccttttttataagagaaaaaaagagtcttaggcctgttcactttgatgccattttcaaccttaccaaattttggtaaagttgccaaaaaaagtggctacatttagtttgctgtcaaattttggtaactatataagaaatcctgccaaaatttggtaaagttttttttcatcaaagtgaacaggcccttagtattgattttttttggataatgaataaacatcagcctctatatttacaagtgggcatacacagcacaaagaaaaactcttattgatggttggttttttttttctttgcaaaacgattgcggtgatacttgttggtattgaaatatatttatacatgtttatatgcaaattgaacagattgagaaaaaaagttagttgcaagtgtaacttaaagggtgtaattacaggacgcgaggaaataattattcacgatggatattttttatgtaaatcttatcagtttatcaccgatatggaatgtagcaacctacttttattgggactcaaatttgctgaagattcaacaattggtatttggtagcaatgtatcggtaagctgcttgagatgatttgacgacatgtcgtcattcgctcactggaagtatgggttattgaaatcccctaaatgattcatttatagacctattaatacattgctctcaaactctttaggtagatgccgtaaaattgagaattaggcattcatagctttattattgataaccgttagttcatgatgtcatggttatggataccacatacactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgttttgggggtgcgagtcgcatgcattcaagggacca

SEQ ID NO: 3923 - DNA, 859 bp, Oryza sativa
  unsure (1)..(859): unsure at all n locations
gatggntnntttgtgatnnnnnnnnnnnnnnnnnnnnnnnnnnnnnnnnnnnnnnnnnnnnnnnnnnnaaggcagggatatgcatacacttgcaaatcagatcagatcagatcagattgattattgcctgctcctttttggatgctactgtagcaaacctaccagcaaaaaacccaatacctccatttatggaagaggagtacacttgccttttcaagtatttggacttttgcactgttgctttgcctgcaatttgcaaaaaagcttttgtttgattatgggttgtggcacaggcactaaacatcctcaaatatagtgctactccttttgatttaaatctgtagataatactaggtcggcatggttcaaacttatggaatcatgatgccactgaaattttttttggatggaagttgtaaaagttgaaacctgccttggttgaataagcactgatcctagcccccagccgtgaagttggaaagctcagtttctgattacacggcttggttaatacgcacggcgagaactcttacacgaccagatcttacatggtcttttgtctctacaggatccgacaagcccttatcggctctgggcgtccccagccaaagttcccttaggttcctcggaggtcttgtcaagacggcgtaaagggacagtaggataggtttcaacgctaggtgtcgtcgtggtaagggatctctgggtaaaacacttggcgatattgtgtacctgctatcaactttgttgaaatagaggtagtaggagagtcgctacaccgctggtcgaggaccaggtagtagtcgtaactcgaccacttaaagtggaaatgggtaccgagctcgaatatcaatatcgc

SEQ ID NO: 3924 - DNA, 1220 bp, Oryza sativa
aataatttataatttactaaaatttgatattaaaaataattaataactaacacgtatataaaatataatatgaaaattcaaaaataaaaataaataatattggaaaaaaagcatagagtctatatataaaaatacaatttacagaaaattcggaattaaaaaaagaaatattaaaagacgagtctagagtacatataggaatatatataatttacaaataactaaaatttgatattaaaaataattaataaataacacgtatataaaatataatatgaatattacacattagtagctttgtaaagttattgtaaaatttaaaattacgttgtcattttaatatatttgaataatataattagaaaacatatatgttattatatgagagaaaatataatgattctagtcgcgcagattgcgcgggccattatgctagtttataatatgaaacggtgggagtaatatatatttgtacagagtgcgtgaaacttatttggtgtgtgtaaaaggaatgcgaacacgtgtgttcgtgtacgtggggtggatgggtgtacccgctagacttgggtgaccaccaatagcacccggccaccaacccccgtcttcgtttcccgcgctatataaacgcgccaaaacttcgcccactccacgaacacactactacgaccacctttcatcccaacgcacatacgcacctacgcatcactcaatcgatcaacaatggcgtcgtctccactgccggcgttcacggtgcggcgaggcgagccggtgctggtgacaccggcggcgccgacgccgcgggaggtgaaggcgctgtccgacatcgacgacggcgagggcatgcggttctacagctcgggcatccacctgtaccgcaacaacccggccaagaaggggcaggacccggccatggtgatccgggaggcgctggccagggcgctcgtcccgtactaccccctcgccggccgcctccgcgaggaggccggccggaagctcgtcgtcgagtgcgccgcccagggcgtcatgttcgccgaggccgatgccgacctcaccgccgacgacttcggcgacgtgcagagcccgccgttcccttgcttcgagcggttcatcctcgagagcaccaccgtcgccggcgtcgagcccgtggtcggccgcccgctggtctacattcaagtgacgaagcttgggtgcggcggcttcatcttgggcagaggttctgg

SEQ ID NO: 3925 - DNA, 2638 bp, Oryza sativa
  unsure (1)..(2638): unsure at all n locations
gtattgtggcaaccggacgggggctctggggtacgcccccgcaagaagtccgcttttcttccttgtgaacgccggggccgggccnaccgtgcgcttcccgaaggggtttacggaaaggcgttcgcctattcggttcgcgancgaccgccggcgagctctgcgncgcgaccctcgggtacgcgctggggctggtgaagaaggccaagtcggcggtgacgtacgagtacctgcagtcggtggcggacctgatggtggtcgccgggcggccgctgttcgcgctgtcgcggacgtacatcgtctccgacgtgagccacgccgggttcaagagcgtcgacttcgggtggggagaggccgtctacggcggtccgccgaagggcggcgaagggccgctcctcggcgtcaccaactacttctcgaggtccaagaatggcaagggcgagcagagcgtcgtcgtgcccatctgcttgcccaaggacgccatggacaagttccagctcgaggtccaagctctcaccgccgagctcagctagaccattgaaacgcagcatgtgtgttctactgttacttttttttttttttgcccaagtgtgttctactgctcttgttttttcttggttcagaatgtacttatacctgtcggtgtctgataaaaattgcactgactatgtactactaatgacgatgtcctatcgtgttcaaaaaatatactctgtctgtcccaaaatataaatatttttagtataatgataaattaaatatttttaactttaactattaatataaaaaattaattatataaaattgatgttactaaatttatcattaaataaactattataatatataactctttttatttaaaatatttttcttttatagatattgttggttaaaataatatctcggagattgtgtaagagtcaaaatgtttatatttttagaacggatcgtatctctctacatttctccagtccggtcatcgtacagcgaagagttcctgtggaacgtgatccgagtctgctacagtaactaagcacaatttatggctacagcctacagtatcagtgtgatctggatcgttagactgtgatcgtgtggtttggtatcattgttcatccactgcgttagtacctctaatgcagaggatctaagttgatattttttttcagttctgtgaaagtgtgtggtactaaattatctgaatcagaactggtgatctctcgattgaatgcattagtctagttgtctctcattgctttgcttattggcttatcaacaataatcagcatttataaattttgaaaattttaattttagaagagacttacctttgtggtttgtttcgttctagtctatttctagcttggctgcaccgtagataatacggatataaaaagttgacctataaattatttttattcgttttttttccgtggcttatccgcacgactgctcctctttttaagcagaggcgaacatcaactttgttacaatcctaagataatttatattttttaatagaacttcaaacagatttttacttgctcttaggacccttttaaatagtaggaattaaaaaaaatagagaaaatagagaagtgtaaaagacaacaaaacatagaaatgaccgtttgtttagaccgtaaaacaaaataatacaagaatcggataagagagatagactccggattgtctattcctattccgcatgaatttcaaaggatagaatataatagaatcatttgtttctaatatgatagaatatatttttttctacaattcaagagggccttcgcagttagcaatcataaaaatagaattgaacaacaaatgtgacaaagcaacagttgggtcctttgaatcgtagaaatgaaaaaacagatgaatagagaaaacacaggattctgacaggaatacaattgtaaaacagaggaatgtaaaatacaggaaaaacacaggaatggccatttgattagaccacaggaaaaacgcagaaatcagatgagagagatagattcagaggaaatgttccaagaggttagacctcttgctaactttcctccaaaatgtgtataggattacccattccatataaattttaaaggattggataggatccaatcctttatttcaaaaacctttataggattttttttccataggattgaaatcctctaaaattcctacatttttcctacacatcaatggagccctaaaattaattcaaaaaaattaaaaaaattgtaatcacctccaaattaccactactactataatataaaccgtgtcaagcaggcaagatcctcgttccgtgtaccgaggatgcaagtgcaacaagatggatttaaagtacagatcccgtggaactttccgaggtgctctctggtgaatctatatcttctcatttctccttcatggtttcccgtttagttgcccaaattttttttcccaaaaacatcatatcgaatctttagatacatacatgaagtattaaatatagataaataaaaaaaactaattgcacagttagagaggaaattgcgagacgaatcttttgagttttttgagtttaattagtccatgattaaccataagtgctncagtagccgggtgcagagtagcaatcaatnnngaccac

SEQ ID NO: 3926 - DNA, 970 bp, Oryza sativa
  unsure (1)..(970): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttttttttttttggaacacaataggaatagtccctactctgcgtcgtgggatgaactagagggccagcatgttatctgacaccaacaaatttaagtacaatctgaaccaagaagaaacaagaacagtagaacacatgcgttgcaattgcatttagacagaagatgagctctgcgatgagggtttggacatcgagctggaacctgcccatgagggcaagcagatcggcaagacgacgctctgatcgcccttgccgttcttgaaaggaacaacactttactgaaaattagtagtactaagttgccagccagttgatataactttaagagcatggatcattatggccatgcttttataatcaagatagcagttgatacagagtaggtgctaaatgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntn

SEQ ID NO: 3927 - DNA, 1191 bp, Oryza sativa
  unsure (1)..(1191): unsure at all n locations
agataattctctcgtggtttgcatgttatctaaataattatatattttttttaaaaaaaatcaccaagatagattaatatgtgatgaatttctttacaaacaatgtatactcaaaatttaacgactgcaaaagttacaccaaaaaataaatttgattggaattatatattaactagatatattttaatttgtttttaacttgcgtgattgtgaactgatctatcacatattaattaatctagttgattgtttataactatttggatgatatgtaatccataaggggatgtctcattcagagtttagaatcaactcccataatagtagtgaaaaccgagagattgtttgttcgcgctgccctaatggtggtcgtcgggcggtcgctgtccacgctgtcgtggatgtacatcgtctccgacatgagccacgccgggtttaagagcatcaacttcgggtggggggaggccatctatggcggtctggcgaagggccgctccttggcgtgacaaactacttctccaggtccaagaatggcaagggcgagcagagcatcgtcgtgcccaaacttctataccttcgtgcgaaacataccatttaacaatttaaaaaacgagctaacgaaaactgagatagaatcatatattacacacctggtgcacatacaccggtacattgcactagaatttttattattttttagactttttaattttaaaatagattgtccccaaaacttattttcaaatacgaaccttttaattacacttgcgtggtgaacactgccacatcacccaaaaacttataatgagagtgttagtattattttgccacaccaatctaattgacgtgttgaaagtcgaaaccaaagtggccacgctaaaaaaattcagattgtaaattagttttgcgagcccttatttttaaaatttttaattttaaataagttcagaaaacagaaaaaaaagggtacactggacatatttgaacgaggactggttgtagacccccgtttttataacaggaatcattcgtgtaaacagtaccattttcctggatcaaatagtctggtacatacgagttcatagctgaaataccaaatgcttatacacgagagtctagtgctaattattacatcataagcccgcaggtattgtcttaagggtncgagcagatgtcatcaaaanntaccag

SEQ ID NO: 3928 - DNA, 983 bp, Oryza sativa
  unsure (1)..(983): unsure at all n locations
gtgtgnccattgtanatgcttattnnnnnnnnnnnnnnnnnnnnnnnnnnnnnnnnnnnnttagtagatgctacagctggttgcgagttgatgagtttcttagatgcatactccggttatcatcaagtctttatgatgaaggaagatgaagagaaaacatcgttcatcacttcgtttggaacttactgtttcatttgaatgccatttggtttaaagagtgcaggagcaacttttgcaaggttaataggcaaggtattggcaaagcagttaggccgcaatgtagaagcttatgtggatgacattgtggtgaaaagcaaacaggcgctcactcatggcaaagacctgcaggaaacattcgagaatttaagaaaatattcagttaagcttaacccggaaaagtgtgttttcggggtaagagtaggaaagttgcttggtttcttagtgtccaagagaggcatagaagcaaatcctgacaagatcgcagcgattcaccaaatggagccaccaaaaaacataagggaaatgcaaaggctaacagggagaatggcttctttgagcagatttctttctaaatctgcagagaaaggcttgtcgtttttcaaaaccctaagaggggcaaactcatttgaggggacagccgagtgccagaaagcttttgatgatttgaagacatacttacagaatatgccaactttagcaagtccacgaaaggtcaacctttgctagtgtatgtagcggcaacaccagtgacagtaagcgcagtcttagtgcaagagaaagaaaacaagcaaatgccagtttacttcgtatcagaagctttacaagggccaaagacaaggtacacagaagtggaaaagttgatttatgccattgtgatggcttcaagaaagttgagacattacttcttatcacatgacataacgataccgtcagcatacccgataggagaggtattcaaaaataaggagtcgccagaatgattg

SEQ ID NO: 3929 - DNA, 946 bp, Oryza sativa
  unsure (1)..(946): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgaagaggatagtgtgagatgggagtacaaagaaaatgaggttattcagggagcgatttatagtagagcagaagatatgaaggaggcggtaaaacattttgcagtgtcacttcatagagagttttgggttgccaagtccaaccggtcgcaatatgaagttcggtgtgttaaggaaaaagatggttgtccctagagagtgcacgcgtataaggggaaatggaaggattattggacagtgtcagttgttaccaagcatacatgttttctacctggtgttcagaaataccacagaaacattacttgtgcatttgttgcatctgagatgtatgcgcatgtcatcgataatctcacatatgaaccaaggtcaataatccgacacatcgaagagacatacaagtatactattagctatgccaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 3930 - DNA, 834 bp, Oryza sativa
  unsure (1)..(834): unsure at all n locations
ctccaactatagctcgatctttcatgtttatgtcggttagttgcgtgtatctattacaattttatattagttaaaattggccattaataatatcccaaccnncccccccgtgcgnnnnttgtagtttcagattcnacatctcnnnnnnnnnnnnnnnnnnnnnnnnnnnnnnnnnccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccggtccgtacacattgcgaaacgcatgtttcttgggtcatttgagaattcctggtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3931 - DNA, 1163 bp, Oryza sativa
  unsure (1)..(1163): unsure at all n locations
agctgccattgaaatcatgatcgacaatcccgcaagccngcaggttgactctagaggatccccatgagcaattaaccactttgtatcttcagcaacacagattagcagttgataacacgggagcacaagcaccaaaccacaaattgcatcgttgctacatgcatcctagtggagttatatgtagtaatttctgtaactgaccagtgtgcatttcttgatttacttactaattaactctagggtacatgaaccctgtactcattaactttaggttgcatgagtttgtactaaagctataaatagtccatagggcatgtaatgggggattcaaaattccacaaatcaatacacattgttttacttttcactgtgtgaaccacgtctttcgacgtacacagttgtcaatcgacaataatattatcaagatatattcttagttaaatataatgaaactaatttgatattgaaaatattgctaattttttctataaacttagttaaatctaatactttctccatctactcccttaatctttatatttcatcttagcagacggaggaaacggaggatttttgtgtcagcgaggccgccaactcgcctggatcgtcgcatggccttgtcgccgcatgcacgcacgcagctgggatcatagtctcaactgtacacactcttttaatttgccggctgcagtagcatgagtcctgttttatgtgctcgtttcatgtgaacacacacatccagtatatgctctccagttatgctcctctaactagcatgagttctgttcagattgcaacctgcatatccaaagatgcactgttattaatgggagccgtctatgtcagagctataataatttcttaattaaagtctacctatacttccatttggtggtgcttaatctcaagttaatgcacgcagctgcttctgtcctttggagtccccactatatatgtatactcctatcaagttaggtttggttcacatttgctgtaatcaactaatcttgcatcaaacttacacagttacacataacacatcagttgctagagctatcagctatgtgattcagatcaatatccattgcgtgccatggtaatggcagttcagagctagctaggggtacaaggtgaattncaggtttgccaatcaancggaccca

SEQ ID NO: 3932 - DNA, 2380 bp, Oryza sativa
  unsure (1)..(2380): unsure at all n locations
acgtcctttgttgtcataccagctcggtacccaacggcgtcatacattaaaatacgttaaaatacggagggattacagcttgcttgcattgcaggttctgtacatagccaagaaaaactcaaactgcaatgagcgagaagtgagaacatagcttagctagctataggggaatggtcagctgcgctacttattgcggagattgaggtatatatcagggctcttgaatgaatcttgattcccggcgccgcgagttcgttcgtcaaagcgtgatactaatccagaatcctaagtaaagaaccaactgataaacaaatcacacggcatacctaagaaaaaggtatggccatgtatcttctgtagtaaaagctagctcaacgcatgtaaaagtacatgctttagggcttgtttgatttagtgtcctaccaaagtattggtagtgccaaaacttacgtatgttttggcactaccaatattttggtaggatagcattttaggtgaatggatttggattgataccaattggaagccaaatttatattatactcaggaaagttctagaattataccaaattaatcatggtcattaccattcatttggcttcaaaccaaacctttacattcactatttcaaactacgaaccaaactggtagggcacattttggcatcaatccaaaatggcccataatgcttatacagtaatatagaatagttctttttttagatcataatatagttattttctgaaactttgatgctttcacttcgatcatggccatgtttagttcacccccaactactctaaacttccaactttccatcatatcacatcacattcaaaactttcctacacatataaacttttaacttttttccaaacttttaacttttcccaaacttccaacttttttcaggaactaaacacagcccatatatcatgtactaaagaactgtgttcggatgctacttttcccaacctctctctctcgtttccgcacgcacgcttttcaaattgttaaacggtgtgtttttttaaatagtttctatacgaaagttgcttaaaaaatcaaattaatctatttttttaaaaaaataacaaatacttaattaatcgcgtgctaatggatcgtcccttttccgtgcatactgtacaccgtttccatccaccggtagcgaacacaccctccttcaagaaagtatagaaggaatctacatgtaacatgctgttagttggcagatcagcatacatactttggaggaattctgtacggaacattttacttggctaaatgctgacacaataactgatattttaacgaactcagcctaaactgaaggaaagaatgtgagtcaaaaggagggttgaaaatcacaaaaaggtgtaggagaccaaacccagaatggtagtgagtggagtggaccagatattaggcccatgtccaactccaaccattgcataattcaagcttttgcacatgcatgtgcatgtacctacgtaccacaattatttgaacaggttttcaaacctcatttaatatcttctttcccatcaaaatgaataagtgtactcctcaccctcaaattaacctcatcatgtcattgcaaaaaatatccattattcagaaaacatcacacatgatctcattccgatccaatgctctctgcataaatgtatcttacttatactatgatttgatttgcgatagttcaaattttgaaacataaacaaatatgtgccaattggagttcattaggaagatgagtgtgatgtggatggcatcacatgaggtggaggtccaccagagcacgggagtaggccggatcccatcgcttgcactgcacccgactcgatcagcttcagctcgcttcccacggagacaaccacacgagatttcctctctttctcactagacactagtctcctcctgctcatggcccatcacgtgatcgcacctcttcttttgtggacatcttctctcatttttactcctcctgattctggaattttctgtttaggtcccattcttgtcacaaatgtaaccccttgccatgctctagttatgctcggccatgttttgtaataattctggttaggtcccatgttttgtaatttttttaaataaaatcataaatataaagttttaatagaaaatgtaccgtttaatagattgaaaaatgcatattcatgcatcatttctcactcttccagctaggatattgataacgtggatagctattcaacctgctgaatgttattgtacatgctcttaagagagaataaaagcctatcggtaaaaaagaagtaatgggggtaaagtagtttatcaaatttttttcacactgagctgatgcatgttgtggtccctttaacaaggtagatan

SEQ ID NO: 3933 - DNA, 916 bp, Oryza sativa
  unsure (1)..(916): unsure at all n locations
nggccgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactgatgatgcggtcaaggggcattcttgttctggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagtaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccn

SEQ ID NO: 3934 - DNA, 900 bp, Oryza sativa
  unsure (1)..(900): unsure at all n locations
cgtctataatctggtgtctgtttactaatantggcgcgtttttatttcangtnctgtatattatnattngcgtggtatatatattcgggttatatgaantctcaccccaactacccaacaccccccctagtacnttttgttgttcgacttgctcctataagcactcgattcaaccacgtagcccaataccaacagatgaatgattttatatttatgcgtgatggtttttatatttattcgtgatgaactaagcatgcgcacagatattgatctgcaaaagagaacaaagcagctttaatttgttgccacactgaagctgtattgattatcttggagaatgcagggtagctagtgatgatttgatcaattgatcacttgcttaattgcagtgacctgatcaccaccaaaaaacaaaaggttagtagtgaaggtgttaagaataattaatataatcaccctacttattatttttttcagatatcttatcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 3935 - DNA, 4624 bp, Oryza sativa
  unsure (1)..(4624): unsure at all n locations
atgggcnnntttgaatgctanncctganaancncctctgnacccctaaaaaaaaagataccgatgggttggtttcatgtagttatcatctagctaaaaaagttgtatcgtctaactaacaaatccagggaatgattgattggccggtttggcagaaatgtgatgacaatttgacccttgggtccaacctgaccgaagtcatctgaattttaaatattatatggttgctatgatatggcgtcggcctcgcatcatcgcagacgcgatgagcaatgcaactcagtgtcttgcagttagcagccgtgttatctcaaagcttgcacgtaatatattttcatctcaccaaaaaggtgttcagtgaagttgctgaaaagagatggggttccctaatcaaggttcagagtttcagacgttgaagagtttgtgcagacagatcaaggttactatacctcgtcttcttgattatcccgtgttaaacttctactaaaataaaagtattttatagtatttaaattttgagggcagctacacaacgggatattttaagtgactctcccttttcctttcctctatccacgtgtgctccctggtacctgatacctggtatgtccacgcgtgctccctggtacctgatacatggtaccttaggtaccggttggtacctggtacctggtacctttggtactgactaggtatcgaccgatgcctgatacctggtaccttacctggtacctgatacctttggtaccgactaggtatcgactgatacctaatacccggtgccaaggtaccgggtggtatctcggtatcagcctaatacttgtggggcatcagagggtaccatcaaaaagaggaggagacgtgggggagggagggccgcaacggcggaggatggcgtcgaggacgcacggcgagttgagggtcgaggcccaagccagagagcgtgagaagtctcgaggagaagccgaagaggaggttgacggccatacctgttgcaagtcgacacaggctgccggcgtccatcccggaggcgcaaagcaataggctgcagcggggacgacggtgacgccgaggccgagggcgaggacaaggggagcttccgcttctgccctccccggggcgacgactccctggcgcacacccgactgacgagggcggcgagctagagcggcgcaccaaggggaggcgagctcgagggcgaccctgttgagggttggtcgacctcgccaacgcagtgccgtcgtcgtcctcctctgccgctgaagacgacgacgacgaccccttcctcccggccggcttcgtctccgctcggccttcttcacacagagagagagagagagagaggagtggagtgaggccagagtaaaatggggattgcgtcgggtggatgagaatccgggtcggatggataaggttgaagagctatctcgacaccacgggataccggggagtagattttctcttaaattttatgccacaattttaatattcacgcattgattctcatgatttaaatgattccaaagctaatcacatgcttgaaaaggaatctaaaaaaatcaaaattcaaaaattaatacctgaagtaacttaaaaaaaatattttaactagtatttgctaaacaatctaaaaacattatattttagaacgggtggagtaattttaagttaaaaatatgagatgctttgatcattttagctccaacttgaaacctaaatgaaataaaaaaatattccggttaaatatatgtgttattagctacataaaaaaataatgctagaaaatagcctaagacaaaaatcaacttcaagttttgaaatttaaatttaggctgtgatttagtataagctaacaagcacatgataatagacggaattttattttctgtttccttttctatcgaatgttgatgaaaatcatggtctagactctagactagaatgaacatggctcttagcttctctccggatcttagactctagacaggatgtcaggatctctccgggtttccgccttcagcacttctcgggggaccgctaacccgattagttagcggattacctgaaatacgtattctttaatggaacgcgtattttcttagttagttatcggttccactcttcttccccaactcgctcctgtctccgcgcgcgccgccatggatgcatactacctcgtccgcctccatctccctccaccactccagcttccacccaccctgcctctacctcgaggccgccatgaccgccgcgtcggtggcgccgtcgcgtgccgcgccaccgccggcccagtgggcagccaagagcggccgtgggagtcctacgaccgcggcattcagcaccacgcaggctccgacctcgccttcttccttcgcctgctcgccgacatgcaggccgccgggctgcgccccagcggcgcggcgtacgcgcgcctaatacgggcgctcgcccgcgccggccggacgctcgaggccgaggcgctcctcctcgagatgcgccgcctcgggctccgcccggacgccgngcactacaacgccctccttgaggggctccttttcacggggcacctccgncttgccgaccggcttcttcttcagatggccgacgacggcgtcgcgcggaaccggcgcacgtacatgctgctgctgaacgcgtacgcccgggccggccgcctcgaggactcgtggtgggttctcggcgagatgaagcgccggggtattcggcttgacaccgccgggtacagcacgttggtgcggctgtacagggacaatggcatgtggaagaaggccaccgacctcatcatggagatgcaggagctcggggtggagctcgatgtcaagatttacaacgggttgatcgatacattcggcaagtatgggcagttagcggatgcacgcaaggtgttcgacaaaatgtgcgcagaaggggtcaagcctgatattactacatggaattctttgattcggtggcattgtcgtgtggggaatacgaaacgtgctctgcgattcttcgctgcaatgcaggaggaaggaatgtatccggatcctaaaatctttgttacaatcatcagcaggttgggggaacaggggaagtgggacgaaattaagaagctgtttcatggcatgaggaatcgagggctcaaggagagtggtgcagtgtatgcagttttggttgacatttatggacaatacggccattttcgtgatgcccatgactgtgtagctgctctcaaagctgagaatctgcagctttcacctagcatcttttgtgtcttggccaatgcatatgctcaacaggttagtctagttactggatatagatggaatcaacttcgtctaatggcatgatagttgttattaacatctgatgcagactaacatagagtgtcaaagtgataatataactttggaaaacaacaatttgcagtcattttagtattaaatcacagttctatctctggattaaaatatccatgaataattcagtgaatcctgaccattttgtttatctgttcaatgccgtgctcattgttcatttgccacccattctgtttagttctagttaaagggggtggcaatgattatatcccacccatgtgtcacacatgggccctaaggcacatgtgttcttgcacactctagcaaggcatggcaagggtatcaagagagtcaaaaatgtggtggcattactcggtagtctctactgtagtttcaaaacgctctggaatcttcaattatcattctgccttcacagttttgttttcttttggacgaaggcttaattggtctaaaaacatcaatatctacatgtcactgtgcatacctttcagtttgtgtggcttgtgcaccatttcaactctctcttttcagggtttgtgtgaacaaactgtaaatgttcttcaattgatggaggcagaaggaattgagccaaatcttgttatgctgaatttgctaataaatgcttttggtactgctggaaggcatttggaggcacttgctgtactccagcatatcaaggatagcgtacgttctttctccagaaatgagagaagaaaagtgttttttttaatgtttcttttttgggttccatgatttaacttagtttgagcaatttctacctattgttgatttcattttttcagggtatgagcccagatgttgtgacttacacaacacttatgaaggctttcatgagagcaaagaaatttgaaaaggcatgtccactatttttctactccttagcatttagtaacttaaatatcatggattgtagcaaatcctcatcctaaatttctgttgaaattctgaatacttatttgttttgctcttcaccataactgttaaaataagtttttcctcatgtatgcaactatctcacattatattatgctattagatcatcttgatgatacaaaatattgtaacaaagctttatgaaacatggcttattaatctaaggttttaggagattgaagtaattctgattattttcctgcataggtgtcagaagtatataaggagatggagggtgctggttgtactcctgatagaaaagctagagaaatgctgaatgacgcctctattgtactgaacaaggggagggtaccacgacgttgacaacccgcg

SEQ ID NO: 3936 - DNA, 1959 bp, Oryza sativa
  unsure (1)..(1959): unsure at all n locations
ngaccgattctaatatatagtaacccagggtagtttgggttgcccagaaaataaataaccctctgaagttttttttccccccaggatgttaaaatgccaccaaaaaaattttcccaacccctccatttatttttttaatgttttaattcaaaggtgtccaaaaaaagcaaaaaagcacctttctttaaaaaaagaaaggtaaggctcctttcaaaaaaaaaaaaaaaaaaaaatttaggtcccaccttttatggaaaatataaaggtttaaaatctggaaaagtttaacccacacttgtaaaaagacctcttgctttaaacattgcaatagctcggctcctctattcgcttcagatttacctattactaaatttcatgggagaaaacaatgaggcatcaagccctcaatttatcttaagcatagaaataaggttctcatatttccatgtctatctctatttctagttagaaatccatcttacttggttcctcctcaacatatgattgttgatactcttgcactctttcacagaggaagaatatcgaactacattcagggttcacaaaggaatccacagggtgcaatttgtgggatattcaacgaatcaagactccagagaggccctctgtgttattctaccattggatcacctgctgttgacaaatgctgtgtctgcaattgaagcttgttggactgacacaatggcagcaattctcttgaattgctgaactttggaattttgaggttggacagaacattggaaatggtcatccgttgatgctttcataagcctggttccacaatgctggtacgcactaaaacagtcaggccctactacattcatttcagtatgtaggatcagtcaaacacaaatgaatgaattaggacttcattcattttacatcataggatcaattggtacacttgtgtgtttgtacttgagcatgcaatttttgtagttaaggcaacaagtaggtaacacttacaggcatcatgataaggaggaatcagaaatgttcactttctgtttatgatacataattttctaccccacatatttccgtatgtttcagatgaaaaagattatatttggagatagtgatatacacgaaacatttagaatttcctcatgttgctttcttgctgaatcatacatgagtagctttgcacgataaagtcataaggagatgttgatagtatcagatggtctgatattgacttgtgtgttacaagattcagtgaagtataaaatgacatgtaaatatgtaatcaatcatcttgtgatatactgtatgacagggcaattcttttgtgataaagtgttcgttttttctttgcgttgatcctttttattttgtaccaatagaccataactcaaaataaaatagaatgaaccaattaaatcaaataagtgtgtccgtttctgtatacgttcatgtactgcaaatgctctctgagaaaattgcccaagtatgaactcgtaatggcgtgagcagtggcttgtgaatttagatactagaaaaaattgccctagtgttgttactgaaatcatgattttcacatactggaccttaacgctgttcttgagttcttctatttagaaaattgtcaggatactattactgaattcataatggcatcaggaaaggctgtgtaaatcagtaaatggtttaggagacatatgggaggggcaaaagacgaaattttggcaagaagtctgtacttcatttctacatctcctgaccacattacatatcccattcatatatctttcttcgtctatctcatgcaaaatactagaaaacagcaggatttatatccttttccctgaagtttgattcatatgactcttctatgttgtaacctaaaacattttggaacatagataaagcagaagcagcagtgatgaaatcttttgttcaactgagctcgtntttatcgtcgcagtcgctgagcaa

SEQ ID NO: 3937 - DNA, 767 bp, Oryza sativa
  unsure (1)..(767): unsure at all n locations
ccgtccaggtagaacaacatcagtnnnnnnnnnnnnnnnnnnnnnnnnnnnnnnnnnnnnnnnnatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggcttaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacggcgtaccccagcttat

SEQ ID NO: 3938 - DNA, 746 bp, Oryza sativa
  unsure (1)..(746): unsure at all n locations
nttttaatcacaatattcacaccagtacaatatgtggggtagcctatctacttgttgtcgacatgccggtctgaaggtctgactcatagtcgacaaaagggtagccttcctcctcgagctcgcgcccgacggaatcagagacagtgctagatccctacggccggcctctaaaggtaccggatagggtcgatccaggcgtatctctgatgtcgatatccgccggcttgtcttggcgtatgtaggcttgtatgttgtggcttctggtgggtgttgattgtctcttcatggtgagtgtcgatcgtgttgatcgtcttatatcatgggtgtcttccatggtggttctccctagtgggtgtcgatcccccatggtgggtgtgtccccctgtcctcctaggggggcttgtatttatacccataggtgtccctttgtccaagtagaactagggaaaccaatatagatacaatccgagtagtccttgttgtttccatgtagaactctggttgtctttccttatccggaactccctccatatccgaaggttgtttccgtatagacatggtatgtggtgggtcctgccgagatttagtcaactactattaggtatcactacgccagatcctcacacctctgacgggatacctgtgacgggcaaacgaattggtcagtagtgaccattacctttgacgggttatannnnnnnnnnnnnnnnnnnnnnnnnnnnnnnnnnnnagtaggtctaacaacn

SEQ ID NO: 3939 - DNA, 765 bp, Oryza sativa
  unsure (1)..(765): unsure at all n locations
cgttcaagtagtacaacnnnnnnnnnnnnnnnnnnnnnnnnnnnnnnnnnnnnnnnnntcgagcaggaagaggaggcaccggcgtggccttcctccgcctcccctcggcctcctccgtctcctcttggccacgagccaccggctcggcgctccacgctgtcctcctcctccgtgccgccgccgttcgcgtcaccggccgccgcgcaacgtttttctccgggtcggcctcctgcttcagctcgacgggcagcgaccttgcgaccgcacgcctacgggctttacaaccactgcggaaggcgcgagcggcggggggaggagctactcgtggacggcggccggcgggggagcccgtgtgccgctttccccaccggcgccgggtngactgcatcaccgccgacgcccgccgcctaggcgctgccggccacagagaagggagagagagatgaggaagagagagaagagaggacaagagagatgagggtgttgacgtggccagctgacatgtgggacccacgctgactcagccgttacgtcggataaaaccgggttcaaaactaccgaaggatgtcgggtgacccgttttatataattaaagagaactcgcgtatctggtttttgcggttcgaggatgttttttaccctgattacaaaggtgagggaccttcgtgtaccttttcgctggataattaagctcatgcgttgtggccttattgggatggggccatttggatcggatttccaatgggcctatgcgttctattttgg

SEQ ID NO: 3940 - DNA, 6402 bp, Oryza sativa
  unsure (1)..(6402): unsure at all n locations
gaatgcaatttacataatttgtccgttgtaaanntaanatttcttcctcgctantnnctctnccctacnnnttatgctcttcgtctatttcttctaccctcctcccnnnnnncnnaagcgtggtttgnatctcaatcttgcatgccnngcagncgactttagaggatccccggctagcctcaggatttgctagccatgccctctgaaaaatagaaacatcacagatatattccagtgacagatccatcacagatacattacccccccaatataacatcacagatccccaacaacacatatatgcagttcaaatgccataattttgcacagcaaattcacaccccttgaaagccacaatttcggtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagttaattacattgcactctataaaaacataattttttacatcgccagaaattataaaaacatcttttttacatcacaataaattatctagccaatttcatgaatctatttggcatgaaaacgtcctttcttgttcattatttctgcaagaataaaggcgcacaattcgcctctgatagcggggggggggttgatgggtgagatcttgaagccagctctacctttctgtttaataaataagaggttaattagcacgttttgaatagcaatgtagatattgaaatgagcttattcgccattagcaccaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatggaccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggttgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctcgggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttacacttgggaggtgtaagctccgtcggtcgacttggatgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagaaatggatcggataacaacaattacctcgatgtggtccactacagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagtgtccctctcttccttggagactttccgtttcctgtattgggagctgtactgagggagtccatgctttcagggcacatcgctaccaattccccgagatcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttatgtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctacagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagaacagaattcctcccacaccgcttcggttatttgagggtattcatcgaacggcgtatgattgccgggcgggttgacatactcggtgaagagcttcgacttccaattcttccaagctttgcccatcttttggaatgccttccacttgagcctatccttttcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagaattagatccaatgtaatacggggtatactatgaaagatatggcctcagttttgctgagaaatatgcatcaattacaatcatttgcatgaagggataaaaagaggaaatcagctactaggagaaaaaagcaaccgaaagaaaatagaacaagtgtagttcatctgttcttatccataaaatagaacaagtgtagttcatctgttcttatccataaggaaaagagcaagtgcaggaaattagagtagtagcaacagcatggccatataatagcagcaataagagcagtagcagggccatataacagcagtaggggtatatatgccacaggggcagcaacagcagggggagattcacataaacagcaacagcagagggaaattcacatagacagcaagggtatataaatcaacaagtgtagataatctgttcttatccataaagaaaagaacaggtatagatagaatgttattaagcaattcatccttgaccatttaacaagaagtacaggggcaacgacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactccattcaacatgtctagatatcatccattcaattcaagcaagtctagataataaaacagcccacaatcattgtggcagcagcagcaagggtatataaatcatgtatataaacaacaattcatacaattgacctattcatagacaaaaagggtatataaatcaacaagtttagataatctgcaaagcctccttaatcatcaaattatgacagaaaacaaaatgcatggagaattttggtgtctaggtcggttccgtccatggactacactggcctatccaccaaaattccccatgcattttgtattctgtgatggtttgataacctcggaactacattaaatctgcggccaatctatcaattcttcccttgtaactagatttcaaaccctacacctaataaaggtccttaattatcaaagatttcaaacaaaatgcttaataaactatttctagctagcttaataaccctcaatccatcctttttcagctaaatgtaaacatgatccacaaaattcaataggtctagcaaaagggaacaaaacaacatatatagcagtacacactccatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaactattcatagacaacaagggtatataaatcaataacttatccataaagaaaagaacatctactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctggatcctggtggcggcggcggagaggcagtggcgaagaggtcgaggcagtcggcggtggtcggggatcccggcgtcgggaaggtcaggatcggggaggtcggggaagtcgatggacggacggcggagaggacgaccggcggcgagggcggcggtggaggcggcggcggaaagggcgaggcggcgatggagagggtggagatggcggcagagagggcggcggagatggcggcggataggtcgagacggcgacggtggagatggcggtggagatggatggcggcggtcgaaagagtgagtgcggcggcggtggtgcaagccggcctttcggaaaggtccgccgagaaaggtgaccggccacacagggccggcagtggaaaaggtccaaggccgttggttggggaggtccaaggcaaccgttgcaaaagggttgccgaaaaagggccgtataagggccgctggattttgccggccgctaaggaccgccggaggaaaaagcccaagcgcgctgttgaaaaggagcgccgccaaaaaggtctacaga

SEQ ID NO: 3941 - DNA, 1190 bp, Oryza sativa
  unsure (1)..(1190): unsure at all n locations
cggctcggaaagtcgccgaaaaggtgaacggcaaagaggtcgcaagtgaaaaggtcaagcggttggtgggaaggtcnaggcaacggtgnaaagggtgncgaaaaggcgnaagaggcgnncgnatttgncgncggcgagaacgncggtggagaggtcgaggcggcggtggagaggagggcggcagagaggtcgagagaggcgaggcggcggtcgagagagtgagtgagtgagtaagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggttgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgatagtggtgaaaccttcattgtcaacttttacattgcgaagatcgacccatcgacaacgaaacaacgggactttgaacttcaagtaatctagctccaatatttgctcaactctaccatagtattgatcacgacgaccagggtnccaaggaggttgtccaacaaagnangaccatcg

SEQ ID NO: 3942 - DNA, 857 bp, Oryza sativa
  unsure (1)..(857): unsure at all n locations
tcgctcgtctaactaggattcggtgttgtactattttaaacaacccttccccgtttttntaactnncgntgctcttggcgcgttaaaaaactctnctnttctcnncnccncccccccccccccgagcggccttttgatgctgctcgnactggaccaaacgnanagctagaagaactntacaaggtccaaatcatggcttgataacatgccacccatgttaagtgaaatatgttcagttaatatacacatcaaaccaatgaagtggagataacttcaatgcgcaaggataaccgaacataaaagagaattttcattaccttatctacctgtcaccctttctcttacaatgttccccccacttgtggtagggattggacgcattcacacaatcaggattgatttctcctgtttgctctgctttcacaaaagttttgcccttccttgagtctgtaacagagagatagtaggcattaaaatgtctgccaaagctctcgtatatatacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgg

SEQ ID NO: 3943 - DNA, 935 bp, Oryza sativa
  unsure (1)..(935): unsure at all n locations
agggagggatanacgnannnnncnnannnnncnntagagganccccgntaaattggattgctgttcacctgggaattgctcaattggacactctgcacacaaattttgagacgtttgaagtttcaattgtggggaaaagaatggtgaaaactgcgagcgaatgttgagtggtcaatgctgaaaaggagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagagtaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataagcacggaatccggcagggtttaccttcctccagcctgctacactctttcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattaatcccgagggactagatgaactacaggcagaacttgtgagaaccctatgtcatcttgagatgtactttcctccaactttctttgacaaatggaacatcttccgggtcacagccgnntggtgcttaatgattacattcaataggccg

SEQ ID NO: 3944 - DNA, 1526 bp, Oryza sativa
  unsure (1)..(1526): unsure at all n locations
acgtcctttgatgtcgatcccttcaccaagggcgaattcgagctcggtaccctacacacataaacttccaacttttccgtcacatcgttccaatttcaaccaaacttccaattttggcgtgaactaaatacacatttttcttcaaactttcaacttttccgtcacatcaaatgtttagatacatgtatggagtattaaatgtggacaaaaaaaaaccaattgcagagtctgtatgtgaatcacgagacgaatcttttgagcctaattacgccataatttgacaatgtggtgctatagtaaacatttgctaatgacagattaattaggcttaatagattcgtctcgcattttacaggtgaaatctgtaatttgttttgttattagtctacgttttcaaatgtgtgtccgtatactttaaaaaattttggcacacgaactaaacacgccacaggccgtgtttagattcaaacttttttccttcaagcttccaacttttcagcacataaaatgtttggacacatgcatggagcattaaatgtggaccaaaaaaacaattgcaagtttgcatgtaaatcacgagacgaatcttttgagcctaattacaccatgatttggtaatgtggtgctacagtaaacatttgccaatgacggattaattaggcttaatagattcgtctcacagtttacccgtggaatctgtaatttgttttgttattagtctatgtttaatacatcaaatgtgtgtccgtatacttaaaaaaattttagcacaaaaactaaacacagcccttataggaaagttagatgtgatgaaaaagcaaaaagtttaaagaaaaaaattggattctaaacaggcccaaaccaaatatcctaccatgaacacagcgtcaaattttgaaaagggaggaaagttaatatgcaacttttgcatggctgcatgtcaaacccgtaacagtccccttccttatttaaaataaaagagaaaaaagaaaaagaaaatgtgaataaatctgcaacgttcacctgtggagtccgatccaatccaagccgtaaatacgaacgagtcttccatcggaaggaaacccgccagagagagagagagagagagagagagagcgcaacggcctcctcgcaccaaatccgccgtctctgcggctcctctccttcttctcctgcaatccaaccgccctcaaaaatacttgcaacccccactcatcgtctcccctccccgtctccacgccatgtcgtcgtcgtggttccactccttctcctcctactcctnctnctgctacacccaccaccaccaccgncacgttgtccaccacgcgtcgacctacttcgacggcgacgacgacgagggcgacgtcaagccggcggtgacgcagcactggcgttacgacgcccgcgctgcggcctcctacggcggcggcgaggatgtgaagccggcggtggtggtgaagcagacgacgctgcctcgcccgagagtgggaaggggtgtccacgaccgcgcggaggagaccacggcg

SEQ ID NO: 3945 - DNA, 3875 bp, Oryza sativa
  unsure (1)..(3875): unsure at all n locations
ccggtgactccgcttgccgggcgcgggggtgccacggcgacgccgcgggtccctatctgtgtgtacgcgcaggcgttcgcgccgggaatgcgcctgccgctgcacccgttcgtcagaaacggcgctggcccacttcggcatcgcgccgtcgcagctggcgcccaacgggtggcgcgtcctggccgggttcgccgtgctctgccacttccgcggcgtcggcgcgccgtcgctcccggtgttccgccacttcttcaccctggcgccgctgcccaaggggaaggggtggtactccttccgcgccagggagagcgtccccgcgctgttcacgggcctcccgtcctccgtcaaggcgtggaaggaggagttcctcttcgtctcgccgccgcccgccgcgccgtggcgctgccccgtgcgctggggaaccccgtccaaggaggccacgagcgacccggcgctcaccgagagggaggccgccgtggcgcggcggctcacgcagggccaaggcgtcgtcgacctcaagacctacctctcggagagcaacctcgtcgccgccaagatcagcagcgccccggcatgtctgggaggtacggacggacgatcaaatgccaccaacaaaacgtacatcggatggtgcagattcctcaattgctcgattgttttcttctttcttgcttccagggacggaagcttcacggggttcgtcggtggcggccgggaagaagaggaaggtgctgggcgatggcgtcagcaccggcggtggcgtgcttcggtcagagctgcaggcgaaggacaaggctctggccaaggcgcagggagagatcagccgcctgaaggcgcagctggggagcgccaaggcgagggagctggaggaggcgaggcaggcgttggagtacgagcggaagctggggacgcaggtgctcaagtctgatggcgccgccgccggggccagcaagcgtcgccgtggcggccagtgatccacgttccgccgctgaacgccgccggccagcgattcggtgatgtgctaggtatttactagtactactactacttgccaggataatgagtagctttgcggagtagtgttttagcaaggacctttcatgtttcttcataatcagcatcagctgtgacagacagtgctgatcttggttggtatcatttcgcaacaaactgctaatggaaaatctgttcacagacaccaggtgatgttatgaatcgcaatctgcttagtttatctaccatgttaattagcagcagaaattgctagctactggaatgatcatgggtatgagggtatcccactagttgagcgaaatgaactaaatacatagataatatgcatcagaaagaacacattttatagctgatcttgtaaaacaagagcaaggtcaagttgggtaaccacaagtgaaccgcgcccatactatcgccaaatatccctgcaatctgccatcttccatgaacacaacacgagcatcaggcttctaaaagatggtattttcacagcaaagggtcattataatgttattccacaagtacaagggtagattctgccaaaaatattcatccagttgcaatcagaaagtgtccccaaaaaaactgcttgctaccttttttctttgtacatgttcagccgaaatgttactacagtaattgcaattcaattggtccatatttgcgctatacaatgacactacagctcaagatgagaaaactaaatgcccacaaagattatccaattgtatgtactccaagatttggctagtgcatttgcacggtccactccagctaccctttactcttatcattgctagttgattcgttgtcacttgttgaatctgtggagctattagatgatgccattgtgttggactgctcactgattttctctgcagcgctgctggaattgtcatcgcccatgatagaagcaaaagtgagctggagaccatagagtactaatccaattgagttgattccaaacacaaatgttgctaggtagcatatcccatttataattgttctgcagagaaaacgtggttcattcattagataaaaggattacaatatataacaaacaagagaacagtgaatgaatggagttgtaccttattgttattgttatttgacgaacctgcagaaaacaaaaggaggattccattagatgaattgtgctagttacaaaaaatatgacgaagactgaaattcagttcctctgtaagtatatggaaagttggtagcacgaaatagcacattttacggtgcataaatgtgttaaccgacccacgggaggacaacaagaaataatttttgttgcagctctcttagtatttgttccctgcatcattgttgaatttgtatgtgttggtaaaacacaacaataatttgcattttccatgccttattctccatttgtgaaataatattgaaatgggattcaattccttgctgtaaacttcaaggcacattggcgacaaaaaaatggatggtgattacagcagacaattactcaaagcattgcatagcagtagcgctaacttctactagaccattaacgaaggataacaagaaaatggcaggtaataatacaaatgaagcaaacttcaagttggaaaattcatttgaaaccaaaaaaatgtcaaaaacagcataaggtagaggggttcaaattgctcaaaactaatctgcaatccttacaagaatatagaattattcccacaaaataagtgttaccacactgaattatggtccacactccacacttcatcagagctgctacgaaaattgaagtgtcgacctagggctgtgttttgttcaccacaccaaaattggaagtttggttgaaattggaatgatgtgatggaaaagttggaagtttatgtgtgtagaaaagttttgatgtgatggaaaagttggaagttcgaagaattattttggaactaaacacggcctagataacatagccgcacaagtttcatcggcaaacttggcctgcaataaactatttttgttgaagtctttatcacttacactttcagcctttgaccagaaaactgcatagctctaacacaacttcacttgtgccgtgtttagttgttttggcaaaaaaatttgacgcatacggacacacatttgaagtattaaacgtagactaataaaaaacaaattacagattctgcctgtaaactacgagacgaatctattaagcctaattaatccatcattagcaaatgtttactgtagcgccacattgtcaaatcatggcgtaattaggctcataagattcgtcttgcaatttacatgcaagctgtgtttttttgtccacatttaatgttccatgcatgtgtccaaacatttgatgtgacgaaaaagttgaaagtttgaagggaactaaacacagccttaatggtttatgtaaaccagcattcattgtccactatgatatattgaattatcatccatgtggttagttcacaacctttattaaattgtccacgactccataaaatttatttgtagctattcacataggttcaatggcgcatagacatggcaaactagttccaaacaatggcgtatatacaattatacatttatttgtcggaacaacaaaaggattaaccgataaagtgaagtctgacaaaaatcaaagcaacacagatacttgtcatcacagacacaatcggacacatacagcacagccccaagatccctgttactcatgctagatttcctccaaaacttatatgaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3946 - DNA, 1456 bp, Oryza sativa
  unsure (1)..(1456): unsure at all n locations
actttctaaaagaatattcatattctaaaaattttctcaaagaaccctagtttgaaaggagccctaaacagcctaaatccattttaatgtgctgtaaaaaaacatgtatattgtgcaccaaagaaaaatactaaaatattgtgaagggggaagagagctgaccgagaagctgtcggagatggtctggcggttgagcgcggcctcgatggtggtggtgaacttgtagaggatgagcgcgatgacccccgcggcgatcccgccgagcagcgcctgcacgggcgacggcggcttgtcgacctcgatcggcgacgcgctcaccagcctcagcccctccagggcctccttgctcaggttgttgggcttctccaccccgccggaccgaaccctctgtgtcacggaagcaaaaaggatttttagaccatttttctccagtcgagaaagcgcagcgcaggtggatgaggagggaggggattacgagctccttggcgcggcggacgcggcggcggatggagcggaagaggaagacggagatggcgccggtgaggaggacgctggtggcggtctgcagcggggtggggttctcgtcgatggagaagagcgtcggggtgcggagctccacggggccatctccctcgccgtcgtcgcccgggggaggctcggctgccgaggtggacagctccggctcggcgcggacggcgacggagcggcggaggcggagggcgaaggcggaggcggcggggaggaggtcgcgggacggggggagaaggaggcggtggcggaggaggaggcgcggagaggagtggagcagcagcatggtgggagtggagagctgcttggcggtgctcggggagagagttcagtggataacgaacgggtcgggcgagaaagggtgtgatgaattattttcatttctaaatttttattttttaatatttacagaaatattataccatttaaaatatttacagaaatggcccccctgccgccaaagtggagagcggcaaggtgtgcacatttttcattgaggtctcttgccgccctcgtacaaggggctaaatgcaattttcgccatgttaaaaatgcattttgctaatttttcttttgcatctcggctgtctctcacgtcaccctgggtctatttttgtaaatattttcgccggtataatatttctgtaaatattaaaaataaaaatttaaaaatgaaaaaaattcaggtgtgatcggcagatgggctactttgatggaccgaggccttctccatcgtttcttggtggtggcttggtgtgcgtacggtgggggtgggtgctaagggncggggnntgncggngaaggtacgacagtcatcatcgccatggggggggggggggggggggaagggagaaatatttattctntcgccaataagggaggaaaatactatttataacctccaccaacgcgaggntaaagtaatagt

SEQ ID NO: 3947 - DNA, 793 bp, Oryza sativa
  unsure (1)..(793): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccaaagtcttaagcgagaatcagaacctgaagagagaggataacaatcattaatgcatactgcatacaggcataacaagaagatagccataggcaataattcctttcaagcaatagcaatcgaatgctcatagaaatagcaattaaattcaatcaacctgagctaagaaggtacatcccatctgtagttgttcttaatcccgtaacagcaccataatgcgccgttgcacgattttgactagaagacaaaccagggtgcaatctctgttggatatgtccatgtccagggatttgacttttgtgcaatttgtgtgactgtttcttactcttgcctgtcctctgctgtgcagagtaaatctttgaagaagatgaaggttgtaaagagttcaaaggatcctagtcaaaattaaaaatgaatacattgatcatttgcacaactagatcaatgagtttgcgcgtcatttctagggcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3948 - DNA, 2219 bp, Oryza sativa
  unsure (1)..(2219): unsure at all n locations
gatgtacnggatangatctcccactctcggcgaattcgagcctcgtaccctttacttccaaactattttaacttttttcttcaaacttctaacttttccgttacatcgaactttcctacacacataaacttctaacttttccatcacatcgttctaatttcttcaaactttcaattttggcgtggaactaaataaaagctaaggtaaactaataagttttaaaacaggatcaaaactaatagaccatggctgtgtttaggccgactttagttccaaaatttttcttcaaacctccaacttttccatcacatcaaaactttcctacacacgtaaacttccaacttttccatcacatcgttccaatttcaacgaaacttccaaatttggcgtgaactaaacacacccttagatccacgctaatattggaagcctgaagaaattggaacgatgtgacgaaaaagttgaaagtttgaagaaaaaacttttccgtcacatcgaactttcctacacacacaaacttttaacttttccgtaacattggccgagtttagttcccaactttttcttcaaactttcaacttttccatcacatcaaaactttcctacacacataaacttcaacttttttcttcaaacttccaattttagtcaaacttccattttggcgtggaactaaacatagcctatgtttcgtgaaaaccttaggtcacatacactaggaaccctatccatgtcccagatctggccgccaccctctgcctgctcgagtccatcgccacttcaacgactcaggccacgccggtgcggcatcccgtcctccgtcccatgtttccactctcctcatctcatcctccccgctgcttccttgccaccgtcgtctacaccggggtaccgcgccgcgccatgcgaccgtcggcactatagatagccataaggttcgaagcccgacggcccggtccatggcacgatattttggcccgacccaagcatggcacggcccgacgggggtcgggcccatgccggccctgcttggccactaggccatgcttggcccccccccaccggcacgttgggccagcacggcacgatgggtcgacaggccaagcccaacacacaaagcatagggagcaaaaatagacatattatatgccacggtccaaagaatagggatgtaaaatagacttatttttgctatatatatgtcagcccaaagagaagggagggaaaatagacttattttagctatatatatatatatgtcacagcccaaagagaagggagaaaaaaatagaattattttaaaaaaggcacgatgggccacccgtgccttcgggccgacctggcatagcccgactgctggtgggccgtgcttgggccggtggtgcagcccatgggccggcacggcatggctcggtgtgttggtcgggccatgccatgcctgggccgtgccgcttgtttggctaactatagtcgccacccccaagcagcaccaccgctcagctgttgtcacggtgtcacctactccaacacatttacgcaaagattttcgttatcgggattgctatatggcattcaaatgaaatttggggatgaaatcttacagattttagaccattggatccatgccaagattcgtgcatcggcttctctccaactccgacaggctccccttcttctccggcgccagcgacaccccgactccagagggttagggtttggagtgagggtaggaggggggatgggggagggggaagagggggtttcctcggggcttagagggatggccgtgggcggcagaagaccggcggtgggctgtggactccggcgagcggcggaggaccggccgtgggcggtggactccggcgggcggcgaggaggcggcggcggcgcccaagccgcggggatggaggagggcagtgggccggtgttggcggtgggggtaaagcaagggtgggattaggtggcggatccggcggcggggagccgccgaagacggggaagaccgtgggacggggacaccttatcgtcgccgccatgaggagaaagtgaggggggaaggggagggggaagggggaagtctctttttctttatcccccccgcccttctttagatccagttctatttcttccgtcccctcgactgtagtaattctacccatatcttcatttcaccttttttattatatctccttctttttccttctcttgccgccatgcct

SEQ ID NO: 3949 - DNA, 16012 bp, Oryza sativa
  unsure (1)..(16012): unsure at all n locations
ggggagggggaagggaaaggagaagaaagnggaggaaaagggaaaagagagagaggaaggaaagaagggggaaggagganagaagagaaaaagaggaaagaaggaagagggagggaagagaagaagagaaggaggagggagaaaaggggagaaggagaaaagaaaagaaaagaagaagggagaagagaaggaaaagagaaaggaaaaagaagaggaagagggagggggctcgccggggggccctccccggcgccgttgaccttttccggccagccgacaaggcagncggcggcgcggtgggccggtgccagtggtgacgacggcggatcgcgcgtgggacgggagaagaagggtggcggcgtgatctagaaaccgggggaggaggaggaggagtgagggttaaggggctgcatgaatcttaaagcacatccaatggtttaaaatttgaatgataggaggtgagattttccgtcacatgatatatagacagccccgttagttattgttgacgctaaagtacgattttcatcgggtccatctatatatatgacgccacaaaatttagtctcggattggacttcacactgattaccgccatttcaaacacaaagttgaccattaacgagccgtggcaatatagcaaataagtaacttgattataatacacaatataaattaaattaagatagaaaactagcgatcacaaaatttacacttaagtgcagtgtaattttaatataaattacaatgtaagtaaggtgtaagtgcagtgtaattatagtattaaacacaatttctcaccataacttttcttatgggactatctatatacatggcaccgtattttttatcgatatgtatttacattataagtccctaaaatttacatatataattttaatatattttcactgtaagtttcaaaattacatatgtaagtcctaaaattatatatgtaattagtatgtaattacaatgtaagtggcatgtaagttactatagtgtaatttttattaattataattactttgagtaaagaacgagtaccatctttgtgctcagttggtcaaaagccttttgctgtaacttatcgatcgtgttttctcttggagagcactcgcacgaatcttgaaacatatcctagggtctaaaaattgactatttttttacacaaaaagtggcgccatatttctagcaactctgtgtacattagtgtttagccatgtattgttgttgccgatggctaaatgaaatcattattgctgcatgttctataataattgacgttttggacaaggttaaggtcaaacttttataattttaaccatcaataacttttaaaatatttagtttacataaactagaataagatacactataataaaaataaacatgcatttatttattatatatattataatagaaaaataagatcaaaggtatattttgtaaaccgtgtcattgtctaaaatatcaattaaaatgaaactggagggagtatagcattggtatgcttcttgctgctttctatcttccgtatagcattgatgttgctgataattttcggggatgggcacccagcgggtgcttcttacccaagtggggacgggacgaggagaaatcttccccgtgtgcagggatggggatggtgacggaatatttttctcactctggggatggggtagtagaacccgacgggtgcagcctcgttgccatccctagatctgtgtgttttcatgggccaactgtccttcggacatgggcctacagttgatgggttaacatgcaagcaatatgggccaacggaagtttgttggctggcctacataggctaaaagaatatgcctgttagtttttaatgtgtgtcctgtgctatgattgtacaacggtgactatctgggatgttaaaattgaaagtttaaattatggtgatttcttatgaaattcaaagttaatacttatggatcttacattgtactttaaaacttataatggaattttgaaattacactgtgaacttatcaaattcacagtgtaatatcttgtaagttatagtgtaatttataaaactagtaatttgtctgtgctaacactaccgtaatatttgataatgcatataaataaactaaagagatcatatattatcgcaatcaagcatataattagataaatttaaaatgcatgtaaaaaaatcgttcccatgggcggcaaatcctgaatattgacgaagtcaccacaggtgcctcgctgttgacgggtacatcgcctatcactgaaagcacaataccgttaaaacctaaaaaaatcgtttccatgggaagtcaaacccaagaactaaggtgctactgagactcttgtaaccattacttattttttattttgttattaaatacatagccacacgatatcatcacaacttctatatgttcggatccatctaattcttgggctaaaaaatttttataactacatgaacataatttgtccatgatgcacagcataactaatctttggaaaccagcatccaatcagcaccttagaagcttgtcggattgcctgggtcatcatcctcgtggagttggggtggtgatcttgtgatggctggtagtgggaaggtggctgctgccccttgccaaagtagttctggtaccccggaagaggctggctcgactggacacggctgtgagtaatcttcattccacagcaacaacccaaaatatatcagggaataatatctgtacccagttgctgtggaatcataatttcttttacaccagttgtaacatctaagcaaaatgttggtgtatttgccgctcactgccagggcagggatatcaagtggagctagcagagcatataatggctgtgccaggagacactcacgctgctcaaaatccaatcggggaggacactgcatacagggatacctgagtcaataaatgatgcatatttgacatgaatttaacttcaaacttgataatccaactattatcaagcatcacgttgaaagtatcatgcataagcatgcaaaattatacctaaatctgaccaatttgtcatatagcttgcagagttgttacatgaagcgtggtaccttgctatcaaagaaggatctagatgtatattaaaggtggacctcacatagtttggtcaactttaattgtctgagttcaataaagttttcattaactaaaaaagtcaggtcaacttgataatatggctatgacagagcatattgatacttaaatctatactattatgacaagcagtttgatgatcttaatgccgatgacggtctgaaaacctcaaggctagcatataaatgaagcatatccagggccggccctggccctatgcagccgaggcgacggccggggacccataatggtgaggggccaacacctaatactagtaatctagtacgtcatccgatattgagatcaatgatttttatttagaattaaaggtgttgcaagtgagtttgctagattcttcaatgtccgcacctgagattctgaagtttgttatggatgcagatttctattcaaatgtttcagttgcctatcgaattctcttaaccgtacctgtgacggtagcttcagctgaaagaagtttctcaaaattgaagttgttgaagaactatttgagatcaactatgtcgcaagaaatgttaaatggcttggctatgtactcaatcgagaatgatatcttggacaatattgatcttaataccattcttgatgattttacatcaagaaatgtcagaagaagtatcttttcataggaagcaatggaatagggttctattcttcattaagttaatgaataatgatattagttccaagttacaaatatattgttattttggtcgactttatttcttgataattaccaagcatattaaatttaatatatggatgtacttgtttccgttttgtaagtaaaattagcgtatatatatatcaataaattttatatatagcttagagggcccatcacgatgagttcgcctagggccctcaaaatcataggactggccctgagcacatctgttcatattaagattgagtttggaagaaaaggagcctatttagccatcttatcacatgagctgatattttagcaggataaatcaagtataacactcagtacctacatgataatgaatgccttacattgagagcgaatcaactcaaaagaaaatgaaccacattaacaatgagaaaccatcaaaaattgaagagattgcattggaataaaatcaatggtctggtctgagataaaaattaaagcaaaataggcaagaggtaagaatgcaatagggtagtcattggattttgactctttctttcaataaaattctgttttccatatagattttttctgtctctagatgtttactcttgattttagtaaattctattggcagtgtaatcaaccaattctagaattgaacagaaagtcaagataaatattaccttagagacacacccttactcccacaaaatctcagaaaataagatagtatgtagttgaaacacacaacgtagctgatacaaatggaaattagagatccaagatctacaggttaagaagtgcgctctgaatactgatgaagctatgactgcataaacatcccctgagaaacctgaatatcttttgcagatcatgatgcttactttgtcagttgtcacctttaaatcttcttagatcttctattatgctttgcagtctacaataagattgatagatcccaaagtatttataagcaggaagacaaaccccagtatctaaatgacaccaaaatgttagtatatcaaagaggtatacaataaaatgatatgattggtgaaatgatccatttcttatgacatgattaataatacacaatatggatgccattccatgaaagattggaagtgagaaagcacctggaaagagaaaccaaatcatgagaactcttagttccatagatgcatggctgtaccttcctaatagtttttttttgcatggttcttaataggatttgaacaattgaaaaaagccatgcttgtgtaacaggaaacgtaaatacggtatgaaccccacaatagatacaaagaaagaatctgtacaacgccacttctgaacttcttttaagatacaaacgaaaatataaattcagtacaaacctagtaatagatcacatgttagctcttgcaaagtaaaagtttacaattgttagtatcttataacaattggttagcttccagagaccacctcgggttgctgagtttcttataacaacctgtcatggccgtccaaccggagctaaatacggaggagtaccctccccagaaattggcttaggaatatatactaacgtggaggaatacccgtactaagttgtcaccatcagcggcccacctctactgtcctgcagcatatatgcccaattaatgatatctaataatctaagcaccatgcttacattatcaaatattactctatatcctctagaataacatagatcaatcatttccatgaacattaaacccacaccactgcacctctctggtaggctagtcatacaactatgtcggcacaaatataaagtaaatccagtactcagacagagtaaagtaccgaaggtatataaagaagaatattctattaattccgagagtcttacgaaagaagaaagaaaagctactagagccatactgaaatcttctgaatactcgaggacttcgagaactatcctattctactccacttagcactagagcattaactaaacttgagagagagagagagagagagagagagagagagatatcaaagcttcttgcttgagtgtgtgttggaatgaagaaagtgacccctttatatagcctcccaatgatggttatggcagttggaattgtcagaaatgccctgcaaccgtcattaggagtgcatctggagcgtccatgtggagggctgagctgagccggtgctaccagggttcgaccgaacctgggccggcccagcaggcctctagatttggtcagggggttgacagatgggtcctcatggcagttgtggcagttatgacggtttccaggacggttacacctgacatgtgggcccttgtattcttaagcttgcttaggagtgaagttttcattaatttcttctttattcatgtgctaatctctgcaaacaaataatactccaagtacaagtggaaatatattattctaaaataaatatgtattgcaagcatagctagttctcctttattttagttatattgacggtcaaaattggtctgtaacgaccgtcaacatctactccagaaacaagagtgtacggcgtggatttggtagctggacatgccaaagtccaagttgacatggtcaaagacaattgctgaattggcaactaccaatcccaccaaaggacgagatacttacactcgctcatgcacgtggaatgtttatccaatggccaaaagacctcatcaccacaaagattattccaaggtcaaatgttgcagcaggcccaactcatctagctcggtcagctaaagctcatgcacctcagatggccattgaagctccttttgggtcccacgtcttggattttggtggaatggccatagatcgtcctccttcaaagaaaagaaaaggccaattcatctccaccgatggtgtctagcaggccaaatcatggaaggggaaaattgaaaggaaaaggaaaggtaggagggtcgtccttacctcccaaacggctagatctagataaggaggtgtacgttgctctcaagatcctagatcacgacacattctggccagggatgccgttggatcaagacaatgaattagccagaatgggcactattactcgagagctgcgtcggtactacgtggataaattgaactccaagaggaagaatagtgatatgtccatactgggtcatcatgaccaagcgcccttcctggggccacccagttatatcatagtgggcttctctgatcttttcaacctctttaggctacgagcggtggacaccgatctcccaaagtgctactcattgtaagtactaataacactaaacttagctaataacaatccatgtagaatgcttctagccatacagatcaaccttgaaggttatgttggatggaagcacggaagaccagaagtcaagttagattcctagatccacgtcaagtcaatgagacacaacttaagtcttgattggatgatgtggtcggttacatcatgaacaacttgagggcccactaggacaaaggcttcatcatattagcacacaatcaatagtgagtatgctaaataattaataatcccttctttctataaagctaatgcccactaaacacctaaagctcaacatgcaagcatagtatttattagcactcctaaaacctacatgtaagcatgccagatcaacccattaagcacacaaagctcaacatgcaagcgtatacttcctccgttttacattataagactttctagcattgcccacattcatatatatgttaatgaatctagacatatatatgtgcctagattcattaacatctatatgaatgtggacaatgctaaaaagtcttagaggctgtttggttggtgccctaagtatcatgcctgaggaatttgtgtgcctgaaaggcataggagaagttgatgaaacttgcctggccaggcagcctgacattttgcttgtttggttgtggacagttgtctgagaggaaaaagaatctacagtttagatgggtattgctaagtgctaactgtaacaaatcaatttattgcctaataatttttgccggcttcacgtacgtaaagaagaggaaaaaaaagaaaaaacataaatgcccaaacctacaacgatttcttcaagactccaactgcgtgtaaagtgcttcaattgtttcggcagatcagcgacagttgctgctgcgtgtgggagatcagatgggtcgcagatggaaccgacgaattgagatacttcaccgcagatttgtgtgacgccggatctggcaagctagtggtggcttcccacggcggaggcaaggttactgcatgcgcgcgacggcggcggcggtggaagaggcaagcttttcactgcatgcgcgtaatggcggtggcggaggaagaggcaagcttttcatgtgcatgcgacaacgatggcgggtgaggacatcgggcccagcggcggcggagtcttgcgtgacggtagcgatggcttgcccggaggacggaggaaaattatacgacggtaatctcgctagctgctgtgcctggagctcacgcgaccgaaataagtcgcctgactcaggctaatcacgcgcggagatatgcattaggccaggcgaggggaaaacagtctcaggccagcaaccaaataggaccaaaaccgtgtcaggctagttctcctcaggatagcaaccaaacagccccttataacctgaaacggaggcagtaataattatttatatatataatttatttcattctaaaactagacatacacatgctaaatcatcattctcaaatcattttcgtaatatttcaatccaaatcatttcatcgtttctccaatatctaacatatatcccacaacaaagcgcggggcatcatctagttacatctaaaagtgtggtttttaacttacactatattaactttgcgggttccattggattctattgtgcatagtgccaaaatggagtaggttttactatcttaactgccgcataagcgacaaatatgactttaacgctctcaaagaggcattgaacacagcatgggactaatacgtgcaaaaatgggcatgcatcaagaaggaaaaatccaacctctatcaccatgacgacttcaaatgcaagcaacaatccagcgagacctgtggtttccacgtgtgccataccatgaaggtcctcacaggacaggtgactgcgctagatcccgaggtttgtggtatattgatttgggaaaacaaattagtacgttggtatggttgcacctaggatctgtactaacttaacgcctctctttcaggaggttgttgttggcggctgttaaatgccgactctataccgccaacatctgcataaagtttggataataaaacatccaacatagtgataggtgtttcatctcaaatattacacaagtgttggtatatatttgtatgcagataataaaccccagtgttgggaggaaaatcagactcgagtgaggagaattatgtatccatacaaggagggattgtgaacttcatcgaaacattagtaaatcaacccaaaactccgagaaatggatagaggacgtctcagggagtccaccgaccgaaggccaggccaagagggcccagcccaggttcggccgaacccccctgatcaccgttgatcctggggtttggcgtggacgctccagatgttctcccaatgacggttgcagggcagttcggacattttcccttctcacaaccgtcataactgccctataaaaggacctcacttcattcactctcacacacacttccaagcttgagctgaattacaagatgctctattgtcctatattgtatactagaataggaaaagtgtagagtagaaggagtcggaagaattccggagttgtcggtaatcttctcctatttttttttctatttattactctgaattcaatataatattcttcttgagtaatttagatttatcttgtgagaattatctcttggttagttcgtaaatagcatacgggattattgttcactataattaattaaaatatagtgattgctttggtgagttataaacactaaagtagatattaattgcttagacgtggtgtttaggtaattgttatccagtaattgttgcgtatcccacagtgtgttgaggtaggtgtagaggtggtgacagccctcgagattagttaagtcctccctgtccgggtacgtagtagagcgacatctgggaacagcgggttgcctgtgcctgaagtattgcgttaggattaaagttaagctttccctagacactgtttctcactagtaaatcctctctatcctggcctatcatttggttggtgtccttggatgaaccggaggaagatttgaccacacacgttcttggattcgatacccttgaaatactccgtaggggaagtgctacatcggtatatccgtacgcttgcggattttatctgtgaccgtattaaataccaacagttgttacaaacattctagagcataatttcgaggatattagaaatgaattggctgccttcatcctagcaaaaattgtctctccaaagggcagtttttgtgcaaagtagtagctgaattatcataggatagctacacgtatatgtgttaaatggatgattaagtgacattctctattggaaaacgatttttcttggcttctgtttatatgtatgtacattggtaatattcatattaactaatatattcatcacttggttaatttaaattataactgcattcacatgttgtgattgatggttctcatttgaagatgcttcggtgattttgtaaggtaagaaatcaaaggtattggtcgttgagagaattgaaaaaattgaggtaatccaactattgagacttgcatgcatctgaggttttgaatttatgtgttgtggtcgtttctgaatcttatttttgtatgtgaatgtcaaatatatgggactatgggggaagttatgtgttgcaggaatactgcgaattttatagcgggcgtggctagcatttgaggctagccaataaaaccgatttgtttttttaatgaaaagcctcatcggtgtcgggtcgcaacaaacacctgtaactgatgacatacatctttgtcggttctaaactccaccccgtcaccgatgatcatgcataatgggcactgaaacaccctgtcagaggtgaacctgtgatttttaagtttatttgaaattagtaaaatccaattttgtaatttattttatatttttcagatatttaactaatcatgtattgtgttccagatggacttatatttcaatattatttatttttaattgtaatttcagttatttctatattatatattcctacttaaattcacattaaaatataattttgcaattatttttattttaaattttaattaatatcgtgttgtcttcttggtagacacttctttcagttttcgttattccaaatttaagttatttctaaattatatttctagctaaaagcatacttttccctttgattaatgtaggaattactagactttataatgaacgtggtggttttttttgagatgtttttattttcaaactagtaaaacaattacttaggttttggatcgttttgataagttctcataatttttgtatgctcagtaatttttatttcttcgtagtactttcaatttgtttacttttctgattttccctaattttatcactattttccaatattaaagtttttttctctgattttcagcttcttttttcattcttatctaattaaagattttcatttcaaacttttatttcagatttggactttttttctgcaactactaccggttacctcatggccttaggcttacaacctctgactttatgctctttcagatttatatgttgaagtattgattagcttatactggtaaggagtggatggtcatccttatatatgtgtgaacgagaatccatatatttgctccatctataattggtattctaacgcagatcaggcaaataatagttggatgagaatcctcgacaataatattactgtcattacagtcactggtatatgagtctcacccttctatcatccacatgttatgacaatcactagtatatgagtctcactcttctatcattcacatgttatgacagtcactggtatataagtctcactcttctaccattcacacgttatgacaaggacatgttcacatcccgaaacttgcccaaaatggctaaattgaaaatccaagaaggtgcgccggctttgctctaatcaccacttgcccccgcagccatcggcaagcgccggccgatacgcattcgacggccgaaaagaaaacccaaaaaagaaagaaacgcgcacgcgaggggaaatcgccaaccgctgcctcgatccgttcgaaaccaccccctcccgctcgcgagatatatatatatatatatattccccaactcattccctaacttaccacactctctcgatctctctctcactcgatctctctccttgctccccaccgcgccgcctttgcgatttatttccatcaccatcaccatctccatggccggcgagcaccgtttctacgactccaatggagatgtgagccgctacatgctcgacgacatggagtttcttcccttgttcggtgaggcagaagcggctaccacattgcccctgcccgtcctccccgacgtcgagccgcttcctacggcgccggcgccggcggcgacggctcacgtcgagcccgctccggcggcggatttcggtctcgggaacccggtgcttgcagatctcggcttcgatgtcgatctcgacttctttcccgagttgaattttcagtctccgccgccgccgccggcgatgaatgccggtggatacactcatcaggttcaggcgtcgccgccggtgatgcatcaccagcaacagcaacagcaaccgctggctccgttgccggcggcgcacggcttcgccggccagccggcgccggcgacgacgatggcgccctcaggcggtgacgacggtttgttcttggccgccccatcacgggacgctccatgctcccccgtgatgttcaatttcatggacttcaacgtcgacatgggcgacgtcgacatggatgatgtcctgatgtgggctgaccaagacacacacggcgccgccgccggcggcgacactgctccgcccgtcgtcgtcgatgagtacgccgacttcgtcccatttcaggccggagatctggactgctccaactgccaccttgtcagggagatgatgcatgcaaacggtaaataagttctatcaatatttcatatgctttcatgtgtttaattatgtgcagattaatacgcatcaaaatgagaattacttggcaatgtcgactgtgattattgctttgataatgaattatgaatagatgtccggcgtgtgattttgtgaaattgttgccctttgtgccgcgcagctagccggacaatatacttcttggttcatgcaaccggggttggatcatttcaacatgcgattgtggatcgcagatacactgctactggtgctgaaggactacacttccccgggagacaactgctatacttcgagtaagggatcgactcaaattaaattaactttgttttgttgtatccaatgttttttccccaacaccggctgttcataaaattcccaacaatcacacgctgttaccgagaaaacagattataatcccttgaggagatgtacgtctctcctcgtgtaccttttttttttcaaattcaatacaaatagtgtaaaaaaaattgacaatagtgagtataatgacgtctatcactccaaaaatcacgttcatgtttgtcctgcacagtaaataaaagataaattcatcatatgaatagtactttttttatatattttttagttaatagaagtggtttatatctcccggtctctaccaactcggatacaacaaataaattttagtattgagaaagaaaaagaaaaaaatatagagtgatgggacaagtccccaactcctctaaaacgataaccatttgaattaaaagctaagacaaatcacacaaattccagtaagtaattctataggtacaaagacatataaaacagaacaaaataccatttggctactaattccaactgcagtatatataactacgcatagtttcctacttctaataccaagtgtagagctggttcacataaagataacctactctataggattagcgaaattttattacaaaaagatttaccatttgggcaacgccaaattgaacaacatagtgcattggctcagatcataattttttttttggacttgggtatcttgacaagccaattttcaaatatattttgagcactatgaggagtgggaatattggatgcaaagaaaacactttgtcaaacaaatcgtgctatgtgactttcaaaaagaagacgttgaattgtctcttgtgcatgaaaaacaacattgcttatcccccctcccccaattatttttaaaaatgttatattgttaggattaccttcttgtgaaaccatataaatactttgattgtttttcaccttcacctccattcgttgttgcattgtttttttttatatcttagtgtgagtggagtttgcatgatgttgtgtacttgtatatatatatgttggatgaatattgtcgaaatttttgagactttttctcatatctttttggatggatttaaacaagcgaggagacaacctctcaagggatcagaacagtttctatatcgtaattttctttttcaaatgttttcagccttaccaatcataccattgagtccgcgagcgacttcatcgcaagcaacgttgagaagctgaaaaatgatacgactgggcatcattttctggacactggctacaacttctccggagcggtccgcaccgacatggccaacagtcacacggcgatggaaatgaacatgctccatacgatcgtgtcagccccatttgagaacggtaaatgatcgagccgtcgtcaaattttcgatactgaaacagtggagcgagtgataaggcatggatgttttcatttgaaccattttaatttgtacattgtgtattaattcatacaaattgatattatgtgcgcagtaactacagatgcagcgtccccgccggcggcacagttcatcggagctcctccagcagcagagcttccagcgccggtgccggcgccggcgccgccagcagcccatgagcagaatgctgttgttgctaccttactgttcaaagttgaagaattctatgccgctgcaaacagtcgtccagcagcgaaaagggcagacgtgaagatactggaatcatctcaagtgacccagcaagctggaggtagctctgctgctactgctaccatgtacccgagcatggtagacaggaagaggaagagggcgcaggcgacgccatcaagaatggctccacacgaggtgatacagtatctgcgcgccacagcggtggaaactgacaaggaactggagactctgaacaatttcttcaaggtttgtgatggggaagacaaagctctaataaccttctcggtggagcaggtatgcatgtgcatggaaaacgatcatctacatgcctctagttgttgagtattacctccgtcccaaaataagtgcagctatagatatccgtgcttagcgctttgaccatccgtcttatttgaaaaatttatgaaaagtattaaaaaaattagtcacacataaaatactattcatgttttatcatctaataataataaaaatactaatcataatctttttcaaaataagacgaacggtcaaacgttgaacatgaacagtgctaaaattgcacttattttgggacggagggagtagtaatatatgttgtacatagttcattgcatataaaatgaagttgatttcattttatgtgatattaatttggttctttaacctgtcacagataagaagtataaagaagaagatagggaggatcatcaacaaaccggtcactgcaatgtcaagtaggcggatggcgagatttattgatgaaattgatactatcaaagaagagaaggcaagagtgtttgaagaaattataaaaatcttgaaaaatcctaggaggaagagagagaatgatggatcttctggcagcaataggaaaannnnnnnnnnnnnnnnnnnnnnnnnnnnnnnnnnnnnnnnnnnnnnnnnnnnnnnnnnnnnngacgtggggtccatcaatnggcccaca

SEQ ID NO: 3950 - DNA, 7596 bp, Oryza sativa
  unsure (1)..(7596): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtagcgttgtcattatgaatcttcatatgttgttattgcgttgtaacaatttgtaattcaatccgaactggatgtagtacttatatgacatatcatttttatatatagcaaatttattgtccttcagtgtggaatgatttatattagtttgcatctctaaatcaatatgaattctactgtacttgccctgtgtattttaccaccttcacactggaaaatactactgcacaaattaacccatagtttggtacttccaccatttttaaatataagaagcagttggcttttggacacattgtcttatcattcatcttttatttgtcttattacaaaatatagtacacatataagttataacaaaataaatgatatttgcactatcttttaataagttgtaaggccagacgtacgtacaaaagccggtcatatactctaaacataggtagtacttgttttacgattaaactgtgtattaaactaacaggaattacttgttttacgattaaactgcattaaaataacaggaatacgcataaaagtgaaaacaaatatttaaaacacacactcaattaaatcaaaacatggtctcttcaaacaggactataaaggatacagaatgtgttaattaaagaggtgagatataaaagtcacgagaaaacatcagtgggtaaccacggactgagccaaattttcatcacaaagaggtgagatatatatgtaataaacatgtaaatacatatatactttgacgattaattcctttggatatatatttataatatatattacatttcttgtaaataagaatatagcttagttattggaaaattgacactgcagtatcaatttgttgtaattaataatattagtgtaaaactatgttcaattcttatacgtgcgtaccatatatgcattactgatgggtgttaaagccccatcgcacagatttatggttttcaacttacaagggtatatttatttttgtatgaaatctatctatctattatatatttcctaaaacgctcttcctacaaactctcgtaagctgcctcgtggtgctctaataaagtagagtaaaatccaaacaattctaaagaaataaaaatatctaaccatcgattttactttaaatacggtgaaatcactattttctaccgttgggtgcacctctatacctaattaaaaaaatatgtaaggccttcggacaaatttttgtccatccacctccccatcacgcatggcctccgtttccgcctctctccctgtctcgatcccgtatgtctttgcttccgcctccctctctccctcccacgtgcctccgctttcgcctccctccctccctccctctcaacgcctcccatctttgcctcgtgatccccctctccccgtagcccctctcctccctggcacctctcctcccagcacccctcttctcctctgtgttccctccctcttgcgcgctcaagtaaaacggaaccccctcgtccaggaacacgttttgacatgctcactcgaccgtgttcaccactagagctcgttgttgccgtttctctttctgtggggaccacatcgtcgctggttgtgttcccgctgttttgattttctttataaccaaccgccaccatctatggacaagtcacatcgtggtacatgtccgaccaccttcctcaccgtcatatgatcaccagagcaccaacgcccatattccctcttttttgtttcttgcttcggctagggaagatgatgaatagtgttggttgtttttattcatcttcgttctttctacgcattcaaggaaaatggaacccctcgtctgggaacatgttttaacacactcatctgctcgtgttcaccaccagagctcgccaatgccatttctctctctatcagggccacgtcgttgccggccatgttcctgttgttctggttttcttcgttgcccgagcaccgatgcccatctttattatgatgagaatatgagtatatcaatatgcaatactggttttcatccatcctaattatcatttaaatttgtgatcaatacttagcataataaaaaatttatttgtcttttacccgtaacaaagcacgggtattttgctagttaataaaaagagttaaaaaaaaaggatccacacgggccgtccgtgtcgtgcacgtgcaccagcacacgtacgtacgccatacctcctccctcattctatattagatagaaaacatattttgtgataataaattccgaacaattatatgctctaaatcatatagctaatattttatccacatacattattagattatccaaactaactatatatttaataagtaaaagagataaaaacacatttataggtaaaatcatatagatattttaatgatctatttaaaaacacaaagcttttaatagaacaatatgcaacacataaaattaatgttataaatacacataaaatttataaataatattatgataatacacaatttgattagaaaatagatatttaacaagtataaaacaaatacattactttgggtcattattatatttataaatcaaactgttgaaaccattggatctatctcaaaggaaacataactccccccccctcttgtcgtatgacatgtgtacgtttctcggaagcaagatctaggatatgtatatctactctctctttattgattcatatgtaaatatatataacaaattgcatcaatgtgaaccaattaaaaagagggctagcttgatggtacattattagcaataatagttttccaagatttgttcaaaaaagagccccaaaacattcaattaaaaaagaaaaaacaccttagttttaatttaaacttaatttgttagacatgtttcctaaacaaactattctacctcctttttaaatgatgaagaaaaaaatagcttatatagatgaattaaatattagatagtatatgggtgaaaaatactcctatgtaagaaaagttatttaagaaaagatgacaaataaatttatgaagaaaacatacttctaaagtttggcaagtgctatatggttggggaatatatactatgtacacaagcttcctgtgcacactccgtacacatcaactagcaaatgtcacaaattttttttaaaaaaattggacacatacttccaatagtattacacctacctgtgaaatcttatctttaaattcattatattttagtcataaagaaaaagacaaaattctaacagatttttacccttaaatctgtcaatttttttcacttttttgttatcgctaaaatataatgaatttgaatatgagactttatagatacatgtaatactattaggagtaaatgtctatagttggtgtgcactgattgtgcacgggaagcttttgttcatataggatatggtcccatatggttgatattcaattgttagaagtttctcaaatgcagactataatatacatgccctgcgtgggctatcatccttgttaatataggttatgtgttcccagaaaggccaccttgaactcttatacatacatgccgtaggaaagaaatataaaagagtgaatttaattcactgagtgaatcatctatataactattctcagatacagacaaagtagggcacatgcaatggaaagaccaaaagaagccagtaaatttcactgagtgaatcatcatcaacatatataaatactcttgcatacatacaaaataggacacgtgcaatgaaacatatgcaacgacgaaaacgaaagaaaacggcgaaggagaaaaagacaagcacacactttctacgcgatgacaagattggcaatccccacgagagcagcagtccacaccacaccggccgcgcctgcaacggccaccgcattggtggtggcgctgtcatctgaatcttctcctccagctccggccgtcggcgcggtggccgcgacctcattcttgggcatggcgccgcccttcttgtgctccttattggcgcccttcccggcggcggacgcgggcgcggcggccggcgcgggagccttggccttcccgaacatctgctccggcaggagcacgccgtcgacggagtagacggcgagcgggaagtctgcggagagcgtggtgccgagggggacggcggcgacgccggtggacacgttgacgaggctctgccccgtggtggtggtgacgttgacggtgtacacgccggcggggcccgtggcctgcgtgcgcagcgggttgctggccgtctggaacgtggcgagggtgtagtagcgcgggaggacgtggtagagcaccagctgcacctgctcctggtcgctcaggccgttgagcgtgcccggcctcagcgcggcgaaggcggcgtccgtcggcgcgaaaaaggtgaggccgtcgtaggtggtcttcagctggctgcccagctgctcgccaacgcgggtggcgttgagaaggcggagcagcgtgttgtactgcccgcccttctcaagaatgcccgtgaggttgatcgtctgcgccgcaggtggcgccggcgcaggggcgacgtccgcggcggcgacgtccccggcggcgaggaaagggaggaggaggatgagggtggtgtgagaggccattggcactgtcactgcgctattgaatggtgagggtgtagaaggtgtagtgggctagctagggtggagtgtgaggtaggagaggtttgcatatgcacatattgcatgtgagtgggaatttttgttttgtacgtgttgttgtggcaaggaacgtgaaggtggggatggagagagaagtgtgagatgcatagtgacatgacattgtgagctggtggatgggtgtgggtgctttggagtgaagcgggttaatgttgggcagagagaggttaaaaaaaagctgtaagcttattacttagagccaacttaggctgcgttagttagttaggttcccaacgcatatccctcatttttaacacgcacacttttcaaattgctaaacagtgtgtttttttataaaaaatttctatacgaaagttaattaaaaaaatcatattgatctatttttttaaaaaaacaattagctaattcttaattaatcacgtattaatggactgctccgttttccgtgcgcaaggcattagttcccaacaaggagcaacatgaacacacagccttaaaataggatgtgacctatatatcttatgacaatgaggacaaatatttttttggacggatggagtcctctgtcttataatatataatatatgatccaaaattcaaactttatctcaaaatataagaaatcctatagtatatttattccattaattaattagtatttaatattttttaccatcttaccgtcgatcacccatctaccactactcacaccctatttaatgagagcatcatggtctttttcttctttcgtaatctctccaaaagaacctcgagtgatgttggatagtagagcttgaatgagtctaagctggtgatggtggggtgtaacttttggttggtttttcacacagtttcattatatataatcatggaccaaccactatagttaataaaaaatccttaatttttcatgtacaatctatgttactacttcgtatttcactactgttctgcacttctatacaaaattcttaattcatgcaattagcacaggtaggagtacttcacaattgttggctgttagctcatttgccaaccgttagttcagacagccctcacctgtgtcctcacctaggctacctacctagagcagagtaccctatgcaaaattgggaaatatataagcctatttctcgatgggaataaattgttcaatcgaaaggagatgagtctggtgccacgcgttctcctccgtctccccttctgctagtgctttctaccaggggtgaaaatagtcggaatcggcaggatctcttcaaaaacgacgatggatcggccgataattgaccatatttatcatttaagctactcagtgtcgacattaatacgacgcataaagaaattaaaaaaacaaaatttataaatagctataaacagtacggtaggaaatggtaccccttatacagaaacgatgctcggttgcatcgagagtttccgtgaccgttttcagtaccatctggctggcaccctagccttcgcctcatccagcaacacctccacatcgcaggcgcccgccacctgtgccacaaccgtgctaggccctcctcctgcgcctcggccatgcaagacactgccatcaccacatcatggtgaccgaggcctcctctcagcctcggccttggcctccatgccctcctccttgtcaccgttctcgtagtagtcatcatcattagagtcctattatgacagtgggtccttgtggttgtcccaccagtgggtccttgtggttgtccttctttggtggggacccattgtatcagcggttttgaagtcactgtgtccactttatcagtaggtgatttgcttacaatgatttgggagttcagtgatgcggggtggatgcgctcgatgtatcggctctattcaatccagtgcatcgagcctttttttggatcgcgtacgtctcaaaggtgccgattttaaaacctacaaaccggcatctattacacacatatagatacagggttttgaaaccggcaccgatgaccgaagtcatccgtgccgcctccatggtgccggttgggaaaaccggcacccaaggggattcccaactggtaccgatgtgcttttctggagttgtggtgatgtaaaaaatcaacaaacgtcatatataaaaatggagagtgtatataaaaaacgaatgtactaactgcgtactaagacatacttccttcgttttacgatgtaagactttttagcattactcaaattcatatagatgttaatgaaactagacatatataaaaaaacatatacattgatcaatagataaatctatgttagtccaaaaggtatatatatatgaaacggagggagttacatattgtagccacgtaaccacacacacacacacacacacacacacacatatatatatatatatatatatatatatatatatatatatatatatatatatatatatatatatatatatatatatatatatatatatatatatatatatatatatatatatatatatatatatatatatatatatatatatatatatatatatatatatatatatatatatatatatctctgtatatatacatatacatctttatgtctctctatttatatattcctataatctcccgcaccctgttattaacttggcgtaccttatctatttgttgtatatacctcttctctgcctgtttgtgttgctgagacacccgaattttctgtccctcc

SEQ ID NO: 3951 - DNA, 2937 bp, Oryza sativa
cgtgttttttgggaggaacatgagacatggaatagtacgagcttaagggtcacctcatgtatactacggcaggctttcccatcttttgaccctgtagggctaggttaccgttttgacggtaacctttcgtccgtacggggttacgtaatggtggcttaagttgagagtctcagacttgcgaaggttaacttcggtagattcgtacaaatatattagttaagggataaattgctttagtttcgaaccttcgtatggttagttctgtcagctccaaacatatttgcccaaagaaagatactctgttacattggacttgtttacctacgcgtttccatatgtggtatagatttctgtatgctcgtacgagccgtgcattagcacataattaagtatatatacatacatctatatcttgacttagatagtcggatgcacatatagatatatatatacatatgtgtatatatatacatatatatacatatacatatatacgcattcacacacacacacagatatatatatatatatatatatatatatatatatatatatatatatatatatatatatatatatgtatgtatgtatgtatgtatgtatgtatgtatgtatgtatgtgtgtgtgcgcgcgcgccgtcatgacatgcaagatactccgatatgcatgatatcgatcccctgttcgatgggtcggattgctgcatcgttcgtccggtttgtcatcaggtcgatcgagacggtcccctcgatcgtcggattcgacgtcacattcatacacggccggccggctagctggtgtggcagctggcccgtacgtacgtggcggcgtccagacaatgtgcaggtgatgaacgtacccctgctacatgtgaaatataacatccccacaccgagcagccggccaatcttacataagtttaattatattttctcttaggttattattatttcatcaggtttatgcaccgttttctgtggcgaaattacactttattttgcttataaaaaatgtttaggatgctccatggaagaggtgaccatttttttttaaaaaaaggatttcaaaagccgacaatatgaaaagttcaaaaataaaagcttacgtgtcctatagtaacatctcactaatttaaatttgtcttcatcttacgcataacattttatgtagtgaaaggcactgtgcattttttaaaataatctaaatcattgctaaaagattttaaaatatttatattttgaaacaaagatatttggacaaggaggatccacattactaccaccagggtcagatgacccgagtcatccgaccatataacaacatatcctcaacattttgtaggcagggacccggccaccaagctagctaattgaccccagtccgcttaaacgcacagcagctcatggggtaaaattttaaaacaactaggtgaaaccccacgcattgctgcgggaatttagtatgataacaataaaaaaaataacgtgtaagatagctagataatatcagcttaagtaaactaatgtggtttatgataatttaaatttaaatagtatgtagaatggtgatttaaacataaaaagtaaggtggtatgactttatggaagaagaaaagtagggagatagtttggaccgtagattaatcatctaaaggctaaaaacaatagatgtgatatgacttaattagagaaaaaaggagaaagataatttagaccatagattaatcatttaagcactaagtgaggataaactatataagtatataggatatcataaaacttaataaagatatacattgaaacattatgtgaattatgttggatgataatttaacatgtttgtatttgaaaagctcttaaattataaaaactataaagatatagtatgtttgcatgatgtttaattgtttaaatatgatgattgttagtggatgatgatgtggcatcttgttaattagtggatgatgatgtggcatcttgttagtggatgatgatgtggcatctttgcatgttaagcttaaggagttagtgagggataactttatagtaagataggatacaactctttcctttaaaacatgtactcccttcgtcccaaaaaaagtgaatctatgattggatgtgacatattctagtacaacgaatctagacagatgtactccctccgtcccataaaaaaccaacctagtactagatgtgacatatcctagtactacgaatctagacatatctatatccatattcattgtactagaatatatcatatctagttctagattcatttttttgagatggagggactatgtccagatttattgtattaggacgtgtcacatccagtactagtttggttttttatgggacagagagagtatatttcaataagtgacagtacgtaggtactcagcgtactccctccattaaaaaaaccaacatcgtactatacatcctaccattaaaaaaactaacatcgtactatacatcctagtacaataaatctgaacatagagtatgttcagattagagtatgttcagattcgtggtgctaggatatgagtacaaggttgtttttttttataagctgactgtttgtgataagactgtgccacacaataccatacgtatctctcaacaaatcctatgcacagaaatttcggtgaacaaaaccaaagttttggataatggttagtaaattatatatctacgttacattcaagtgaaaaataaatttgttcgtttacatctaattttcaaccatgagattaaccatgtactccctccgtcccataatataagggattttgagtttttgtttgtaacgtttgaccactcgtcttattcaaaattttttgaaattattatttttttttgacttactttattatggggatcctctagagtcgacctgcaggcagcagtgatagttatcatgaacgc

SEQ ID NO: 3952 - DNA, 1431 bp, Oryza sativa
  unsure (1)..(1431): unsure at all n locations
gcgtccattgatgtacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgagtgcatctcaaatctttgatattctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtgtaaccttattccacacattatgcccttgcgactggaggtaggcctccattcgtgccttccaaatgacaaaattgtgtccatcgaaaacaaatggtttcgcagagtatttttcctccatagctgcgttcgttgccatggttaggttacaacgaacttaaccgggctctgataccaattgaaagaccaagaacagctatagaggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctcttggacaaacacactccaaactaattctaatacaaaagccttttgggcaaacacactccaaactcacacagaaactctcttaccgagcatcttaaaatgattaccaaaaggagcaacctncacccttgcattcatctttctatttatagcctaagacccctaagacattgtctan

SEQ ID NO: 3953 - DNA, 14818 bp, Oryza sativa
  unsure (1)..(14818): unsure at all n locations
agagtaaaatttggtagccatcnactatagggcgatttcgagctcggtccccagctagcttgacttttccaccgagccatgctagtagcaaccagttcaatgcatgctcctccttgcacaagtacagtacgtgttcatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccctgagtctagtcccgatccgccggtgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacatgttgcaaaaggaactacataaggtcgttggccggagaaggtttctgctcatgctcgacgatgtatggaatgaagaaaagaagaagtgagaggaagacctaaagccactcctgtcttctgttggtggtggtgatggaagtgctatactagtgacagctcggagccaacaagtagcatctataatgggcaccctagaatcccataacctagcttgtctgagtgacgatgattcatgggaactattctcaaagaaagcattcaataaaggcgtacaacagcaagttgaattggtcaccgctggcaaacttattgtcaagaaatgtaaggggcttcctcttgctttgaagacaatgggtgatatgatgagttcaaagcaacaagtcaaggaatgggaaacaattgcaagaagcaatactggggacaatgacaggggtgaagatgatatactacctgtactaaaattgagctacagacacctaccacctgaaatgaagcaatgctttgccttttgttcagttttcccaaaggaccatgagatggacaaagaagtgttgatccaattgtggatggcaaatggtttcattcaggaagacgaaacaatgggtttggaacaaaagggggaatatgttttccgtaatttggtttggagatccttcctccaagacgtgaaacaggaaaggtttttttttccgtttgcaaaatgcatgatttgatgcatgatttagtaaaagatgtggcagatgatagtgtaatttcagaacagttaatcccacaggaagcatataccggacgttgcatatcagcaatgagtcaaacagtgggattgctcaaaacatcatcttgtctccgcactttgataactctgtggttaccagtacatattaataacttaagacagatgtcattaagagatattggtactgacttaagactgatgtcattaagagctttgggtactgtccgtatgcatgattgctcttttcatagccaggtcatcaatccaaagcatctacgatatcttgacctttctgggtctgacatggatgtgctgccaagttcaatatgcacgatgtataacttacaaacactaaggctgaaccgttgcaaaaaactgagatatttactggaaggtatgagaacaatgagcaagctcatccatctttatctttttagctgtccattgaagcggatgccaccaaatattagcctactgaaaaatcttcgcactctaacaacatttattttggacactgaaaaatcttcgcactctaacaacatttattttggacactgaacctggccatggaattgaggagctcaaagacttgaatcaccttgccaataggttggaattgtacaatttgagaaaaataaatagcaggaaaaatggaaaagatgccaatctccatctgaagcaagatctaagtgaactagtactttcttggggtagtagtaaattttgcatgcctttatgctaaacataaagggaaatgctgaacatagccatcattaaatcggacgtgatggctgcgttgctgaaattttgctcagccaactctcagaatttggaaatgctgaacatagcgattattacgttgctgccaaagaaggaggcctctacccttttgaaggattatagacctattagcctcattcacggctttgccaaattggcaacgaaggtcatcgctctgaggctcactccgagaatgggtgagctggtctctcgcactcagacatcgttcatcaaaggccaatctatccatgagaacttcattttcgttcaagggctgacaagataatttcatcgacagaggaaagcaatggttctccttaaacttgacatctcgaaggcctttgattcagtttcatggagcttccttttggatatgttaaaacacagaggttttgggaggagatggagaggttgggtgtcggctcttctcctaactgcagaaacaaggattgacatcaatggcactttaagtgaccccttcaagcctatgagggggctaagacaaggggatccgttatctcctcttctttttgtcctggtgatggatactcttcatgctatgttgcagaaagcaatgtcagccgggttgcttgacaaagttaaccagtggagcagagcaccaaataattctctctatgccgacgacgccgtcatcttctttaaaccggttcgtcatcttctttaaaccaaattttgcatgcctgaaaacaagggatgcaacgaggaagaagtgttggagtcgcttaaacctcatgctaagctcaaaattttggaactacacggatatagtggcctaaagatcccacaatggatggaagacccacaaatgttgcagtgcctaacaactctccacttttccaactgttcaggatgtaaggatctatcgactgtgtggtttttggtctcgattgagtgtatgtctttatctaaaatggagaatctaaccacattgtttatgaatgtcgttggtgtgaaagccgaaggatactacatccctctacaaattttcccaaggttaaaggatatgacactaagccagttatcgaacttggagaaatggacagaaagtactgctggagaggccaatactagcttagttacgtttccgaagctcgcaacgctatgtatctctgattgtccaaaacttgcaagtgttccagattgctcagttctaaaagaattgaaaacatatggatattgcagtcttgcaatgagcttacttgcacatctaaccactttgtctgaactcatttaccgggaaaatgagtctatgagaatgtcgttgggctcatggccatctctcacgaaactacatattagttcgtcatataaccaaatggccactctggaggtcgacacaaaccaaggcccactagaaaaccttaggattttgaggctatatggcctcaacttcttcacagctgcatccggtttatccaaaatgcatcttgggctatggaaatgctttgcctttgtggaggatttgtgtattggtgcatgcaacgaccttgtgcattggccaatggaggagctcatgagcttgattcaccttcgatccctgtctattgaacactgtgataaccttgaaggaaagggttcatcatcggaggaaatcatgccactctactatctagagaagtttcacatcaaagactgcaaaagtctattggatattccgacgatgcctgcatcccttgaggagctgtgtctgctactttgccccagattagtggcactgccttcgaaccttggaaatttggccaggctaaagactatgagttttgagcactgtcatgacctgaaagagttgcctgatgggatggatggccttatttcccttgaagaattgaagattatgggggtgcccagagatagagagatttccacagggtctcctccatcagattccgacccttcgatacctaatggtagcaggctgccctagcttggaaagacggtgcagagaaggtggcgagtattttgatctgatctcctccattccacgtatagttgttccagtagcaaaacagaagtgacggaatcaacatcaagcctgaagaagcttgtaaaggggctcctcccctcctgctcactctcaaagtgaggtgtgtatgctttgctcttccattatttcactctgccattattcacaagctaattaattaattacataagctaagcgccgggagtttgctttggaattgccggaaaaattggatcctttagagtagtaatattttttcaggaatacgcaaggagcgcatcttttccattaagagaaataaaagttatttacatttgaaagaaaaaacagcatgggactgatacaggacattgacagttaatcctaggtctatctatcgcactgaagtttggcaaccaaactccagccgagtttagttccaaaatttttcttcaaacttccaatttttctattacatcaaaactttcttacacacacaaactttcaacttttctgtcacatcgttccaatttcaatcaaactttcaattttagcgtgaactaaacacaccctccctcctgaattgcagcgcaggaatcgctgggtttgctttatgccaaagagaagcctcgtcagccatccctttggccacatctacccaagatctgcactgctgattgagagtagtagtattctttagagtagtagtattcacgtaaactttgtgacttaggcgcagtctccatgcctctggtgatctttgtattctttttctgcagcgaacatatagcttgttcttgaagatgaacagcatcaggaggatttctgggatgagcaaaagtctaaggtcccctctgcaatttataaagagaaatatgagagcatagttttcttcagggagctgtaaaagcgtgacaaagataatatcgattaacctcctggaacacaagtactctgttgagtttgatgctatccaaggtgagatctttgcctcttgcatttctatttttcctacacatgttgtcagaaatgttatggacatattcacaatctcttaatatgtctaggcgtgattcaaagatggataaactcactgcagtttttgtattcctctcaatctgaatctgtgatgggtggccacaccagcaaagccccatcagggaaggaggatttcctcataacagtggatgagaagcatgattatgacaggtaggttataattcacttgttctagatcatatacctgtgttgttggaactatttttgagaagcacagctcgtttcaggctgaagacgcctccagttacaccactgtttctttccatagagacggaaaccaaccaactcctctcaaatgattttccagaagaagcaacctatccctcaaccagttaaaccttcagcttccagggtatactatctgctctgtattatcctacatctaaaaaaaaaatcccagatgcagcttttctcctcaactgaaaaccacatttctagaacctgtttctttttttttttttttttgccgggtcggcgaaggagccgaccaaatttcattaagattgaaaggggaaagttatagattttacacaacattaaactgtcgagccggggactaacacccctggagagcagaaaccgggggggaggggggggtgggtggcgcgggctactcctcacaacactgaaaaacacccgcagctctccaaactgcaacttcctctttaatatctgccacaaggtgcttagccgtcttgcttctttggtcgaaaactctgatattgcgttccttccaaattagccagctcaccaacatgaaaaaggtgtcaaaagcagtcatgtagcgcgtctgaaatagaacttgtttcttcatcgaagagcttatcttgatcttgactttatccatgagagctttctgggaggacaaaggcaacaaaaaaaaatcggttacccacacctgactcatcatcaaagaacttgttcagacgggctgcaccatccatctccactgagaataaccaaccttgcacaattgaaaagagatcaacttacgcaggcataatgagcaggcaaacctgttgctgcaactgcacctacagtttctacagcaagtaggaatgcaaacaagaaacactctgacagatgctacgtacgcaagccaaggcagtaccacaagtggactcaagaatgtgacgaaacctgaactcccttacaatgcaccgaagaatctgaccacaacaagatctatatttacatgccgtgcgccagcattggatgtaggtgagaaaatagaaaatggcaggataagaagaaaatcatgcccacctgttgcaacaatagggaccaaggagcagagattagatggcaagaagaaaggcctaccagctaaagtgaaggctgtgagcagtagcaatgagtctacttctaataatggtggccgttctggtgaggccacaacaatgaacggaacgagaaaaacagatgggaagaaagagcacatgtcaaagcatggaaaatcggctgaagaagtgaacatgtcattttatacaagtttgtttttacagtttctagtgttctctgcttcgtactcttctttttctaatgattcaaaggacgaaactgttttgcatgatccgaaaaacatacatgttgtaaccaattaactatccggtgcagatgtgacttcaaatgaggaacttatgtgttttatgggttcgaagtagaaggcttttacctgtgctattaggtatctaggcaaaatgaacagacctctttttcatctacatattctagtaggtaagatttgttcacattgctagcaccattgctgtatcagtatacatgcatgtaccagtaatacttctatttgaagaatcttgccacaaaacgaaccaacacatggagtatctagctgtaatatgaatggtaatcggtttggagcctgatgcaaggatcagatttgcaagagaaaacagcacagcaggctatcaccagcatggccaccaccagggttcacaattccgataccaccttccatgccaaacgctggcagcacgttggttttcacgaaatccgattgaaaaccaacaaattcatatcggtcggtctttgtgtcaaaaatcgattggctttaccaaaatttcgaatggaaacgttgaaattcttatcgacagttggaagtgaaaacatcaatctgtttgtatcgaaaaccgattgattttgtcaagaaaccaatgtgaaatttcaaaaaaaaattgtttactaaaaatgtggaaaatagtgaaaaaaaaaagctagaaaattgggaaaatttctaaaagttttggcatgccatttctataaatttgacccattgcttgtttctgatcacaaataatgaaaacaaatgtttaatcttctatgtaaagataaataaatatatgcataggattgtaggaatgctaaccttactaagctagtctaacaagttttttttctggagtattctgttattaaatgaaatgacaacaaaacaagctaacatgtatttccaaacgaaaatgttataaagggaaatgcatgcacctagatataacatagcaaaggacgatggcaccgaaaacctagaatgaactaagtaaagtgcgggaacagacaaaggtattggacctgtagacttttttttttttttttgctagtagtagctcaaactaggtggaaggtttggatatatttctaaattcctcagcatgaactttaattttgaagccattgcctctttataatggtaaacagcattcccttgacagttgattggtcaccctctcatgatatgttattagcgggatgtcacgatggaacggtaccttttccttacccaacaaaattattttcttatcttaaatcatgtgacctttgagtctttcaagttgctgttctgaaagttctgtgattgacttttttatattccaggttgctttagggtgtgtttagttcacgttaaaattgaaagtttgattgaaattgaaacgatgtgacgtaaaagttgaaagtttgtgtgtgtatgaaagttttgatgtgatggaaaagttggaagtttgaagaactgctttaccgacaacatgtctgactgtagaactgctttactggtttaaaagcagccagttactggagttcccaaatcttcgcttttcttattctgttctgttttcaaacaaaactaaatcatgtgttctgttgataaacaggttcaaaaccttttatgtgtgtaactgctgaatctgctcccatcagaaccgtgtcgtgggcaccatctgtgaggtagccagttgtactgttactctggtctattccaaaagataatttttgagttttgactcttgtcattctatcagtaaggaaaacgtgaatacctttgtcactggtggagaggatggtctgaaattcggggatttaaggtaggtgttggccttgttgtgaactgaagcaatgtttaaaacatctttcgaactactctcttatcctgcatgaatttctaatattatgtatgggtcctcagaggtctgaacattgagggtagtctctcccccttcctctctgaattcgtggcacctcccaatttctgaaccattcatatttgtttctgtttgtttcctaatggtaaaaattccgagttaacaaacaaaagataggcacgatatgcagaatatgttattatcacatggaccaatgatgtcagtaggagtttctttatgaatccagtgcgatatacggtttttttctttagcttttcaatgggcactaagaaacttgttctagaagctgcagtatgtttggctatgaatatactgattgttatggttaaatcactacctgtcacagcccccttggatttgctattgttttctaccgtttttgttttgtaatatttgggaattttagtgcatctcataagatatctttgctgcagagatccatatcgtcatctttgggagttaactactgctcgaagggccgtaataagtcttcaatggttgaaggatgcaaggtaatatttgttaagcactaaatgtacttgtttttcttcactaacacggtgtttacgttgttttccttgtctttgaaacactgcactaattttaaatggagatgtatgttttcattaatgttggaacacatactagaaaccatatttgctagaatgttgacaattattttagtcatgtaatttatgttcatagggcctgtacttctccgttagtgtgtgctaaggtggatattgtctttgtttatataattagttccattaaagcatcagcgtatttttttaagtaattctatttgcactttttttttgcaaacgctctatttgcacttgtttacataattattaatataaatgtttgtatttgcccacgtaccttctaaatgagatgcaagcttccttcactggacatggtcttgatgtattactggatcaaagtagacgtgattaaatagaccacattgtttcattcatggtgatattgtgtgtatatatgccagacataccctttttactagaatggtaatgttaactgttatattttttatctttgtgttcagaggtattgtcatatcattggaagatggcgcattaaagttcgttagcttgttaagaatcgcaaatgatgttcctgttactggaaggccatttgttggaacgaaaactcagggtgtttctacctatcaattgcctgaatatttgatctggagtgtccatgcctcagaaattacaggtgcatttcacctcatgtccaaccatagtagatgtcaagtatcggaatattggttatagccttatatcaatatttagttccacacatttgagcagagtaaaaatgtcaaatatatattcatgatagttcatgaatttgtaattttgttttgctgatatccaggctatgcggcttattgtgtggctgatggaactgctgtttgctttgaggtaaactaaacagcacataaactattgatttatgcatgctattgtgattctctataacattgctaaataaatattcaacttactgtagcttactccgagattctaggaaaaggaacctgggagaaaccgtgtaccatattttctttgtggttcattatcagagggaacaaccattaaaattggtatcgcattaccaaactctcctttgtcaaatgttcctctggagaccaaacgggctactaaaacttgcaaagatgtagctcaattgcatgttatagaagaagggaaacttcttaccaactcaggtaatcgctgtcacctgcaacttgtatcattttgcttgtacctgacatgcctgcttaaccaccatacagaatgcaattgtgctataaatccgagcatcagagatggtcaacaagatgaacctgatgaaggacaagaaactggtgccatagttttagctgctccttcaatgcaagagaactttggcacaagcaccagcaggggtagcgaatcccctgaaaattttgaggtatttcctcctaaagctgtagcaatgcatcggttgagatggaccatgaataaaggtagcgagaaatggttgtgctatggaggtgctgcaggcattatccggtgtcagaggatctaaggaacaagagcacacttgaggaatctccttgtatatcaggaaaatctgcatgtgtccatctacacaataaactgttgcatgctgtggtatgtttcatccgtttctttcctctactgttattttgatcaccatgtccattttgggttatatgtattaacttcttgcactgtgcttgcaatataacagattatggccctgtttggttcatgggctaatatttagccctcaccttttagcctcaaattagccctcagagatccaaacaggtgagctaattttgagctaatatgaattagcccccctcaaaacattagcccctctaaggggtactaatggggctaatttcgtgtggggaccatcaaaaagcagctctctctctctctccttctctctctcctctctttctactctctctccaccttttagccttgaattagcccatggatctaaacataccaccctaggctaatgtttagcctaccaattcatgactaaacattagctctcaaaattagccctgggctaatctttcaaagagggcctatctttggaactcccgacggagctgtatagccttatggactgaagctttacctgagctgcgaggttctctgtgttttgggaccagcaattcattgcatgttggttcgaaaatagaaaatattgtcactccatgcgattcttcctccacattactctgaaataagtgcaatatgtgcctttggcgatccagattcgcaaaatctgttgtaattgtaattgtaattgatagctattcttattcatttcctgtaacatatgtaagatcgcacagattattgatgcagctaaaaaactgcacgatattaggtgggatttcatgcatcgctgtttaagttttggaagtcatacagccttgttgcttcataatatgtactactctttttaaggattgttgagttgttaggctgtcgaagcttttttaaacaaatcaacagcaatgtgttgaggcatttcttcgctgctgtgctcaagttctcgtagggagcacgaccctacgacataggagcatttctgtccttgctccttaccagataaagagaagatctgatgtatctttgttaacacgatatcataacagttgggtaaacacgatataggagcattttcattattggagagagaatttggcatatttacatttcacttagctgtctttatcaaagtgatatttcgggtgaaactgcaggatgaagtactgtacaatagtaataaacgtggcttcccttaaaaaaagaaaaaaaaacatggcctgttaacatccctaatgtcaatgttcttagtgtacaatacaactatacatgcataattctcagtcgctccagttatcctcatcgactacaaaatccatttgcctcttgccatcatcttcctgcagaggtttagcagtgctaacaatcaaatgcctaaaaaagcttatgcaataatatcccaatatgcccgactactcctgagaaatttgaatttgataggatgtaggaaaattctacagaaagatatatgataacaagaaatagaaaatataccatttcagtaaatgctggagttgatggagaccacacaagaatttgcctgtcattgctgccagtataaagctcctgaattccaaaagactcagcaatggtattgatgcgggaacattcagggttaacagaggataggagtagagggaagacttacttgttcttgtgcactatagtagcagcaattaacaggttcatagtgcccacggaatgtttgaaatgtcataccagaccataaattgtacgcctacatgaatttggcaacacaaggtgaagtataaaattcagcgtccaaactgagaagctaaaaaatgaccacaccttaatgcttgccatgcatgggatgaatacaagtgatggatcctcagtgacagctaattgaagtggtttgctagtctgtaatcgcatagcttcaaaattgaccaaagtattacagcctgaatcaatatcccaaagtcttaagcgagaatcagaacttaaagagagaggataacaatcattaatgcatactgcatacaggcataacaagaagatagccataggcaataattcctttcaagcaatagcaatcgaatgctcatagaaatagcaattaaattcaatcaacctgagctaagaaggtacatcccatctgtagttgttcttaatcccgtaacagcaccataatgcgccgttgcacgattttgactagaagacaaaccagggtgcaatctctgttggatatgtccatgtccagggatttgacttttgtgcaatttgtgtgactgtttcttactcttgcctgtcctctgctgtgcagagtaaatctttgaagaagatgaaggttgtaaagagttcaaaggatcctagtcaaaattaaaaatgaatacattgatcatttgcacaactagatcaatgagtttgcgcgtcatttctagggcacaacaatcaacaagaaacaatgtatgcagaccttatattgtaagaattggagcactaaactgatccatagcacctatatactgacactaatatgtgagacaaacctataaattaatagccgcagaaatcagcttttacttgaaggctgacagtattgatctgtagcattacaaccataatgttttacttaaagctgcaacatttttgaagcttttgcagaaaataaaagtggaagtccagctttagcgttgcaaccaaatattttgaaaacaaatgtaagtgatggataatggtgaccataccttatctgaggtgccctcaagaaaaggaggccgccttcctagttgagaccgtgattgatcaagaacaagaaagcatccagctcgtcttatgtcccaaaatcgtattgctccatcacaaccaccgctcatcaaaatccactcacttgaagtagaccactccaaagacatgataccatctgacatgtcagataccaaggataaggtggtaaccatacaaacaaagcaagcatattttcatcactacactagaagtaagcaactaaccacgatgaccagacaacgtgtgggtaaaggctccagaagcaatatcacataaacggacctgaacatctgcacttccagtagcgatcagcatatgtgttgttgcaattggggacattgctgcactgtacacttttccaggcatcttaaaatccattacgacctagaaaagaaaaccaggcaaaaaatcagaacatcaggatcacaccattgccaccacaaaggaggcaagacaaaagaaaaattagcaatcgacaaagcagatgaaagcatacttgagtcgaattagtatcccacactttgacatactgatcaaaagaagctgtcacaaacagcccagtgtccacaggataccatacggccatagataccgcgaacttgtggccattttcatgctgcttgtccacaaggagaatgctcctatgcttggcaatgaacccagcttcgtattcgatcgcattctgcacatcaaatatagcggctgatccatccgatgcgcccgagagcaggtaccgccgctctatcaaatcaacctgaccatattgtcaaattacaaaacaccagcgggagcgactcaggaattgcacaccaaatacgcaagattccatctacagggtgtacaaatcaaattgatctaaaccactaaggtgagagaaggagaaggggagtgagggagtgagaagggggtgtacctggagagagttgacggcgccgttgtgcggggtggttttcccccgtcgtgtctagagtaacagtggcgtgatccggcttaatcgcctggcagtacatcagccttgtgccagaagctgtaagagttaagagggccgcaccgcttgaccttacatacagttggccgggctgaacggttgtgtgcgtcttatcaggggttttatcggtcgatatatgcggtgtgttgcgccagtcatatatgaccgtctcggccgagtgtgatctatgctggcagagtatggacagggattagacgcgtgcactggcgagctcgcatgccccagctcccgtannnnnnnnnnnnnnnnnnnnnnnnnnnnnnnnnnnnnnnnnnnnnnnnnnngactaccaaanatcccat

SEQ ID NO: 3954 - DNA, 1089 bp, Oryza sativa
  unsure (1)..(1089): unsure at all n locations
atctggtatttttaagccggtttatggtaaaacaaggtatttcttgtaagtttaatacacagtttattggtaaaccaagtactacctatgtttagagtatatgaccggcttttgtacgaaggtctggctttacaacttattaaaagatagtgcaaatatcatttattttgttataacttatatgtgtactatattttgtaataagacaaataaaagatgaatgataagacaatgtgtccaaaagccaactgcttcttatatttaaaaatggtggaagtaccaaactatgggttaatttgtgcagtagtattttccagtgtgaaggtggtaaaatacacagggcaagtacagtagaattcatattgatttagagatgcaaactaatataaatcattccacactgaaggacaataaatttgctatatataaaaatgatatgtcatataagtactacatccagttcggattgaattacaaattgttacaacgcaataacaacatatgaagattcataatgacaacgctacattcagcagaaaatttcactccagataatcacgatgtccccaagaactatttttgagcttttttcgcagagggcctaccaacgtttttctttttgctgccagaagatccaccaacggttttctttttgccgccagaagatccaccaacgtttttcctattgctgccagaagatccatcattctctctcttcctcctaggatttttcaagatttttataatttcttcaaacactcttgccttctcttctttgatagtatcaatttcatcaataaatctcgccatccgcctacttgacattgcagtgaccggtttgttgatgatcctccctatcttcttctttatacttcttatctgtgacaggttaaagaaccaaattaatatcacataaaatgaaatcaacttcattttatatgcaatgaactatgtacaacatatattactactccctccgtcccaaaataagtgnnnnnnnnnnnnnnnnnnnnnnnnnnnnnnnnnnnnnnnnnnnnnnnnnnnnnnnnnnnnnnnnnnnnnnnnnnncaaggcaacaaanncggccaa

SEQ ID NO: 3955 - DNA, 707 bp, Oryza sativa
  unsure (1)..(707): unsure at all n locations
ggggcccattgatgacatcctttnnnnnnnnnnnnnnnnnnnnnnnnnnnnnnnnnnnncttacttactagtgccacatctttcagcatgaatttgtcattgaccttgattgttcctttagccatcatgcgtccactgctcgcatccccaaaagtgatggtctcatcaccggatgcacgagtgagagaagtaaaccacttggcttcaccggtcatgtggcgtgagcaaccggagtccacaagccaagaattacttctccctactccaaaatcctacaagaaggacacagcagatctcgatgattcagtactggggttagtgaaaaatgacttaggaatccagtactgaaccatgcgagaagtacaagcatctttagtgttatgagcagaattatatgcaagatgaccatgtctgttttgccccaaccctgctaggtcacgtcgagggtgcacatctcggcgaggaaagcgagatacacaacttgaacgacaatgacacgcacactcgaacctctcagggactctagtagctcttctagtcctaagacgttcttgtcgctcttttctagcctttctaaagcagaaacctacccaatgaccagctttcccacaataggtgcactcatacttggttttctctacaagcttggtttggctctaggtttgcttgtgctcacctgttttggatttttggtctaggaactttan

SEQ ID NO: 3956 - DNA, 4546 bp, Oryza sativa
  unsure (1)..(4546): unsure at all n locations
agataaaatttgataccctcgtattcacgcgaattcgagctcggtacccgagcctcctagctctctatagaaggagtcagtctagctgaagagaacacaccagagaagcaagagtagtagtttctcctgcctctctaggcagttttacccaaaaagaacacttttctatagatacaaggaccaccggatgcctatacaagatgcaagctaagaataagaactaccaaagaggtttctcaacaaacaaacaatgatatataagaaagttacttcatattaaacaagtaagcttacatacggttttctctttcgggaccccaaagaaaggtacagacaagttttctcaccttagaccgtttatataacatttgttgctcccaatatactagaaaggtaaattattaacattactacaggactaagaggctgaaggttcttaaagactaagctagaggatcttgcttctctggtctgtgctctttagctggaccaactccgtttatagaggctagagaaggaggctttgtcggtgcttcgtgcttatcttctcaacactgtaatttcacgagctggctaacatcacagagtagcacttccttttttttttcttcacggcttccttcatttagctaaagtggagacaactttgtacatatgtctcactttttcggccgaaagttatattcttcacaatattcttagcagtgaaatgtcactcaccgaaagaattttgtgatgaatctgcaaacgttatcactctttgcttgtagtgttcttctgaactattcttccctttacccttgaaatatagttgaggtagtttacttgtagactattaggcttgccacccctgaatgattgataaatccttatcaattgaacctttcttatatattgaactttgaaatctatctactacctatatagtgttagggggcaattgcgtttttgatcatattttaaggtctaactatcaatttaaccctattttcctaagtttgctcttttgactctcttttttaaaaacgaacgttcggtctggccctattccgttaaggcaacgtaacagtgttaattcagaaaaaaatagcctttatgcccccactcattttcatttgactctactttttcaaagtgcttgcctaattttgtgtatttttatctaaaaatgtgacaatttttttactaacataagtgacaaatttaacttaggtttgagtgatttgacaattttgaaatagatctaacttcttttggacgaaattcacttagatttgatatatttttgagaaacttaacatacatttgacagatttttgataaatttcacaaaaaaaaattacataatccctccagcaccagcagcatgccgtcctcctgaccaggagagcaccgggcaagaacaaagagaggcgagagagagatggagagcagcagcaacagcaaaaacaaagcagcaaaattctagcggccagcgacggcgagctcccgcgccgcgcgcctccctacgcgccctcccgcgccgcgcgccttcttccgcggccggcggcggcgagctcccgggccgctcgcctcccttcgcgccccgcgccgtgcgcttcctcccgcgcgtgcgtctccttccgtgcttggcggcggcggcgggctcccgcgccacgcgcctccttcgcttcgcacaccgcggcggcgaggtcccgcgactccctccttccgcgcggagcacgccgagagagatggggttgagagtgactggataggattgggagtgagatgatagtgttgagttcaggggtattttggtcagtttgaataataatttgatcttttttttttctaaatgaaaccctaacggtgtaactttttaaaaagcagaatcaaataagcaaactacgaaaagtagggttagattggtagttagactctaaaatagggtcaaatgagcaattgtcccatagtgttattacactatatagctgtactgtaataacattttaatctctataaaacttactgtataatccgtacaagatatatagatttttcgtttgtttctagtacttatgtaaaatttatatataaattataatacaatatagttatataaattacgttaattttagtgtggcgtaatatagttaatttttgatagttttttaaaagaaaccgtcgcaagatttttcttgatagtcctacttgtgtggcgatagctcacatgtggaagtatgatcgggtctggccccattaacagatttgtggagccatcgtttctcttattcatggaataagcgaaacgacgtatttataaacgaaaagtaatttgtgaataaaacttttatatacgtgttcttagcgatctaaaagcaaaggctgaaaaataaacttcgatgaaaaaaccttaaaataagtttcaaatttaaggttgaaaattttaattttggctgataagtataagcataagcgaaaaaatgaggtccttgagctgtctttcatttttatttttttcctggaaaaagtttgtttttcatccctcaatcatatgacaagtttaattaattcacatctcttaaccgtagaaccaggtataaagactcgcttaacgattgaaaaccggataaatttacctccctacggtggcttccctctcacctcggctggccgtggctcctaccctccttcccggggttggaaatttcggatgaaattacttcaattttttcatgaattttggtaatacttgttcaaattcaactaaattttatttaacatttcggaaattttgaatcgaattttttaaaatttcagtatttcggtgaggcccgatcagatcggcataaccaataggatcaaccctgctccttctgcggctcgctcaactggcaggggcaacgacactggcgcggaggtcagcgacagcgagaatgaagggatgcacgtacgtgtcaaggtgtgagccgaggccgcgcgctcggttcccgctgctgctcgctttcctacggagaggagccaccgacgccgaggcccttccttcccgccaatagccactgccgaggagaagcagtcgtcgtcgcgccgggatggggatcgaggtgggtgcggccgtcgtgctcactacttgctgtcgatgcccttgcgcactcaaccccacgaaggtgacagatgaacacgagcaggaggccgatggcagcggcctcggagacgctgacatagagcaagaggagccatcaccaccggcgcgcggagctactagctgctggcctcgagcgcgacgaggaagttgtacgggaatgccgtggaggacacgaggatcacgccgtcgagaacttcggccgccacagtgcgcctacgcgtcttaggtcgtcacgggtggcggcggcgggaaccttcaattcccgccagcagcgccgtgttggctgtcgctcattatcgtagcaaaagtcgctccgcgaggtcgagctcttcacggcaaagacagtgagcatgcacacgcttgcttgcttgcttggtgccaaccagtatgtcagtggggatcgaactgaagatgggttgctgttgccttgttggtctgattgttgaacagctccatttggggtttttatttgtatcttcttcttttcgattgtaatgcaatgtaagcgtcacctacctgccatgttgaacgaatacctggtcgatcaatctgccacgtaagtaccatattagataaaatcatctcgcaaaccatcgaggaagatgaattgatccggtttctaaagttgagagaatttttatatcctgtattgtgatcgaggcacaacaattggactggacatataattaccatcgaggagatgaatcgatccggtttctaaagttgagagaatttttatatcctgtatcgtgatcgaggcacaacaattggactggacataattaagggacgcagaatcgacttaattcttttttttccctctgtcacagggctgactcagcatttcaagcccaaacacagttgctttgcccctaaaaagaagctatataataacacacctaataaactaagtgacgtatacgtaaccttgggtaatgtacactgttggagaaaggggctttactcccggttcgtaacccccctatagttccggttttcaaaccgggactaccaatccgggactaaagatcactatctttagtcccgggtaaaaaaaaccgggagtaaaaaatgtatctttagtcccggttagtgttaccaaccgggactaaagatagagctagcctagctagatcggttactttattattattttcttttcttcattgtgtttttaatatattgatttcactccatccccatcccaaaatcccaaataaattatccccaaatccccaaatcggccatattcaaatagatcacaaaatcttaaaacaaaatttcatcataacttctacaaaattcatcacaaatacattacatatttacggacatcacacacaaatcaaatacacagattnnnnnnnnnnnnnnnnnnnnnnnnnnnnnnnnnnnnnagagattgcatcaataggaccc

SEQ ID NO: 3957 - DNA, 8400 bp, Oryza sativa
  unsure (1)..(8400): unsure at all n locations
aggggtagctgaccgtccgatctatcactggattaatgggtaggaaacgatagtagttagaggagagtagttatagaggaggaagaggaacggatgatggggaagggaagttgaggagttagaggagaggaggagtaatagaagaagatgggatgaaaagataaggttagaagaggaagaggtgaagagataagcctgcccatctcctcgtcctcctcgatctcgcagatggcagatgcctcatactctccgccacgatcttttgttccggttggttttaccaaccgggactaaaaatagatctttagtcctggttggtaacaccaaccgggactaaagatagtatgcatcttttttcccggttggtgttaccaaccgggactagaaatagatctttagtcccggttggtacattaaaaagcagctctaaacttttgaatcgggactaaaaataatttttaatctcggtttttattacaaccaggactattgtagattttggccgaccgagtaaagatggtttctccataagtggtaaccagggtcaatagtctgaacttggccggggagaggacgttaagatgaatcaaacaatatcagtttcaatcaatttgtgaccagacaatggagcttatcatacaacagacgcagcacacgtacatgttgtgtggtttgcaggcctagttctagtgcacaactgctgaccaaaaaagttcatgaacaaccctctccggcaccggtaggcctccccacacacatgcacacgagcggctttattttattggagccgccgtttgcagggcggacatacgtatacttacgggtgcccagaaattcagtttagaaaattttgagctatagtttatctattttcatcatatatatattatgttagtttaaacttagacatctgtatcaagtaaagcaagcgagtggacagtaaaccatatcaacttgtctatgatggcctatctatgacagactgaagtagctatcacagatgacatcatgtctgacgggttaaactaaaacttattgtagataaggctcaaggggatgactcgtcacaggtaagaactcatctatgacagtatgacgggcctatatcagaacacagcacatgacatctctaatgggcttacatataggcccgtcacaggtgaccttcaacctgtggtgggtgttaagtttgcaacctatcaaagatgagatatctcatctcaaacgagttaacatcttatattcgtcagaaataacttaaaaccctcccacccctcatgcccgcacctaccccaccccctgtgccccttctcctcccgtcctcatcttcatgtctcatcnttctctcatcactctcttcttcacatctccagccgacgcctcccgaccgctggccaccggtgcctcccccgtcttctgaccaccggctgccggatctgctcggatctgcctacggggcacggatccgtccatcgcggcctctcccccaaaggttagccacctcctcctcagccaccccaccgtcggccgcaggatttggactcaacgagtttgggggacacggatctgatggcagccgccttctactggccactggatctcgtggacttatgggacgcatatccggccaccgcggcctctccccccgaccactatgccgcttctcctccgccacctgactgtcaggcgccagatcgggcctccgccacctccattccatagccggcgtccgcggccttccctcctaccccgattcttcctctgccaccctaccggcagcagctggatcccccaaccgaccgccagcatccttcaccgtctcctttacccaagagcgctgccgccgtttctgactcttgtaggttatgcttgatttttcttatcttgcaaattttcattgccaaatttcagattgggttatattctcggttgcttgtatggatttgtagtttgttaagatggggattattactggtgtgatgtatattgtcactcaagttgtgtaatctgtgatgtacttgtgtggatgtgcttcatgtgtagctatatctctgatgttaacagatatgtcaataaagcgcaaagttacggtgtcttgcatcttgagatgttgcttcatgtcgtgagctatgggtggtgaattaaacctgtcagagatgtctatcacttcagatggcaggaaagagccacccatcacaagtgactctcatctgtgacgggttatttttatgtggcccgttagaggtgttaatcatcattgacaggcttccacccgttagagatgagatgcagtcatcactgccactgatcattgatgcgagagccgaacccgtcagaggtgatgatatgggcctgtcagtaatgtgcggacccagtgtagtgggaactcccctcgttttattatagctcccccgctgatgcttggatcgatccggcccgtcccaccccttggacgtacacagtgaggcgattttgctagatatttgtcatcaaatttctccccctaatatttatcagatgtaattacagtacaatcgtagtgtaattacactgtaacttacatgtaattacaatgtaactataatgtaacttatatgtaactttcaagaatctctcagtaacatgttatttcagtaaaatagaggtcctgggaataaattctttcacatatgtgtgtgctgtgatttttttattcctcaccagaacaaatcttgtaatagatctaactattcaaaattacgtgaaacttacatacaagttacactgtagttatatgtaagttacagtgtaattacatacaagttacagtgtaattacactatgattgtactataattacatctgtcaaatttttagtagaaaatttatcgacaaatgtataggtggtccccagtgaggtactgacgcacaaaacaagtactagtactatttgactcagatgacacacagtgtgtacgaattaaagttgagcgtatatgtaaattataaaactacatcggtgcagtaacttggaatgtaaaacatgcattcacaaggtatacatctgataaacaaaatgcaatgttgtttgtacacaacatattaacagagcgaaatggagcgtgcttgtgcgtagcatatatcgagcaaaaacccaatgtaaattaacgatatgtgcatcgcctgcatcgcatgcatgcctgctcatcaatacgagagcaggctcacggcgaccaccgcggtcacgacccctgcaaacgccggcgcccatcccgccggcgccatcctgccggcggccgccgtcgccgtggcgtccacctccttcgacggcgcttcgtcaggcgccgccgccaccgacgacgacgacgcggtctgcggcttcccgtgcttccccgccgccgcgggcgcgtcggcggcgccgtagtccttcttggcgccggggccgaacatgtcgggcgggaggaggacggcgtcgagcgagtacacggcgagcgggtggccgtcgcggagcggcctcccgagctcgccctccaccaccccggacgagacgcgcaccctgtcctcgccggcggtggtgacgttgacggtgcagacgccgcgctggccggaggcctgggtgcgcaccgggttggtggtggtctcgaacgtgacgaagccgtagtacctggggaggacgtggtacagcaccagctccgcctgcgcctgcgcgttcatctggttgagcgtccccggccggagccgcccgaacgcggcgtccgtcggcgccagcaccgtcagcccgtcgccgttccggtcgttgttcagcaggctgctcacttgcgacgtcacctccgtgtccttaccaagccggacgaaggtgttgtagtgcccgcctttggccaggatccccgtcaggttaaggggccccgtcggtgccgggcttggcgcttccccggcgccgaagacgacgacgacgaagccggtggctagggttagggccagtacaagaaatcctgtgcttggggaggaagccattttggatgcttaattaatttgctttctgtatagctactactgtactgtgcggtgttagggctggggtttaagtagggagtgagagttggagaaggagggctttcaataatttcttgcagttaaataacggccaaactgttggttcgaccatcctttttctagttggagcgggagacgtctccagttttgttgtggttatgttggtggtgcatgcttatccatgaaacatatacggagaggggaccaatagtgaggtttgctttgccttttcatcttctgatcagaataagctaacgatcaataatactatactaatgatagggcgccatatattgcatgatggatttattgcgatatattgtatttttctatatgcctctatgtgctagtagctctttgatgttgtaacttccaagtgtcaagctgggctactatagctaccgtactatatcgtgtgatttatgaattagataggaacattcgtgcatgcatgtttatattctgcattttgtagtgggcatgatcaatgacagtaacggatgtttgcgccatattttctcgaaaggacagctgacctagacagtcacattaaccacattgtttgttaagactaacggcatatgtaccggtacatccgtactttttacttgctgttatatttggacatcgccacttcaatacacttaaggctgaaaaacagacagcgacagcagcagcagcaataataataataataatacaaaattatccgtctgaacttacgcacttgttcaatttagccctctaaattaattatagaaccacatttttaaccctcaatacttgtaaacaagagtaaagtaacgaggtgaacagtgggattttacgatgaacatgtttttttttttggctatttgagtcgatcagaccgcgcagtgtgcgctggtcagatcagggttgtgcggatggtcagatcaggtaactcaacggtctaacaggttagctcatgtatggagttagcttccagctgtttagttggatactcatgattacttcatgttatgacttctatatgattactatgcatatgtaatactattgtcagctaatattaggttaagttgagaaagcacttgtgcttggctagtttagattataaatcggataaatagtttagaagaaaaaaaacttttaaagtgcggaagatggaaatatgagaagttagctaactgagctgcacaagggtcttatccttttttaaagagcaattttactgtttttgaggaggtaccatgaggtatcactttttctattgtaaatttggtacctcttggtacctaggtactatgaggtaccatgaggtaccaaattttacactaaatttttggtacctcatgttacctcctcaagaaccgtagatttgctcttttttaaattgtcgcacaaagagactgagggggcagtggctatgcatgtaggtattcatgtatgagagagcatgcgtgtaatgtgtagtagtggacacccgatttttcctcttaagatcaggcgctcgagttgcattcgccaagttttgatttttggtctaccattcatcactcctctagtaggatttctccttgtgtttcgatcctaagcttctcgcgcgcttgccacccctccctccaatggcggtgccggcctctcccagccgcagcgatcggcaatggtttagttgctgccctgctgcccctctccacgacatactggtccccacagtacgtccctctccgcgcagctctgaaccaatccctctttcttggcaggaggacacagggaaggcaggggacgggatccggcggcagcaccatcttcttcggtgatggtggaggtgtcgtgcacacacttcaggtcatggatgagtcaactcgtcacaggaggactggtggatcgagtaaatcgaacttattgcaaaacatcaagcggtaattcggacttcttccaataaaaatccccaaaattaactctaaaattagttttgaaaattcaaaattgatatgtggctgataaccaaccagcagaccatgtgagagcctcacatcattgatttatgacctgttactccatccgtcccaataatatataaacattgctaaatagtctaaaggaagtgcatttatttggattcggcttctagctttaataggagaaattaagggtgaagaagaaaattatgataacacttattaaatgaagaggtgttcaggagtaggagtgtagtggtaaaatagggtgaaaatcaattggatcatgattaagatgaaaattaaattgcctgtactagtgaacattgaaatcccaaaattatattttgggacatagggagttatttttttatttaaaatcttcagttaaattactaagatactcaatagagagtccaaggtactgaagaaaatgaaatatcatataattattgtccttgacttttagaattattaaagcttaagaaaaactaaaattgagactacaggcggagtacaacttggtctagtccacgttagttacaacttactaactattaattaactttttttcttttttgagaaagagaggattcctccccgtgttattaacaaactcatcaagcgactactaactattaacttataaatttaatttaataactattaaatcaataaatattaccaaagcgtcactaggatgagtatacatattattaaatttgaaattttagatatttaaagaaataaaaaattagtttatgatagcactccaaaattaagagtatgcacaattaactttatatttattgtatatgtttaaaataattaagttatggtattacaaaaatcattagagtgaattttcaatacaactttgcaggtatttttgaagtagtaattaaattaaattgttttgttcttaagccttaaagttttcatgtatacaaaatatgcaatgcaaatacactactacataaatgtttttgctagacgagaccctggttaggttgcagacgaaccataactgcccgcgtttgtaaaattcggtcttcattttcgcatacggcatcttaagatgcccgcatgcaaaaatcgattttcgtaaatagacaacttaaggagctgcatgcgaaaataagaccatttttgcatgcggacctcttgagggaccgcatgcaaaaatatctcatttttcttttttcccatccacttcaatttttttacccatctcctgtcaagatatttcaatcctctcctccactcctcgcttcctctcctctcctcaatctctctctccctccaagtgggcggcgacaggcgggcggcggcgccaccgccatccccttcctcattgacgatgacaacgacgacgacgaggaggcgaccagctccatccacaccccccccctgacgctgccaccgctgacgacaaggaggcgacaacagtggtcgacgtcgggcggcaggcctcctcctacccatatctggcaacggtggtgagagcggtcggcggctcagcggtaggagcagcggcggtgggagcggacggtggcggctttcacgatggtgatttgcctcctcccgcccggatccagaagtggcgggcctcctgctgcctggatccgacagcaggaacggcagtggtgggagcggacggcagcggcggctcgcctcctcccgcccagatccgacggtggcaggcctcctcccgcctagattcggcagcgggagcggacggcaatgggagcagagggcacgacgccggcactcggctgacgtgattttttttttggatttttatttttgcatgcggcccacgtaagcaactacatgcgaaaatagcaatttagcatgcgggtgcaacgccctcatgcgaaaatcactatttttgcagaccttctcgtgcagacggcctggccatccgcttgcaaaaaccaaatctggctgtctgaaaaatctttttttaagtattgatagtctatacaaatgcaacgtgtgttgtccgccgactagtctaactgtaatagttttacattgggaagtccatcgagttttttaagtattgatagtctatacaaatgcaacgtgtgttgtccgacgactagtctaactgtaatagttttacattgggaagtccatcgaaccagatcgagaccaaactcgcgttatttttttaggcttgttagctagtgtcaagacaagataagttnnnnnnnnnnnnnnnnnnnnnnnnnnnnnnnnnnnnnnnnnnnnnnnnnnnnnnngctgnnggaactagaggtcaaccaaantccccactggggggggnggnntannnntgaaataacattacnaatactaataaataaacaaatcgagtacgaaatacgtaaggagttcaanataagaatacataacccaatctatattcagtacctagagc

SEQ ID NO: 3958 - DNA, 13623 bp, Oryza sativa
  unsure (1)..(13623): unsure at all n locations
tcggtccnnnnggtgagatctcnnnnnnnnnnnnnnnnnnnnnnnnnnnnnnnnnntattcggattagtttcctagtaggagtcctattaggtgtctttctattatcccctatatatactcttgtaagccgtacgggaaggggtgacgttcctattatgattcccctacgtttgtaatcatctcctctatagtgatcattgctggtcggcgcccgtggtttttcccgcaagggttttccacgtaaaattcgtgtctccgttgtgcatatatttttataacaagtggtataatagcattggagattcgatcaacaactatcccatcgtcgttctgcaattcggcgagattatccaccagcgcacgttcatcatcggcgacggcaggcgcgtgtcgtcgctcgtctcgtcgattcgtctcgtcttcgtcgtgctgcctacgcacgcgagaaaaaacaggaggagcagcagccggtctccacaccacacgtcgggggaggagaaaaagcagcagaaaccaatctaattgcgcacggatcccaaagtgaagaaaaagtagggcaagtcagtcagagccatcatcgccctgttctgtgaattcaatttcacgttgagaattgctatggccacctaagcttgtgtaccaggagattccctgatctacgctacgtgcacacataaagtgcacccagaggttcgtgattttgctaggtttaccctaatttcttactagcaaattttaggattaattcctatggcgagtttgaagtatgatctaccgctcctggaccgagacacaagattctcactttggcaagtgaagatgcgagccgttcttgcacagcaagacctcgatgatacgctttctggatttgacaagaggactcaggattggtccaacgatgagaagaaaagggatcgtaaggctatgtcatatattcatcttcatctatctaacaatattttgaaggaggtgcttaaggaggagacagccgctgggctgtggttgaaactggaacagatatgcatgactaaggatctgaccagtaagatgcacctgaagcaaaagttatttttgcataagttgcaagatgatgggtctgtaatggaccatctctccactttcaaggaaattgttgctgaccttgagtctatggaggtaaagtatgatgaaaaggatttaggccttattctattgtgttcattgcctagctcatatgcaaacttcacggatactatactttatagtcgtgatactctaactttgaaagaagtttacgatgctttgcatgccaaagaaaagatgaagaagatggtaccctctgaaggttcaaattcacaagcagaaggcttggttgttcggggcaggcaacaggagaagaacacaaagaaccaatcaagagataaaagctcaagtagctaccgtgggagatcaaagtctagaggcaggtataagtcatgcaaatactgcaagagagatggacatgatatctctgagtgttggaagctacaggacaaagacaagagaactggaaagtatataccaaaaggtaagaaagaagaggaaggtaaagccacagttgttactaatgagaagtctgatgcagaattgcttgttgcttatgctggttgtgcacaaactagtgaccagtggattcttgatactgcatgcacctatcacatgtgccctaatagggattggtttgccacctatgaagctgtgcaaggtggtactgttttgatgggtgatgatacaccatgcgaggttgcaggtattggaacagttcagatcaagatgtttgatggctgtatcagaacattgtcagatgtgcggcatattccaaatttgaagagaagtctcatctctttatgtactcttgatcacaaagggtacaaatattcctgtggagacggaattttgaagataactaaaggctctcttgttgtgatgaaagctgatattaaatatgctaacctgtaccatctgcgaggtacaactatattaggtaatgttgcagcagtttctgattcattatctaattccgatgctactaatctttggcatatgcgtcttgggcatatgagtgaaattggtttggcagaattgagcaagcgaggattgctagatggacaaagcatcgggaagctcaaattttgtgagcattgcatctttggcaagcataagagggtgaagttcaacacatctacacatactactgaaggtattcttgattatgtgcattctgatttatgggggcctgctcgtaagacatcttttggaggtgctcgttacatgatgactatcgttgatgattattcgcgaaaagtttggccttatttcttgaagcacaaatatcaagcttttgatgtgtttaaagagtggaaaactatggttgaaagaaaaactgaaaggaaggtgaaaatccttcgtactgacaatgggatggagttctgttctaagatattttaatcatattgcaagtctgaaggcattgtgcgtcactacaccgttcctcacacacctcaacaaaacggcgtagctgagcatatgaacagaacaattatatcaaaggcccgttgtatgttgtctaatgcaggtttgcctaaacagttttgggcggaagccgtttccactgcttgttatcttataaatcgatcacctagctatgccattgataagaagactccaattgaggtatggtctggttccccagcaaattattcagacttaagagtatttggttgtactgcttatgctcatgttgataatgataaattggagcctagagctattaagtgcatttttcttggttatccgtctgctgtgaaaggctataagttatggtgtcctgaaactaaaaaggttgtgattagtcgaaacattgtcttccatgaatcagttatgttacatgacaaaccttctactaatgttcctgttgagagtcaggagaaagcaagtgtggaggtggagcacttgatcagttcagggcatgcaccagaaaaagaagatgttgctattaaccaagatgaacctgttattgaagattcaaattcttctactgttcagcagtctccaaaacgttctattgcaaaagataggcccaaaagaaatattaaaccttctcaaagatatattgaagaagcaaacatagttgcttatactttgagtgtggcagaagaaattgaaggtaatgcagaaccttctacatattctgaggctattgtttctgatgattgcaatagatggataactgctatgcatgatgagatggagtcacttgaaaagaatcatacttgggaattggtgaagttgccaaaggagaagaaacctatccgttgcaagtggatcttcaaaagaaaggaaggtatgtctccaagtgatgaggcaagatacaaagcaaggctagttgctaaaggttatagccagattccaggtattgatttcaatgatgtcttttcccctgttgtgaagcatagttcaattcgcactttactcagtattgttgcaatgcatgattatgaactagagcaaatggatgttaagactgcatttttacatggggagttagaagaggacatttatatggagcaacctgaaggttttgttgttcctggaaaagagaacctagtctgtaggttgaagaaatctctttatgggttgaagcagtcacctagacagtggtataagagatttgactctttcatgctttctcagaagtttagaagatccaattatgatagctgtgtttatctcaaagttgttgattgttcagctatatatttgtttctttatgttgatgatatgttgattgctgcaaaagacaaatcagagatagcaaagttgaaggcacaattgagtagtgaatttgagatgaaggatttgggtgcagcgaagaaaattctcggtatggaaattactagagaaagacattctggcaagttatatcttagttagaaaggttatattgaaaaagttcttcgtcgtttcaatatgcatgatgcaaaaccagtgagtactcctttagctgcacatttcagattatcttcatattaatgtccacagtcagattatgatgttgagtacatgtctagagttccatattcaagtgcagttggttcacttatgtatgccatggtatgttctcgtcctgacttatcacatgcattgagtgttgtcagtagatacatggctaatcctagcaaagagcattggaaagctgttcaatggattttcagatacctacgtggtacatctagtgcttgtttacagtttgggagatctagagatggacttgttggttatgtggattcagattttgctggagatttagataggcgaagatcactcacaggttatgttttcactattggaggatgtgctgttagttggaaggcaagtttgcaagcaacggttgccttatctactactgaagcaaagtatatggctatttctgaagcttgtaaagaagctatttggcttagaggtttgtacactgagctttgtgaagttacgtcttgcattaatatattttgtgatagtcaaagtgcaatatgccttacaaaggatcagatgttccatgagagaacaaagcacattgatgtgagatatcactttattcgaggtgtgattgttgaaggtgatgtcaaggtatgcaagataagtactcatgataacctagctgatatgatgacaaagccagttcctgctactaagtttgagctttgctcaagcttggttggtgttacagtatagtcctagagactatttggcgcgcggtgattttacctacatgaggtattttttggtgattgatgtttttatgctacaagaggaaattcgtctcaaggtggagattgttaaatatgtgattcgaattttgggcccacaatatattcggattagtttcctagtaggagtcctattaggtgtctttctattatcccctatatatactcttgtaagccgtatgggaaggggtgacgttcccattgtgattcccctacgtttgtaatcatctcctctatagtgatcattgccggtcggcgcccgtggtttttcccgcaagggttttccacgtaaaattcgtgtctccgtttcgcatctattttcataacagtagctaaatccaatagctgaatcacagcctaaggatatacagtatatgaattacgaaaggctgggttatctgtcctgtgtgtttgcaatttctaaaagcttttgtttttttgaggtgcatatgttggtcatgagcagaccactgataaagttacatgggtttctattctagttaaggatctctccttcgtgactttggtgtacataacaagctaccaacggtccctaaaataagttctcgcaaaaaagaaaaaactagctagcaacgataaaacggtagtaagtcatgcatttttccagatgctatcactgatgtgttggagtttaatctttcttaattacataagatattagcccctatatatgatcacctctgcttaatgcaaaaattgatctaactgatgatcttgtttttgaaagccattaagcatgtatttggttttgctgtttttccttttgcctttctcctcctccttctgttcttgtagttagtagaggaagctggggcggcggcttcaaggacgctgcaaggggtgcctgctttttgtttatgaaaaaaaaacctcccagagataccttatgaaccccttgcagtgtctaatcgatcgagcgattggatttagattttaggggtagagagaactcaagggttatagagaactcaaacgtcacttatgcttctcctcttctttcttttatatgtgatgctggtgggggtcacgagtttattttcaattaaaatttaaatccgatttttaccgataaaaaaaagatattatctcttatttgtttcttgttagctagctagtgtcacgcccggaatttctatccaaaattccaaacgcttacatgtgtgtaaaccctcgtccaggaatcagccgaggcacacaataacaaattgataatagagtgcaattattactctaattgataagcgaatataaagtcattacagaggtagatagttcctctcaaacaataaagatctaagcagcggaaaataaaataaagagcgcaggcgactccatcccacaagcagcttgaccagggctacgcctaaccctccacaccttcagcatcactgtagaactcctcctctgatgaatgattgcaaggtgagtatatgacatactcaacaagccacgcagcaaatatgcaagtgcaggggataacaaaggatggcataaatagtctcatttgcataaatggcattcaataaatacttcagaatttagaaaaacagtaaagtatctaagtaaacaatattattccaacactatacaacatacccgttgcataggcccaaccattctgaacaaccattcccggctgcacagttctatctccaaaccaggaatataccattccaaaccaggagctaaacaagttattaccaattacagcatcatttattatggtgtgaggcatgagactaatcacgaaagacattgttagacccgcccataaccgcgggcacggctattcgaatagttttactctggccagaggtgtaccactgtacccacaagacacaacctcaacatcatgtcaactatgcgtcgcgatacttaacaagtacccgaatagagattgtgacaatacccttcgcataacacaattcaaagcagcgcaccattcctggatcataatcacccccttataaaacaaggcatggactccccagcgacccccgtgggcttatctccgccacttctcagtctggtgccccaaaatgaaccacactatacaaaaggtaaaaccgttgcccacgctggcttgtgattggcacggttaatgtttcacgaccgaaaatcgtgaaccggtccttaattgtcatcagcacgaccatcaaaaccatgtgctcacaacccaccattaccatgttttagttggcatcttaattaatcaacatatcatgattaaccatcatgagctaccattaagtcatcattaagtaataaatcattaattatcccattcatatgagctagtgtctctaagcatggctaagcatcctaattactttagctaaaaccatataatgttctagctaatccaattattaaccaggtgacaaagtataggcaatcaatataaaaaggctataacaaaggaaataggtcattcccacccggcgacattcaaaaataaatgcattatttgaatagaaacaataggtttaaacgggatcaacatgctcaaaggattgtctgggatctgtgtgacttgccttgctggccttggaacactttaaagtcttctcctgcaaattcggactctccgggaacgtcgcaatctaagcataaaagagcaaaatcaccaaaacagtacataaacaatcataaacagcacatgttgatatttttaaatgtagatctcaattttagaaaaatttagagacttgaaccaactaaatccgagctaagatgaattagttatgaatttttaaagattaaaccggattaaatcatttatatagattttaattggattatcacgcaataaagaattatttttgaaaaggaaaaatgatttattgcatcagcgggctcgggttcacggtggaccgggtgcacggaaacggtctacggaacgaacggctaggatctaatctagacaaaacggacggccgagatcgacctaatccaccacgggtctacggctgacgtggcgctgacgtcgacgatgacgtcatcacaggcggcggctcggcatctcacgctcaccgacgaacgacggcgcggcggcgcaaacggagggcatctacgcgtagagggcgacgcagcgaactcacagagggctcggacgatgacggacggcaaccgacggcgacggcggcgaggtcgaagcggcggaggtgttcgggtcgacgacgacagcgatgctccggcgatcctcgacagaaacggaggacaggactaggacggcgatgacttggcgaacccgacggcggccttcccgagcgacgacgatgaccagagcggcggcggcgcacggctggacttgcggcggcgacgacggcgcagacgctaacgcggctagagctctaccggcgatggaaggctaaggcgaaggtggcggcggacggaggaggtctcgggggtccttttataggggctagggggcgacgtctaggcccacggcggccggcagcgacgatggaaagtttagggttggagggagaaaacaaatccgaatcgagatcaaatccggcgatttccaaacgaaaatagccaaagtttttgtaggggaaaagatagaggaggtcaaggggatcatttcccctctaccaatttgatcggatcgggaaaggggcgacggaatttggaagggcggcggcggcttgcgcgcggctagggcgcggctggcggcgagaggttgaagacggccctgacaagtgggccccacctatcagcaagagagaggagggagagcgtggcggactgggccggcttgggccgggcgcgcacaggccggggagagagagacttgggccgtctttcggcccaaagccaaaagaggacttttaaaacctttttccttttaaattattcatgaaatgaaattttatttattaaaaatactttcttggctcaaataaatcccagaaaaatctaggaactatagaatcaagagaagtatttaataaaattttatctagcccacttttatgttggaatttattacttaaaattagatcttttcttctaggcttttaaaatcatttttaataattctatttaaacaacaatttatacatttgggatttttaggctgtgacagctaggaacggactagggagattttatcattttcctaactaaccgatagtagccaacagtttctatcattacgtgactgaataatagcgcgcaatttgaattgaaatagcatcatcatcagacaaattttgtcttttgctgtgccataactagcgcttaagcaatacaaggaatacgattacttacttttaagctttccttgagcatgatcataacgacgaaattaagcactctaatgctattcgggcattaagccatttacaactttacaaaaagtcttccaggtgattcaagtttcgtgtgttaaaattaagtaattccttcatatatgcttaaaatgtttggcatgttttgtctgttcaagattgtacagtaggagtttttgccggccggtcggcctaattttacaattatactagctagtatctttcagaaaataacatagataaggcaactagctagtatcttctaataacaactggtttatcagaagatagactaggtcatcaggacattaactttaacttagttgtatcaaaactttcaggacattgcacccttagctttagttgtatccaaactttcaagaccatacataaggtcatcagaaactttcaagaccaaacatgaggtcatcagagatcaaactagctagtcaaacagaagtaaagttcacaaactacttactgacgagccagggttatttctcttgctgagggaggaacctcgcaacaagctccatgagaacagacgggcaactgattttcagatgctcataatcatcactggccatcatcctctcaagattggagcgagaagcaaggaactcaaagcaagcttccttgagtccatagcaactgtgctgctcagctagggccaaagtggtagccaccatgttggagtcaatgtgctttgatagcttctcctcgcatattagcttcagcctcccgacattgtaccgatctgctgccacaactaggtgctgagccatcacaatattttgagcagtctcaggcagtgagtcagtgtagatgaaatgcaacaatgctctgaacaccccagcttctatatcttcaattttgatggtcctacgggctttagcactcatggcgccaaagaactcagctctgaagacagatgaacgagcagcgagtatgcacttgtgcgctgagaatatatcctgaccaacgttgaacgtcacgtccgtactatccatgttcttcaagaggaggtctcccagatgctggtgcaggtcactaggaggaaccaccacaaactgcttttgtgtggtttctttgctacagatatccttcatgacagtcaaatcgcacatgatggagaatgaatcgttgctcaaatgtactgagcgttccaaatcagttttcttcatgaacttagagtggccccaatctgaacctttttccgtgaaggtgtgtaaagggtacaatttgctgtataattgcactgatctaccattcttgtctagcaatgcaaagctgaaggttgccttcacgcccccggcgcaagcaaaatcaatggtcagaaaaaccgacaggtaatccttactctctgtgttaactccattggggaagtatgtgatgaaccagctatgacctccaacactgaatgggatagatgaaacatacttgccattctccatcagctccttggtccttaagtatccatcaatcttgattacatgcgaccctcttgcaacttcagcaaccgtgacagaggaggtgttgttgcaatggtttgccattctggaggtgagctatcagctatggtgtttacagcagcagcagttcagttgtacctatgtcagaatataagtaagtaaagaattttgagtagtttactgaataaaaaagtccctcaacaagaggcgggcccaccgtgattcaaaggtattcaaatgtactatctactaagtggcatgttgtacgaccatgaaaatccacccgtaagaagttacttatacttaatatatgtacaatgaatagtatttaaaaatagtaatatttatcaagagagttcacggtagataaaaccaagcaggaagctgctaattcattacgttgattcctcacatgaataattaactggaattgattaatggcaatgtatatgtaaaggtagtaacaacacaacactataaaatacttctctctagcacaatatatatattcagataacataataaactattattacgatatattaagttcctgttaaaggtatgttcttctataaatggaatataaacagtatagtcatgtcttaagagtacaataaataaattaactattataaagttaaataaattttaaacaacttttaaaaattcatatatagaaaatttatataaaaattgcaacgtttagtaagtagcatatgacgctaaatagaatgtgatattcatagcaattgaatgtagtagaattcgcctattctttcgatataagagatgaatccattatccacccaacgattggtgtttacggcagcagttcagtttgtacctatgtcgagtatatgcaggtaattaaagaattttgagtacttagtaccaaataaaaaagaatcccctcaacaaacaaagtacagatcgagcaacttttcttgaaccagatgcatgatgttctcatcaaactatcacgagcatagaaaatcgaaggatatctgaagccaagatgcctgttctttagacatagcaatctgaattctgaaagaccaagcatatatagtacgattcctacaaagcaagacattcgagaatgtatgttacctttcttaaatattgttctggcgtgccaccgcgcgccgcccgccggcgccgggcttcgagcagatggctgaaaagcactgcagtaacaacgtgcgacgtggggagaggggggcgacggcgacggcgacggctgcggcggagtgaaggttggcttggctgtgcccttccgtatcctctgccgtttgccctccgtactaaccatagagataatctcaaccctttattttaaagggttgattagtaatatagtactacagattagttgtagattagattgaaatattgcagcgtgaatgcgtggtggctgcgacgccgatcaccactaggaggatctttgatgccatacaccaaaatttatctgctaatactaatatgtttgatcaatccaagttcttggttcttgcgttgttgttgtgcgtgtaagtgttttatatgatgttaccaggccaaggtgcgatttgattcatagttaagtgtggttattcttatcgccttaattaggtcgattagccaccaggaattaaggttcgttgatatgtagttcttttttcgttgcttctaataatggcaaatgaaccaagtgcagcaagggttagtgagtgtaaaggacgattatgccctccacgaataattttcctggacaaaaatacactccacaattctactaccattaattaagtgtggtggtagttagaagtagatctaaactcttcaatcaaataagatcaacagtatatattactttctaccataggtacagtgcatagtagggagcaccggagtgggactcctgtatatatggttctctttgctgttgagaaatcgttgatcttacctttccaataaatggcgaggataatcaagacttgttgatttctttcttctggtagtacttttcctttatagaacaattgtgcatttaccatttcatcccatttcaaaacacggttctctagggcaatgttgtatgttgtataaaggcatacaacacttcaatatcatggggctatagtgggacagaggaagataaatcggcaaagaagtttcgtggtttggcttccttatcacagttggtgcagacagtggcgaatctagaaaatcgattcattggtgtcataacgtgtctatcggtgtcataatactaattatgcttagatcatggtgttataacatatggataagcaatttcgctatagattttgctgtaagttatcggtgtcgcctgacaccggcctttctactgtagatccgtccatgggtgcagaacaccatttcctttccttttctggtatctttattggatctccagaactttaaacaaatcaacaaaacttagaacttgaaatcaaaacttcatgtccaaaatccaaagcgttcatctaacaaccaaaaaccctttatttcaacccaaaatctaccttcttataattctcaaaattataacacaaactatcaaaagtttcaacccaaatcttcaagtttctactcatgaaccaaactttcaacacaaagtcacaaaactttcaagcaaagtattcacaactaatacggcggaggatggcggtgcagagtttctattctcccggatctaagaaaatctaaccaatttacaattacagcattttagtatatttcagaaaataacataaataatctacagataggataacatagtaaaaatatatcattccacacatagaaatactcagtagagaaaatggtaagaagaaccaccagttgattcaatattggaaagactaggtagattgaaggtcgtagacaaaactagacatgaggataaattcaacatggttgtcccacaacattcaggatattgcatccttagnnnnnnnnnnnnnnnnnnnnnnnnnnnnnnnnnnnnnnnnnnnnnnnnnnnnnnnnnnnnnnnnnnnagagagtcaattcatnnnnnacccacg

SEQ ID NO: 3959 - DNA, 10063 bp, Oryza sativa
  unsure (1)..(10063): unsure at all n locations
agggatttataacaatcaaaccgcttgtgctgcccatgaaggaccctttaggaacccccactcgagaaaaaaacttcatgtgcaaaatccaaagcgttcatttaacaaccaaaaaccctttattttaacccaaagggtacctttttataattctcaaaattatggcacaaactattaaaaggttcacccaaatctttaaggttctactcatgaaccaaacttttaacacaaagtcacaaaactttcaagccaagtattcacaactaatacgggggagggtgggggtgcaaagtttctattttcccggatctaagaaaatctaaccaatttacaattacagcattttagtatatttcagaaaataacataaataatctacagataggataacatagtaaaaatatatcattccacacatagaaatactcagtagagaaaatggtaagaagaaccaccagttgattcaatattggaaagactaggtagattgaaggtcgtagacaaaactagacatgaggataaattcaacatggttgtcccacaacattcaggatattgcatccttagtgatcgaagtatctagtccaacagaagttgtactaaatttcaccagctacttactgaagatccatggttatttcccttgcagcttccatttccggagagatgaatctcgcaataagttccttgagaacaaatgggcaactaaccttcaaatgctcataaccttcactggccttcatcctctcaagattggcatcagaactaaggaacttgaagcatgcttccttcaatccgtggcagctatgctgctcagctagagccaaagtggtagccaccatgttggagtcaatgtgctttgacagcttctcctcgcaaatcagcttcagcctctctacattgtaccgatctgctgcgacaagcaagtgctgagtcatcacaacatctaaagccgtctcaggcagagcgtcagtgtagatgaaatgcagtagtgatctaaacacaccagcttccatatcttcaattttgatggtcctatgggctttggcactcatggcgccaaagaactcagccttgaagacagatgaacgagcagcgagtatgcacttgtgcgctgagaatatgtcctgaccaatgtcgaatgtcacgtccgttccatccatgttcttcaggaagaggtcgatcagatgctagtgcaggtcacctggaggaaccaccacaaactgcttttgtgtggtttctttgctacagatatccttcatgacaattacatcgatcttgatggagaatgagtcgtccataagatgtactaagccttctaatttaatcagttttcttcaagaacttggagtagccgaaatctgaactttttcccgtgaaggtgtgtaaagggtgcgattggctgtatgattgcaatgatttaccattcttgtcgagcaacgcaaagctgaagtttgccttcatggccatggcgcaagcagaaccaagagtcaggaaaaccgacaggtaatctgtcacatcctgattttcgtttcaggatttataaattatctaataaattattaatagaatttatattaaatgttctttaatttacaagtgaagttaaatgtgggaaataaaaatttcctaaatttaaagcatggatggatttaattttcattaaattctccatgattaattatactctctgaaattttctcggattttttggagctcaattcctaaatgatacaaagaacagttcaataattatttaatcattaatgatctaattataattatgttaagtgcttttcttgtttaaaaatccttaaattataaaatgttgtttaattggaattattagaaatgatcttaaaagcctagaagagaagatctaattttaaataataaattccaatataaaaatgggctagataaaattttcttaaatactttgcttgattctatagttcctagatttttctgggatttatttgagccaaggaagtatttttaataaatgaaattgcatttcatgaataattataattgaaaaaggttttaaaattctcttttggctttgggccgaaagtcggcccaaaaccctctctctctcctccccggcccaagccggcccgcaaccgagccgccgctctcctctctctttctctcccgctgacaggtgggccccacctgtcggactcgtcgtcctcctcgcgccgtcgcccggccgaaccctagccaagttgcgccgccgtctccttccaaatccggctgcccctttccgtttccgatgaaatcaatagaggggaaatgatccccgggatcccctctatcttttctcttatggaatcgtcggctaatttcgtttggaaatccgtggattcgagttcgattcggatcgatctctctcctccgaaccctaatctttccttctcgtcgccggtcgccatggaccttcgccgcagcctccttgcccctttataaggacccccaagcccgccgctacccgtcgccaccctcgccttagtctctcgcagccggtagagctctagcgccgtgccgcctcgcgccgccgttgtcgccgccgctccagccgtgcgccgccgtcgctccagtcgtcgtcgtcgcttggggaggtcaccgccgtggtcgccgtcgcgtcgccatcctcgtccgcccctccgccgttgctgtcgaccgccggaacaccgctgtcgtcgtcaagccgatcgtcgccgccgctcttcctcgacgccgtcgccgtccgttgatcttccgccgccgctttggtcactggtgagttcgccgtgccgtccgctacccgttggtgctctccgttcgcgccgccgcgccgtcgttcgccggcgagcatgcgccgctcgagccgtcgccggtgatgacgtcatcgccgaagtcgtcgttgtcgtctctcgtagtccggccgtggaccggtcgatctcggccgtccgttttggatggaaagatctagaccgtccgttccgtagaccgttcctgtgcacccggtccaccgtgaaccctagccgctgacgcaataattcccttttccttttcaaaaataattcattattgcgtcataattcaattaaaacccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgttttggtgttttgcttctttctgtttagattccgacgtttccggagagtttgttttcgcaggagaagaatttgaagagttccaaggccagcaaggcaagtcacacagatacaaacaatcctttgagcatgttgatcctatatttaaattctctatttatttcaattgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaatttgataatggtgggttgtgagcacatggttttgagagtcgtgctcatgacaattaaggaccggttcacgattttcggttgtgaaacattaaccgtgccaaccacaagccagcgtgggcaacggctttaccttttgtatagcatggttcattgcggagtaccagactgagaagtggcggagataagcccacgggggtcgctggggagtccatgccttgttttataacggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggtcataggcgggtctaacaatgtctttcgtgattagtctcacacttctcaccataataaatgatgatataattggtaataatttatttagcttctggtttggagatagatctgtgcagccgggtatggttgttcaggatggttgggcctgtgcagtatgggtgtgctgttcagtgttgattaatattgatgattaattactctattgttttataattctcaaatgtttgctaaatgctgcttttgcaaatgagccctatattatgccatcctttggtatccatgtgcacttgcatatttgctgtgtggcttgctgagtatgtcatatgctcaccttgcaataatcaatcaaacctcagttgaagacaagttgcgaaggagaagacgttcggcttataccccagttgagctgcctgtgggagtggagctgaagccatcgctagaccgttaattccgctgctgtttttcttttattttgtaagtatgtaactttattattatgatgaatttgtatattaaattgtcagtttgtgtacctcggctgagtcctggacgaggattttatgcacaaataagttcggaaattactagtgaatttccgggcgtgacataatcctaactgtctgtgttgttcccattgggatagtatttgatgaaccaactatgacccccaacactgaatggaacagaagacacatacttgccattctccatcagcttcactctcgagtatccatcaatctagactacatgtgacccgctcacaacttccgcgacaatggcagatgacgtaatgttgtttgccattgtggagaggtgggcagtgggttatggtggaacactagcagatgaggaaatgttttgcggtgccactgtttatgtttagtaatgtagcggtgggaactgagaagttaaaccggtcgaaagatcgatacatttcctcgatcgaaattaatgatgagctgatgataggattagactatggactaagtgagtaaatcgagatgcatatcctcgatcgcatggcggatttcaagtttggctacacgaggagactccaactcgattgccaaggtatctgtgaattcgtttcgtttcttagttctctctttctgatgtattcaggccttatttggcaagcccggccatgattccctggccatcatatctctggggataggccgattatggcccagcccatgtgcaggacgccggtgatagcagcgatgccatgagcatatttcctggtttgaaattctgagcgcggctcaaaagaacaccaatagagatgataatatttcccggtttcaatacattatcaaattgaggaaattttaaaataaaaaacatcagaaaataaaaataagaaattgagaagacttgttttatctcattttatctgtactgtattttcgtatggtcgaaattcccctagcctaccctatcttcttcttcccagccaacaaggaattagattttataagtattaaacatagactattaacaaaacacattccataactctggactaatttgcgagacgaatctagtgagcctaattaatacatgattagcctatgtgatgctgcaataaatatatgctaattatggattaattaggcttaaaaaatttgtcatacgaattagctctcatttatgtaattagttttataagtaatttatgtttaatactccaaattagtatccaaacatccgatgtgacagggattaaagtttagtccttggatccaaacaccacctaaggatggtgcgataaagagagagcaaggactccggaccatcgaggatggggctggtggtttcctcctctccctcctctcccctctctctccctctctccctctctctctctctgcgcgccggtgatcccctcccacgacgcatcgtcaaccttgtgcttctccatctcggttgaggagtgccgaagatgctcctccccctggggtcgccgagctctagttggggagtgaatcggtagcctcgtgggcatgaagccatcgacgagcccaatcaccccaagcagactccccatcctactggcaagcccaagctactccttgccgatttcatgggcatcgctgacgaggaggaacaagatttgaaggaagagctcatcgacaacggtgctctcgccgcccgcacacagccattgtccgccaccgccggcgtcgcctcgccctgtcaccgcatgcggacagccatggctcaccactcgccatcactgcctttccctcttgccgtccgcacacatccatgcccgtccgccaccgtgggcatcacctcgccctctcgccgcccatagacagccatggctcgccacccaccgtctttgcttttccctcttgccgccctctttgccccacgcctccacgcacccatgcccggagagaagacaggagaggagaagcgaggtgggtagaagatagaagataggagaagagatggagaactgacgtgtgggtcccacatgcatattgggggcctcatcttttcgctcatgcttcagctaaaatttaaattttttaccttaaatttaaagttgatttttggattttttttatcgaagtttgtttttcatcctttgcttttagatagctaagaacatgtataaaagtgctattcacaaatgatttttcatttgcaaatataagcgaaataatccgtttctaggtatttttgttcatctaaaaatacggtagcaaaagaacaattaaaaacatgattgatgcatataaaatggtatggatacaattttagaggtatagcaatggcatagttacaaattacctttggcatttttataatgatatggatcaaattaacccaaatatcaaggaattgtattaactttatttatgttttccctaaatattcaagatatgcatggcatccttacagatggaattactcaaaagttaaaaagaaaaaagaaaactacctaagagccatagttatttgttttgctgctttcatttcatgaggaagcaatctcgcagcaagctcattaagaacagatgggcaactggttttcagatgctcgtaaccatcactttccaccatgctttcaatattagatggagaatcaattaggaacttgaagcaagcttccttgagttgatgacatctgtgctgctcagctagagccagattggttgccaccatgttggagtcaatgtgctctgatagcttctcctcgcataccagcttcagcctctcaacattgtaccgatctgccgcgacaagtagttactgagccatcaccacgtcttgcgacgtatcaggcagcaagtcagtgtatacgaaatgtaggaatgatctgaaaacgccagcttccatatcttcaattttgatattgctcctacggggcttcgctctcgtagcaccaaagaacattgcctcgaagacggatgatcgagcagcgagcacgcacttatgtgccgagaatctctcctggccaacgtcgaacgtcacgtctgctccatccatgttcttcagcaagtcgcccagatgctggtgcagatcacctggaggaacctccacagacggcttgggcatggccggggtttccttgctacaaatgggcttcatgaccgtgacatcgcaccggatggaaaatgagtcgtctctcagagattctgatgctttcaaatccttgctcttgataaacattgggtagccccaaccggtacctctaagtttgaaggttttgacagggctggcgatgctgttcagtagcaatggtcttccattcttgtccagcagtttgaagctgtaaattgccttgacgtccctggcaaaagagtccagaaacaggtacaacgacaggtattctctacactccgtagattgaccattgggatagtatctgatggtccaggtgtagccagcaacgctgaatggggtagatgacagacactcttcattcttgatcagcgccttggtttttgagtatccatcaatcttcattacgtgtgacccgctcacagcttcggcgacaatggcagaggagatagtgttgcaatcatttgccattatggaggggagctatcaactttggtggtggaacactgacatggaaattaaaaggttaatttgctgtgtttcttatagatgcccaaagttaaaaccgattacaagtatatattaaaatctaagtaaaatcacacgaaagattatccagggtagaaagtatttgcaccaaccgaaggatatttgaacaaggaatacagtataagttcagttaaagcttaacaaacagaaaatattcttacattatcagaacgagcatcgcaaatccaagcatatttgcagccaagatgcatgttctaaacatacgtattacccctccgtcactaaatatttgacgccgttgacttttttaaacatgtttgaccgttcgtcttattcaaaaaatttaagtaattattaattctttttctatcatttgattcaatgttaaatatagttttatgtaagcatatagttttacatatttcacagaagttcttgaataagacgaatggtcaaacatactttaaaaaagtcaatggcgtcaaatattcagtggcggagggagtacacagcaatctgaaactcaaagcatattaaagtttcaagagtgtgtacgtttgtcaattacctagttatatgtcaggacattggattaggagtggggaattcttcaggaaaattcagtaaagatggtggtcgccgcaagactcgaacgctgaagaaaaccctaattttactcctactcctaaagacaaagatatagtagattcatttcctgcttcattatgggctaatagccgctataagtagcatacaaatattattacacagctgtaaagctagagttaaacaaccacatgaaacagagcatcttcctctgtcccaaaaaagcaatgacaacgacaaaaacgactacagtggtcccattttgatcttcttttccccttagctctgatcttttctgaacttaactgaagtttccttcccaactctgaaactctgaacttaatctcccatttctcaactcctgtcttgacaattgcccccggttaagttggaccttgtcctcaaggttcaaaagaaggaaaagctgactgaatataagtcgcatcctcctaggtcgcatcagccggcgtcaagttctgccaaagaataaggcactgaattactggttcattgtttcttggaatcatgcgcctttgcaacacagcgactggttcagtcttaatctgtccctcaggacctactgctggcagattaggcataggaacaacatgctgtcctaaatgtttcttcaattgactcacatgaaacactggatggattcctactccttcaagtaattgcagcctgtaagcaaccttccccaccttttcaataaccttgaatagcccatagaatttagacctgagtttcagtgatcccctaatgccaaacgcagcttgtctatagggctgcaactttaagtacaccatgtctccaacctccaacactctttcagtcctattcaaatcggcataatgtttcattcttctctgagcttcacccatgctatccctcaatttctgcaaaatggctgctctttctttcagggtaacccttgcttcttcagatacattgcatggaattgaaaattcattcacttgtgggggtggatacccatacaaagcttgagtattctatnnnnnnnnnnnnnnnnnnnnnnnnnnnnnnnnnnnnnnnnnnnnnnnnnnnnnnnnntgngatagaccgacgatcatcaaaaggggccaggctgggggggggganggannngggnattgaaaagaggatttatctcagttacaaacaattaatgaaaccgctgaagtttgagaagganttgtgctgcaaccttctacaacacgcgtagtcgtcgtaacacgattcgttgcggac

SEQ ID NO: 3960 - DNA, 706 bp, Oryza sativa
  unsure (1)..(706): unsure at all n locations
gtggataaaagcnnnnnnnnnnnnnnnnnnnnnnnnnnnnnnnnnnnnnnnnnnnnnnnnctcaacttcttcacagctgcatccggtttatccaaaatgcatcttgggctatggaaatgctttgcctttgtggaggatttgtgtattggtgcatgcaacgaccttgtgcattggccaatggaggagctcatgagcttgattcaccttcgatccctgtctattgaacactgtgataaccttgaaggaaagggttcatcatcggaggaaatcatgccactctactatctagagaagtttcacatcaaagactgcaaaagtctattggatattccgacgatgcctgcatcccttgaggagctgtgtctgctactttgccccagattagtggcactgccttcgaaccttggaaatttggccaggctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgc

SEQ ID NO: 3961 - DNA, 2130 bp, Oryza sativa
  unsure (1)..(2130): unsure at all n locations
cctcagttgttgattgagcaacagaagtattgcttacgagagcacaaagagaccaaagaggtcgccaagaaaatgacaagtgctagaggactttttgcgatcattttcacccccagcaaaatcagcatctgaaaaagctcgaactgaaagggcaaaagagcaggagttccaaataccgtactcaagtgtagacttgatgtagcggaagatgcgcttgactgcttggcgatgtgatgttcttggagaagcctgaaacctcgcgcacaggcacacggagaagtggatgtccggccttgacgcagtcaagtagaggagggagccgatcatgcttctgtactcgcgctggtcaacttcttcatcgtcctcatcaggaccaagcgatgaagtagttgccatgggagtagcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttgaaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctaatgtgccaccatcaatctcctcagctgctgaagatgatgtagttggtgcatctcctgaaggtgatgtagtcgaaggagaaccggtttcttgcactggtggtgtactgtctagaggtggaggaatagaatcatcatcatcatcatctgaatccacatccacaaagatgctttcatctgaaacacctgaatttctgggtctagctcctgggctagcctcatcaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatttgagctcatatggcgtcttgtgcaagatagttctcaaaaacacacgattggagataaaacaagcagcagaaatagcttcagtccagaattttcttggagtcgtaaactcatcaagcatagttcgtgccatctccacaagggtgcggttcttcctctcaaccaccccattctgttgtgggacatatggcgaagaaaactggtgttcaactccagaagaatcacagaaagattcaaatgcagaatttttgaattcagagccattatcactgcgaatggctcgaagagcaccaggaaactccaaagccaaactacgagcaagagactgaaagaagccaaatgtttcctcctttnttcnngtnggtncatgccctccaggtgacgn

SEQ ID NO: 3962 - DNA, 806 bp, Oryza sativa
  unsure (1)..(806): unsure at all n locations
taattttggataacaaaaactgaaagaagtgtctacaaagaggccacccgatattaattaaattttagattaaaaataatgcaaaattatattttaatgtgaattttaagtaggaatatataatatagaaatacctgaaattacaattaaaaataaataatattgaaatataagtccatttggaacacaatacatgattagttaaatatctgaaaaatataaaataaattacaaaattggattttactaatttcaaataaacttaaaaatcacaggttcacctctgacagggtgtttcagtgcccattatgcatgatcatcggtgacggggtggagtttagaaccgacaaagatgtatgtcatcagttacaggtgtttgttgcgacccgacaccgatgaggcttttcattaaaaaaacaaatcggttttattggctagcctcaaatgctagccacgcccgctataaaattcgcagtattcctgcaacacataacttcccccatagtcccatatatttgacattcacatacaaaaataagattcagaaacgaccacaacacataaattcaaaacctcagatgcatgcaagtctcaatagttggattacctcaattttttcaattctctcaacgaccaatacctttgatttcttaccttacaaaatcaccgaagcatcttcaaatgagaaccatcaatcacaacatgtgaatgcagttannnnnnnnnnnnnnnnnnnnnnnnnnnnnnnnnnnnnnnnnnnnnnnnnnnnnnnnnnnnnnagactggaggtccatcattngggccac

SEQ ID NO: 3963 - DNA, 10882 bp, Oryza sativa
  unsure (1)..(10882): unsure at all n locations
tgggancnnattgatgacatnnnnnnnnnnnnnnnnnnnnnnnnnnnnnnnnnnnnnnnnnnnnnnnnnnnnnnnnnnnnnnnnnnnnnnncgaatttgaaatgagcatgatgggagagctgactttcttccttggacttcaaatcaagcaaaccaaggaaggaatctttgtacatcagaccaagtactccaaagagctcctgaagaagttcgacatggccgactgcaagccaatcgctactcccatggcaactacttcatcgcttggtcctgatgaggacgatgaagaagttgaccagcgcgagtacagaagcatgatcggctccctcctctacttgactgcgtcaaggccggacatccacttctccgtgtgcctgtgcgcgaggtttcaggcttctccaagaacatcacatcgccaagcagtcaagcgcatcttccgctacatcaagtctacacttgagtacggtatttggtactcctgctcttctgccctttcagttcgagctttttcagatgctgattttgctgggtgtaagattgatcgcaaaagtacttctagcacttgtcattttcttggcacttctttggtctcttggtcctctcgtaagcagtcttctgttgctcaatcaacagctgaggctgagtacgtagctgctgctagtgcttgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggagtgatccacccctatggcttgatttgagggggagttgtttttcttttgcatgcatttgtaacatattgcatcatgtttactttatgcattgtattatacactcttcaattgagctttgcttgttatctcttggtcatcactatgctatggatgtatcactcttatgctagtttgatctcttgtctagctttcatttgcttaagtagcttgtgtgatcatgttatgctgttcaagcgtgttgaaacctgcttaaattaactattcatttgaactcaatcaatgtgcaatgcttgctctagaagtttgtttaaattgaagtatccatctcatactcatgccatgtttacattcttttcgcaataactgtcagtacatgcttatgaatgctcatgcttatgcgtccatactttgtatcaatcatgctttacaagatttatctctgttttgtccgggctactgagtgcgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaaattaaaaaaaatcataaaaataaaagtcatgagaaaagattaaaagctcatgttctatgctttgttatcatgttgatactctttatgaactgggcattagcacattagcatgggttcattgctttgattatgtaaatcttgcatgattatgagctggtttgcttccttttaagcttcttctagaaatagctttgcacactaaatcactaattcacttgaaagctttttgcttgctggcgatactaacttgatattcatgacttgtttcatacttcttatgcacatgcttagctaggcttgagcacatgcttgtatctgtgtgatccatgtctaccttttgatgcctttagataactctcaaagctctcaaaacctaaaatttgcaagtttcatctcatttttatcttgcatttttgtctcttttgatcttgatagcatcattgacaaagggggagagaaatttgcacttattgaaaattaaaacttgctttaaatcttggtgaaagggggagtttggcacatagggggagttttgcatttgcatccctttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaggaggtctttgcaacaggcttcacaaggtcaagtgtgcaagcatcggattcgcgaagaaatcagaagggactgtgcaagtgcattgctgctacagtacttgctgtaggtagcatacatgcatgtacacgtactgtacttgtgcaaggaggagcttgcattgtactggttgctactagcatggctcggtggaaaagtcaagctagctagctgtgcatgtgcgctgtgattggttggcagggaggccaagccaatctagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcgggaaaaccgtacgcggcaacctccgtttcgcgtgactcgatcggaggcgggtgcaggagcgcgggacccacacgcgattttgcaagcgcgcgcgggagcggctcagcggaacgcgtggcggcttcgggctggttgggcgctggcgagcgcgcgctgaggaaaaggagacggaacgcgcacgacgcggctaggcaacgtggcaagtttggattcgtcaagacggagagcacgcggattcatcagcaagaagaccatgtgaaggttcggatcgatgaggtggcaatcatctggagcttttcctttgagtagaaggaacaatggatggaccagatctgttctgagttagggtttcgccctaggggtatttgagacaatgtcttaggggtcttaggctataaatagagagatggatgcaagggtggaggttgctccttttggtaatcattttgagatgctcggtgagagagtttctgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctctcttctagtttcgggaattccttttctcttcctcctctagtttcgggaattccttctctcttctttttctctcttcttttctagatccggcttctctaatagccgcgattctagtaaggattttgagaaatccggcttgatgagtattttcgggggcaagatttgaattgctatattcacccccccctctatagctgttcttggtctttcacaacaactcgacgttgtcaagcagttggcatgctttatttgtagccaattcaatgatggatttcagaagggaaacaacttcaaagttgtctgacacacagtgccacatctttagctcgaagtgattctgaaccctgtagtcattgtagaccatcttggcgagcgttgtcttgcttaaaccacccatccccacgatgggaggttctcccacttgtgctgatctcgctgatcgagcaacagtttgatcaccaccgcctccttgtcgtcgtctctgccaaagatatcatctaattcatttgatggcagcactgagtacgtctgccagtaaggaagttgatgtactggctcatcttgcagcaacaggccaaacatgttcatctcttcaaccagctcgttgatgttcttgagcactttggcaagcttcctgctcatggtaaaacggaactcgagtggggtcatgcagcttcgtaccttgtgtcccagtgactcgaggctcatggcctcgcggcgcagcgcctcgtactggaactcgttgagcatgtcatcggcctcgtcggcggcggcgttgaggtctttcatccaacgcttgatggcggggttggtctcgctcttcaactcggcgtccgccagcagctgccgctctagcttagggcggtcgccgtcgacgccatacatgcgggtgactttctggacaagcacgtcggtcgccttgccgatcaccccgcacaccacggggagaagcagcgattccgccatgctccatggggactagttcttagctgcaagcctccctctgcaattgctctctttcacaggctatctgctactctctctgctacctacagatctagacaagtcaagatgatatttttggctgtcaccatattcaatgattcatatgattctcaagttgactgacttttgtgatgttgtcccttcacagtgcaggaatgtggcgagttggcacagctcgccacgtaggacagctgctaatgtggcagtggggaccatttctttgtgaggaatacgggactaggccttgttgagatcccaaaaattttgggccaaaacgtcacatcggatgtttggacacatgcacggcgcattaaatgtggaaaaagaaaaccaattacacagtttgcatgtaaattacgagacgaatcttttgagcctaattgcgacatgatttgataatgtgatgctacaataaacattggctaatgacggattaattaggcttaataaattcgtctcgcaatgtacatgcggaatctgtaatttgttttgttattagtctacgtttaatacttcaaatgtgtgtccgtatacttcaaaaacgttacacccctggaactaaacacatcctaacttgagacacgagaagctcaacggaaaaagcagataaaagcatggaatccaggctgtagaccatcatccccacctccccaccatcgaaacaaacctctctctccaccgtcggagtcactgtcgctctggatctgcgccgccactgtcaccctcggcgctctgtctcctcatcaccggcaggaagtggagggcaccgacgagctctcacgccgcttcggatcctcgctgccaccgtcgtcctctgagccctcgtcgctggccgggaatggaggggccccggaagctctcacgttgatgccgttgccctccgagccctcgttgccaaccaggagaggaggggccccggcgagctcccacgctgctgccgtcgctcgctgagcgctcgttgccggccaggagaggaggggtcccagcgagctctcgcgccgccgctgtcgcccttcgagccgctgtttgggaggaggttggggagccgctgtcctctgttggagctcgctgtgctgccagccgctgttgagttgtggtagttggggaatagagagaatgatggaaggggagaaattgtatccttggttctgaattttagggtgtttagtgctaaattttatacgttatgtagtttaaaaacatgtgaggacaaaaatagaagatggcaaaagctgacatgaaaagctaagaacacccttagggcattcacattgcgcccatgtggcgttcagcctcctccccaaaccaaatattcgttgccacgtcatccatccacatggcctcctcaagaacgcgaagcaagttttggctatgagttcttcgtctcaagtggtaggacccacacgtgctagaggagagaggggagaggagcgaggaggaggggagatgcagcggcgtgaagccatccccgaccacgccattgtcgttgcacccgtgcagtactcgaacttggccaccgccatcatcactcgctggtatgctcacccgagcgcaatggcatggagtgcagctccggccttcgagcacgatggcggggatgacaaacgaaggcgaaagaaacgcgccatggtggcaagggagggcccggcgatggtgacggtggcgccctacactagtgtgaacgaaggagatggatgagctgtaaatttgacgggagtggtatgaaatgaagaaattcgctatcctagtggtaaaatcttaatggcttacgaattaagtggtaaattcttaaatgtaagcgtattgaacgggagaagagtgggcggcggccacggctccgtgagatctaggcggcgcgacgcatcgcgcaagagagagcgagagagatgagtgcggcgatggaaccctagcggccgggagttttttcgttttctttttcgttttcttttttgacgcggctgggggtttccggagggggagagatggcgtgtaagaaaaggaaattctacgaaaagacccctcagtttccacgattcagggcgcggtccttttttctcatttttgtcacgttcgtattagatttcgtagaaatagaagggtctaaacgtaatatatttaaacaggaacaagtacggcgaggacatatatcaaaatagctataacggagagggcttttctgcaaagttcacagaatcatcgcggactcacgagaggccgtgaaatctactcgccgtcccacgcgcgctgacgtgccgtgctccggcagcatccacgccagcgcaaaactcggacgagcgagcagcggggggaggttttaatactttagatgctatgcccattgaaaaatgaaaatgaaaattaccgaggaaaatgagaagaaccgttttcgtatttatttattacaaataagcagggatgaagccagcaggtagacccgtatatcctaattttgagattcatgagagctttctatctatattgggcttatcgaagaagatgaagaggatgatctgtattagggagaagataaagtggtacgcgctcggtcaaattggttgatttggcgttacatagtgcgggcccataggtcacttgggtacttttggactactctctccggtttgaaatttgttggcgttttagctcttgaaccattgtattgtgtgatatttcttgacgttttagctttttttttttttttttgcatcttggacctgcttgccctgcatgcatgcagccggccattactcccattatttccaacgtcatgcatgctgcgcggggcgctgccttctattcgcctccttgcactacttttcgccatggagcaggtcgtgcaggacgccaccgctgccgtggagtaggtcgacgctggcgccatggtggtgaagctcgcacaacaggtggacggcgccgccgttgtggttgacgctgccggcgttgtgcatgagtgcaaaaataagtggacaccaagaatcgaacttaggactagtagctttagttttgcatgcgatggccactcaaaccaagagcaggttgtggtttggtgtacctcgaaaccgtatttgttaggggtaaaacaggaagtaggaacactaattaatcactcattggtatgtgtaatcctgtctaaaacgtcaacaaattaggaactgaagggggtaggaggttagaggtagcagcgaggcgtgattcggccttgttttgttcccaaaacaaaaattttcacgctatcacatcgaatgtttggatacatatatggagtattaaatgtaggaaaaaaacaattacatagattgtatgtaaaatgcgagacaaatcttttaagcctaattgcgccatgatttgacaatgtggttctacagtaaacatttgctaatgacggattaattaggcttaataaattcgtcccgcagttttctggcggagtctgtaatttgttttgttattagactatgtttaatacttcaaatatgtttccgtatatccgatgtgacaaccaaacccaaaatttttttccccaactaaaccaggcctcattcttcgaaattgctaattagcgcgtatgcgctattagcacaagcggcgcgagtttctggcccacccccacgcgcgtcccatctcttccttttttttcctttttttctcgcttctttttttttccgccgcgccgtgaaatgtttttttgccgattttttttgtgatctttttattttagaaattgaatctttcatctttaattgctgctgaaagttttgaatttgagttgaaagtttttaaaatttgagttgaaagtttttaagttttgagatgaaagttttcaaatttgagttgaatgtttttgaaccttagatgaaagtttttaaatcagagttgaaagttttcaaatcttaacttaaatagttgaaagtttttaagatttgagaagaatgtttttaagtttttagatgaaagtgttcaaatttgagttgaatgtttttgaatctgagatgaaagtttttaaatctgagttaaaagttttcaaatctttagttgaaagtttttaaatttgagtttaaagttttcaaatattgacttgaaatttttcaaataaagatttgaaagttttaaaataagagttgaaaacttttagatttaagttgaaagtattaaaatcttggcttgaaaattttgaaatctaagttcaaatctagacttgaaagttttcaaatattagttgaaaagtttccaaatcttgaataaatcaaagttgaaagtttgtttcagttaattaaacaaagggaagaaacatacgcattcttataaaaaaaaaacagcgctaagcgctcttagggccgtgaaagtgcgcgctgcctctgatgctagcgcttaagcgtgtaacaggaacccccctcattcatttggtatttgggggctagggttgggatggaggctatatgcctgaaatctacgaggcagatggtgtgaggtggcgatgcgaccacacaggggagagtgcccgaggcattaggctaccagcagaatgcaggcgcaagtcactggcatgggcaagtcaactggttctagtctattattgctactctgctcatctcgttcgctccttagctaataaccttgtgctaattagctaatggccttgtgctaaccaatgaggattctgtatttttctctagtatcttgctaatcaagaatgcacttttatgttggcaatgcactcctccgttttcttttctatttgattatgttaacattgaattcgatgtaggtaaaggtacgtactttactttgcttttattgacttagggcctgttcactttggcatagttgccgaaattttgacaacttgtcaaaattttgacagcatttcttatataattaccaaaatttaaaaatttgacagtaaactaaatgtagccaattttttagcaactttaccaaaacttggtaaggttgaaaataacatcaaatcaaagtgaacaggctcttagacttaaactttgagcctatcctcactatagtttgactagatgtccaccctagcaatctgcttgagagatactccatccgtttcataatgtaagattttctagcattacccatattcatatagatgttaatgaatctagacacacatatatgtctagatttattgatatctatatgaatatgtacaatgctagaaagacttacattatgaaacggagaaaatagaatcataaggcttcttccaccaatttggactatagtttgtaaggttgcacatagattttataatatttaattagattccttggtacgaaatgaaagtggttaggacattgtaataccaatttgttgcaggagctagcctgaccaccgttcaactgcgtctgcagttttattccttacctcgttgctcggaggcaaagatgccacgtgggataaaaccaccttcgaaactgctcggggagtcgatttgcaatgggttatacccgattttactgttgagggatgcgattcaatgaggggcatgagttgagggagtcaatataaacttatttctccaactttccgtcagttccccgtcccttagcacccacccccaccgtacgcacaccaggccaccaccaagaaacgatggagaaggcctcggtccatcaaagtagcccatctaccgatcacacctgaatttttttcatttttaaatttttatttttaatatttacagaaatattataccggcaaaaatatttacaaaaatagacccagggtgacgtgagagacagccgagatgcaaaagaaaaattagcaaaatgcatttttaacatggcgaaaattgcatttagccccttgtacgagggcggcaagagacctcaatgaaaaatgtgcacaccttgccgctctccactttggcggcaggggggccatttctgtaaatattttaaatggtataatatttctgtaaatattaaaaaataaaaatttagaaatgaaaataattcatcacgttctctttcttagcagactcaagatcgactttcagagaaatgcatgaagaacaagaatcaatagatttgatagaatnnnnnnnnnnnnnnnnnnnnnnnnnnnnnnnnnnnnnnnnnnnnnnnnnnnnnnnnngtnngagaccgaggtcatcaatnnnaccac

SEQ ID NO: 3964 - DNA, 1013 bp, Oryza sativa
  unsure (1)..(1013): unsure at all n locations
cctggggcnntttgatggacactccgtctnnnnnnnnnnnnnnnnnnnnnnnnnnnnnnnnnnnnnnnnnnnnnnnnnnnnnnnnnnnnnnnacgctcttctccatcgacgagaaccccaccccgctgcagaccgccaccagcgtcctcctcaccggcgccatctccgtcttcctcttccgctccatccgccgccgcgtccgccgcgccaaggagctcgtaatcccctccctcctcatccacctgcgctgcgctttctcgactggagaaaaatggtctaaaaatcctttttgcttccgtgacacagagggttcggtccggcggggtggagaagcccaacaacctgagcaaggaggccctggaggggctgaggctggtgagcgcgtcgccgatcgaggtcgacaagccgccgtcgcccgtgcaggcgctgctcggcgggatcgccgcgggggtcatcgcgctcatcctctacaagttcaccaccaccatcgaggccgcgctcaaccgccagaccatctccgacagcttctcggtcagctctcttccccctccacaatattttagtatttttcttgttgcaacaatatacatgttttttttacagcacattaaattgatttaggctgtttagggctcctttcaaactaaggtttctttgagaaattttttagaatatgaatatccttttaggaagatttgcctatgttctcctttggaacaaaggaccgaaccctttgaacttccattggaattgccaaattcatataagttttggaggaaatctagcatgagtaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3965 - DNA, 741 bp, Oryza sativa
  unsure (1)..(741): unsure at all n locations
ggtgttatcgattactatanggcgaattcgagctcggtaccctgtcctagtgggccctcaagttgttcatgatgtaaccgaccacatcatccaatcaagacttaagttgtgtctcattgacttgacgtggatctaggaatctaacttgacttctggtcttcggtgcttccatccaacataaccttcaaggttgatctgtatggctagaagcattctacatggattgttattagctaagtttagtgttattagtacttacaatgagtagcactttgggagatcggtgtccaccgctcgtagcctaaagaggttgaaaagatcagagaagcccactatgatataactgggtggccccaggaagggcgcttggtcatgatgacccagtatggacatatcactattcttcctcttggagttcaatttatccacgtagtaccgacgcagctctcgagtaatagtgcccattctggctaattcattgtcttgatccaacggcatccctggccagaatgtgtcgtgatctaggatcttgagagcaacgtacacctccttatctagatctagccgtttgggaggtaaggacgaccctcctacctttccttttccttccaattttccccttccatgatttggcctgctagacaccatcggtggagatnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 3966 - DNA, 711 bp, Oryza sativa
  unsure (1)..(711): unsure at all n locations
gaggggattganattcgatgtcnatcccttgctcgcatgccngcatgtctactctataggatccccagtatggacatatcactattcttcctcttggagttcaatttatccacgtagtaccgacgcagctctcgagtaatagttgtgtaaaccctcgtccaggaatcagccggggcacacaataacaaattggtaatagagtgcaattattactctaattgataagcgaatataaagtcattacagaggtagatagttcctctcaaacaataaagatctaagcagcggaaaataaaataaagagcgcaggcgactccatcccacaagcagcttgaccagggctacgcctaaccctccacacctttagcatcactgtagaactccttctgtgatgaatgattgcaaggcgagtatatgacatactcaacaagccacgcagcaaatatgcaagtgcaggggataacaaaggatggcataaatagtctcatttgcataaatggcattcaataaatacttcagaatttagaaaaacagtaaagtatctaagtaaacaatattattccaacactatacaacatacccgttgcataggcccaaccattctgaacaaccattcccggctgcacagttctatctccaaaccaggaatataccattccaaaccaggagctaaacaagttattaccaattacagcatcatttattatggtg

SEQ ID NO: 3967 - DNA, 690 bp, Oryza sativa
  unsure (1)..(690): unsure at all n locations
gtgtgttaattccttaaatgtgcatgcacnanacacggngaannngagctcggtacccatatgcccaagacgcatatgccaaagattagtagcatcggaattagataatgaatcagaaactgctgcaacattacctaatatagttgtacctcgcagatggtacaggttagcatatttaatatcagctttcatcacaacaagagagcctttagttatcttcaaaattccgtctccacaggaatatttgtaccctttgtgatcaagagtacataaagagatgagacttctcttcaaatttggaatatgccgcacatctgacaatgttctgatacagccatcaaacatcttgatctgaactgttccaatacctgcaacctcgcatggtgtatcatcacccatcaaaacagtaccaccttgcacagcttcataggtggcaaaccaatccctattagggcacatgtgataggtgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgn

SEQ ID NO: 3968 - DNA, 763 bp, Oryza sativa
  unsure (1)..(763): unsure at all n locations
naacacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataagcccacgggggtcgctggggagtccatgccttgttttataagggggtgattatgatccaggaatggtgcgctgctttgaattgtgttatgcgaagggtattgtcacaatctctattcgggtacttgttaagtatcgcgacgcatagttgacatgatgttgaggttgtgtcttgtgggtacagtggtacacctctggccagagtaaaactattcgaatagccgtgcccgcggtcataggcgggtctaacaatgtctttcgtgattagtctcacacttctcaccataataaatgatgatataattggtaataatttatttagcttctggtttggagatagatctgtgcagccgggtatggttgttcaggatggttgggcctgtgcagtatgggtgtgctgttcagtgttgattaatattgatgattaattactctattgttttataattctcaaatgtttgctaaatgctgcttttgcaaatgagccctatattatgccatcctttggtatccatgtgcacttgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 3969 - DNA, 747 bp, Oryza sativa
  unsure (1)..(747): unsure at all n locations
cgtctgtggagtttcctccaagttatctgccacaaacatctggggcgactttcttaaagaccatgtatgaagcagacgtaactttcacgtttggcaaggagaattctcggcaattaagtgcgtgctcgctgttcgatcatcagtcttcaaggcaatgttctttggtgctacgaaagcgaagccccgtaggagcaatatcaaaattaaagatatgaaagggggcgttttcagatcattcttacatttcgtatacactgacttgctgcctaatacgtcgcaaaacgtggtgatggctcagtaactacttgtcgcggcagatcggtacaatgttgagaggctgaagctggtatgagagaagaagctatcagagcacattgattccaacatggtggcaaccaatttggctctagttgacaagcacaattgtcatcaactcaaggaagcttgcttcaagttcataattgattctccatctaatattgaaagcatggtgaaaagtgatggttacgagcatctgaaaaccagttgcccatctgttcttaatgagcttgctgcgagattgcttcctcatgaaatgaaagcagcaaaacaaataactatggctcctaggtagttttcttttttctttttaacttttgagtaattccatctgtaannnnnnnnnnnnnnnnnnnnnnnnnnnnnnnnnnnnnnnnnnnnnnnnnnnnnnnnnnnnngagctgnnggtcagttcatcaaagggcccat

SEQ ID NO: 3970 - DNA, 1517 bp, Oryza sativa
  unsure (1)..(1517): unsure at all n locations
tcctcccccccagatccgcgggtgccaggcctcctcccgcttaaattcgacagcggaaccggacggcaatggaagcagagggcacgacgccggcactcggctgacgtgattttttttttggatttttatttttgcatgcggcccacgtaagcaactacatgcgaaaatagcaatttagcatgcgggtgcaacgccctcatgcgaaaatcactatttttgcagaccttctcgtgcagacggcctggccatccgcttgcaaaaaccaaatctggctgtctgaaaaatctttttttaagtattgatagtctatacaaatgcaacgtgtgttgtccgccgactagtctaactgtaatagttttacattgggaagtccatcgagttttttaagtattgatagtctatacaaatgcaacgtgtgttgtccgacgactagtctaactgtaatagttttacattgggaagtccatcgaaccagatcgagaccaaactcgcgttatttttttaggcttgttagctagtgtcaagacaagataagttggttgtgtatgattaattaaatattagttattataaacttgaaaaatatgttttatttaattttttaaaaagctctatatagaaaaactattgtagtaggtcaggaagtgtgtttatagaaaaggagtggtagctgttaaatatgtgatccgaattttgggcccataatatattcggattagtttcctagtaggagtcctattaggtgtctttctattatcccctatatatactcttgtaagccgtacgggaaggggtgacgttcctattatgattcccctacgtttgtaatcatctcctctatagtgatcattgctggtcggcgcccgtggtttttcccgcaagggttttccacgtaaaattcgtgtctccgttgtgcatatatttttataacaagtggtataatagcattggagattcgatcaacaactatcccatcgtcgttctgcaattcggcgagattatccaccagcgcacgttcatcatcggcgacggcaggcgcgtgtcgtcgctcgtctcgtcgattcgtctcgtcttcgtcgtgctgcctacgcacgcgagaaaaaacaggaggagcagcagccggtctccacaccacacgtcgggggaggagaaaaagcagcagaaaccaatctaattgcgcacggatcccaaagtgaagaaaaagtagggcaagtcagtcagagccatcatcgccctgttctgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3971 - DNA, 740 bp, Oryza sativa
  unsure (1)..(740): unsure at all n locations
cggcattggagaacactgaatgctgcttgcaggncgactctagaggatccccaaataggatgtgacctatatatcttatgacaatgaggacaaatatttttttggacggatggagtcctctgtcttataatatataatatatgaaccaaaattcaaactttatctcaaaatataagaaatcctatagatatttattccattaattaattagtatttaatattttttaccatcttaccgacgatcacccatctaccactactcacaccctatttaatgagagcatcatgggctttttcttctttcgtaatctctccaaaagaacctcgagtgatgttggatagtagagcttgaatgagtctaagctggtgatggtggggtgtaacttttggttggtttttcacacagtttcattatatataatcatggaccaaccactatagttaataaaaaatccttaatttttcatgtacaatctatgttactacttcgtatttcactactgttctgcacttctatacaaaattgttaattcatgcaattagcacaggtaggagtacttcacaattgttggctgttagctcatttgccaaccgttagttcagacagccctcacctgtgtcctcacctaagctacctacctagagcagagtaccctatgcaaaaatgggaaatatataagcctatttctcgatggggataaattgttcaatcgaaagagatgagtctggtgccaccgttt

SEQ ID NO: 3972 - DNA, 962 bp, Oryza sativa
  unsure (1)..(962): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaacattaaaagtatattaattttttcccaatatccttttcctagtgcaggactttgaagtagagagtttaagagaaatgctctcccaatcatcggtgtttgccggtgagtgggatctcgtagattatgtgtattgcacatgagtgtgggatggagtagatcgattacagacaatggtgcaatatagaagtgaggcaaattaaacccaatattatttattgtcagtgatatgccctaaaggcaatcatagagatgattgtatcacatactatgtttacatatttatccaacattgttccttgaaatagataactccttattggttaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3973 - DNA, 771 bp, Oryza sativa
  unsure (1)..(771): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatatgaatatttcccaaagtctaaagttgtaaaaccacctaaggttacctaattaaagcgaagcatctacctaaaatttatactagggataccatgagtaaagtgtccactagttgaggttttgcttgtctagggtgaacaaggtaatagtaataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgta

SEQ ID NO: 3974 - DNA, 3234 bp, Oryza sativa
atcacttggaccttatggaatgctttgtttattgggaaattggcttcacaccgctccttctattcaaaatccccaaaatggttttagtctgggctcggggtgcatggtttttgatggtagcacctcggccatataaggaccggtcttcgggcctctgttgcaaagcactaccgtacttccacatgtctagtgggtaaggattagtttgtggctcagtctagttataaacaaaagtacacggatggagatggaagaagtcgggggtcgatggacatctccagggcaaatgaaggctacacgagctgtggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaaccaatgtctttaaatgctgtttactgcaaccctaaccctttatagtataaatcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgttggtctctgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagccttagcagtattttcgaaataaaaatcctctgttatttgtgaaaaccctctagtctttctctgtcttgctgcttcatttatcgccaaaatctgattttttttaaaaatgttgcttttctttttggttttgtttggagatggccggcagcgtcacccgtcgtggtttggacatgactggtttcgtcttggagctgcggggcatgtgcgttgtcctggggtatccacatggagtggactaccagggcaggcccgttccggagcaggaaggtgacgatgcagagccccacgctgcttgggaggccactgcagtgatcctcgctggctctcccgagcggacttcgctggcagtcaccgcgggtggagattctttccccgccgcttgcaaaagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgtcgtggcatggtggagaacaacatgaagatcctggagctgcgtcaggagaacttgcagctcaagaaggacctcgacgcgatggaggcgcagctgcaccagctcaagatcgcccagggagaggacagccgtcccaagcatcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgcctttttgagttgtgtggggcatggttacacaggtgtgtggtgtaactatgtcggagcctgtctttatttgtttgcctaagcaacttgaactctaatgaaccaatttaatagcagtgataaatttaagaataatagtagtcgcgggtggttagttttaatcgtcagctctctttctctgcttgctggttctgtgtggggttttcagatggtgacgaccaggagaaatgttaacaccggtgaaggcaaccaacccgagggcagcaaccccaacccccaaggcaatccacctccaccaccaccaccagacaccaacgccattctcacccagatcctcgcccaacaagccaacatgatgaatactttcctccaccacctccaaaacccgccacaacagaatgctccaccaccaccaccccaacactctaaactcgccgagttcctccgcatccgcccacctaccttctctagctccaacaaccccgtggatgcgttggattggttgcatgccgtggggaaaaagctggacactgtgcagtgcagtgatgaagaaaaagtcatcttcgccgctcaccagctgcaggggcccgcatctctatggtgggaccacttccaggctacgcagccagaggggcaaccgattacttgggctcgcttcaccgccgctttccggagaacccatgtgcccgctggagtcggggctcttaagaaaagggaattccgggagttgaagcaaggcaaccgctccgtgatggagtatttgcacgagttcaacaatctggcccgttatgccccggaggatgtgcgggaagatgaggagaagcaagagaagttcttggcagggaatgggacccctttggaaggccccttgggggtccccctttggggggggttttccgtctagtctctgagactatccggatttccaacgtctggtggacaagagcatccgcttggaagccaagcacaa

SEQ ID NO: 3975 - DNA, 981 bp, Oryza sativa
  unsure (1)..(981): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgtgctcatgcaggatggtcatgtggtggcctatacctcacgccagctaccggctcatgaaagcaactaccccacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctgggaaggccaacgtggttgccgacgctataagtcgaaaaagccattgcaacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgt

SEQ ID NO: 3976 - DNA, 860 bp, Oryza sativa
  unsure (1)..(860): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagataccctggaagcacgtaatgatctgaagcatatggaacaacgcggcgaccttcacccggaaccaaaggagaaaggaagccattacttgagtccagccagctatactcttagcaaggcagagaaggaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3977 - DNA, 1408 bp, Oryza sativa
  unsure (1)..(1408): unsure at all n locations
cgcgtgnaatgataactcattgtacanccaattcgtttggagctctcctgatcctagcttatcgantccttacccaatggctttgggcaactaagtggcttttaaatgctgtttactgtaaaacttaatccctatattattattcgcttgtacctcccttgcattaattatgcatccccggtgtggcttgctgagtactgtggttgtactcattcttgctcaatctttccccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaattgtatgccaaacttagcaagtgtgagttatggttgtccgaagtcaaattcttagggcacgtgatatctgctaaaggagttgctgtggaccccgaaacagtgaccgccgtcactgaatggaagcaacccaagacagtcactcaaattcgcagtttcttaggtttggcaggatactaccggaggttcatcgagaacttctccaaagtcgctcgacccatgacacagttgttgaagaaagaagagaaatttgtgtggagcccgcaatgcgagaaggcgtttcaaactctcaaagaaaagctggtttcctcgccagtgttaatcttgccgaatactcgcaaggatttcatggtgtattgtgacgcttcgcgccaaggattggggtgcgtgctcatgcaggatggtcatgtggtggcctatgcctcacgccagctacggcctcatgaaggcaactaccccacccatgatttggagttagctgcggtggttcatgctctaaaaatctggcggcactatctcattgggaatcgctgtgaaatatatactgatcataagagtttgaaatacatcttcactcagttggacctgaatcttcggcagaggagatggttagaactcatcaaggattatgatgtgggaattcactatcatcctggtaaggccaacgtggtcgccgacgctctaagtcgaaaaagccattgcaacactcttaacatccgtggcattccacccgaacttaaccaacagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccn

SEQ ID NO: 3978 - DNA, 1211 bp, Oryza sativa
  unsure (1)..(1211): unsure at all n locations
actacatgcccgctatatgtgcatgcagtagcctatcttcctactcactagcattctcccccttcagatggccccccttttttttttttttttacctaaaagcggttttttttataaaataggcttgacatgagttttcttctaaattatttatattcaatttacaatccgattatatcttgaatttattgttattaaatatgtaaaaaaagatatcacataattatattcttatgaaagatatataaacttatgttttaaccatgaaaattcatgttcatacgcgatactgaaatgtttcaacatatgtttcacataatctttcagtatttcaatcactattttttttaatgtttcacctgtggacaacttaaacatttcaccccccccccaaatttttttatggaaattaggtgcctggtatcaatttcatgttggtacttcctcccgttccgtaatccttgatgttttggataagattgagatcaacaattaaaactttaactatcaatactcccttcatttcacaatgtaagtcattctaacattttccacattcatattgatgttaatgaatctagacatatatatctatctagattcattaacattcatatacatcaatatgaatgtgagaaatactagaataacttacattgtaaaacggaggaagtaacttttaaaatatctagtttgaagaaactacaacattatgcatagattaattttgaaacatgcattaataaatttaaataatataataaaaatatagttaaaaatatgttctcgagaccgtattattgtccaacacgtcaagaaatataatagaactgaggggagaatttagtcagatggtttatttatacgaaattatcattaaaaatgcttcctatcggtctgctgataaagccaacagattgtgcctccatcttgcgcttgcactctctgcatccggcgcacctccactggtggagaaaccatctttcgtcggtcggccgatttccacaatagtcccggatgcaataaaaaccggggctaaagatgatctttagtcccggttcaaaagggtaacgggcatatttgatctttagtcccggtttgaagtaaccaaccgggactaaagatcatctttagtnnnnnnnnnnnnnnnnnnnnnnnnnnnnnnnnnnnnnnnnnnnnnnnnnnnnnnnnngcattgcattcaagcgcgc

SEQ ID NO: 3979 - DNA, 5097 bp, Oryza sativa
  unsure (1)..(5097): unsure at all n locations
nacgggcgaggagaaaatagctgctgatggtaacgacgttgcggatgatcttggtcagatgttgcaggacgccaggggggactgcgaaagtgaaaaggaggcccataaattgaacaagatgttggaggaccacagaacttcgttgtacccaggttgcgagcaggggcacaaaaagttggataccactctgtagttgttgcaatggaaggcaaaaaatggggttagtgacaaggcatttggcgatttattgaaactcgtcaagaacattcttccgggggggaacaaattgcccgagacaacgtacgaggctaagaagatagtctgcccgttaggactggaagttcataagattcacgcatgtccgaacgattgtatcctatatcgcggtgaggagtatcagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcaatggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtagaagatcttaaacagttgtggaagaaggaaggtgtccccgtgtgggacgaggacaaacaggaggagtttaacctacgagcgctgctgttcgtaaccatcaatgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcccacataaggccgaccaccgtacgaagcataaacatcgcagcgggaaaacagtgtttgctatggttaaagatcttaaagtagtgttcggaaaggggcctggaagccagcatataaaaagcgaagatggtcacgcggcgatgtgaaaaaagaactctatattttgggagttaccatattgggaattcttggacgtacgccacgcaatcgacgtgatgcacctcactaagaacctttgcgtaaaccttcttggcttcctaggtgtatacggaaagtcgaaagataccctggaagcacgtaatgatctgaagcatatggaacaacgcggcgaccttcacccggaaccaaaggagaaaggaagccattacttgagtccagccagctatactcttagcaaggcagagaaggaaagtatgtttgaatgcttggagagcataaaggtaccgtctggatactccacgaatatcaagcgaataataagcacgaaggagaagaagttcataaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacataggcgttctgaagaagtgtgttcgtaaccgtgctcgtccagaggcaagcatcgccaagggttatggaacagaggaggtcattgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcatggctacgacaacatctcatgggtaacaacttgcctttctggtgaggggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttcttccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagtatatgtgatacttacaatttttaaaagttttaaatcacacaggtggcaatttcatatgtatgttaattagagtttttaacatttaatttactagcattcatatgctaattaaaattgactaaaagggacttaagttcattaaatgcactgcacaatgaccatattaccccctaaaaccatgcaaagtggactgcaccatgcccttgttgcagcatgctgtttgctgccgctgctagcattttacaagcaaaccattgttgctgcatgacagcacaaccaaatgcaagccaaatcaatgtttgaccccaacatcacatgatttaatccatcataatttggacaaacacacaccttcagcaagccgaatcacaagcaataacccccacatcaatttcatcatcaatatcacagcccaatcacagaaattcaaagaagctcatatacatctcaagttgttgaaatacatcacagaagtttcaatgttacaaattacaagcactcatggttcaattgacaagttaaaccaaatacaattcacaagaaaaattgaaccattcattacattcctttcaaataccacaatccatcggcaatccagtcccgaaattggttcatgacacgcgagtccaattcgtttgttggttcgctagatggagaagaggttccacccaatggatcataattttcatcatggtcacaattgtcgaactctgtatcagccatttgactgtctctaatgaaattatgaagtgctatgcatgcatggataattctgctttgcttttcctgcgagtagcttggtaaactaaacaaaatcctccaattgttcttcaagaccccaaatgacctctctatgacattccgacaagaagaatggcagtaattaaagtgctcccttcttccccttggcaatgtgctttcgttgtactcttggaaatgatatgttatacccttgtatggtgctagataacccggcctatttgggtatcccgagtctacgagataaaactttcctgaaggtggctttggaaacttggcactaaatctagtttgtgcatcattgaataccctcatgtcatgaaccgaaccaggccacctagcaagtatcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaaataaattttagtggaatttttagagcacaaataataattaagaagaaataaacaaagttaaaatggttttataaaaagaaaaaccctaaaaagtccttttccccccccttcccctcttgggccggctcggcccacctccctccctctctctcctctcccccgcggcccaatcagcctcctccccgcgcgcgtgccgctgacgggcgggcccgcccgccaccctcactgacgggtggggccgccgtcatcccctacctcgcgccgctcccgccgcctcgctcgtgccctagcgccgccgccgccgcgaatcccgccgcctcccgccgtccccgcgcgcaataaagagggggaaatcattccccgtgattccctccctctttccccccacttttctctctctctctccctcggatttgttcggaaacgtttccccctaaacctcgccggcgcatcaatggcggccggatcttccgcggccgattccccctcatccggccgccctctctcactcccaaccctatataaacgctccccgtgcctccctccaccgtttccgccactcgccgctctctctccccgtcggaatcgagctcgcgccgtcgctctctctctccgccgtcaccgnnnnnnnnnnnnnnnnnnnnnnnnnnnnnnnnnnnnnnnnnnnnagctgtctatcggaatccaaanncccacg

SEQ ID NO: 3980 - DNA, 927 bp, Oryza sativa
  unsure (1)..(927): unsure at all n locations
ncatggtggggtagttgccttcatgagcccgtagctggcgtgaggcataggccaccacatgaccatcctggaaattttttggggaaaaaagggcccaaaccgggccaaccccccaattcctttggcggcgaagcgtcacaatacaccatgaaatccttgcgagtattcggcaagattaacactggcgaggaaaccagcttttctttgagagtttgaaacgccttctcgcattgggggctccacacaaatttctctctttttttcaacaactgtgtcatgggtcgagcgactttggagaagttctcgatgaacctccggtagtatcctgccaaacctaagaaactgcgaatttgagtgactgtcttgggttgcttccattcagtgacggcggtcactgtttcggggtccacagcaactcctttagcagatatcacgtgccctaagaatttgacttcggacaaccataactcacacttgctaagtttggcatacaattgatgttcccgcaactttcccaataccagacggagatggtgctgatggtcttcctctgattgtgagtataccagaatatcatcaatgaaaaccacaacaaacttatccaagtattccatgaacacttggttcattaagttcatgaaaaaggcaggagcattggttaaaccgaacgtcatcaccgtgaattcatacaatccgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3981 - DNA, 7636 bp, Oryza sativa
  unsure (1)..(7636): unsure at all n locations
cgcgtccattagaacgcctgcttacgnnnnnnnnnnnnnnnnnnnnnnnnnnnnnnnnntcccatatgtccaccaagtatgttcctctgttgatcaaagatgtgaaccccagtgtttcctggattaacccccctattaaatccagtgtgcaaagttgagtcaattccctgacttccacagaaattcgagggtgccccaacagttggcctgccctgcataccaccaaattggggtatagagaaattctgttgtggcccaaaatgtgtccccaaaccttgagagccaaatggtggtactgttggttgtggacgcggcaggtcaaaaaactgattgctgttggtcattcccgggccagtccccactccctggctcaccattcccattggattaccagatatagcttcaattgcaaatcttacctcagaagatgtggtattcatcgccgctgtagaacttggaccagcagcatcagcagtagtagcaggagcagatttccccttcgctgtggctgccgctgcgttagctccagcttccccttgctcttccaccgatttctgtttgcatagctccaacagcaaccctttaatctccttaacctcccccttgagtgcctttagctcagccacatcctttttcatcgctgccatatcagtcctgaattcgttcatctcctccatatcaaccatagactcgctggatcgggtcttcgttaccatccccctcctacaggatcggcttggaacttgttcctcccctctggatcccgaacaggagaatctttctaccgccgcctgttctgagtaacgagctccgtagatttcacagggccacaccacacaggatggaaccccaaccctcgctcaatcactcagcaacaactccgttgcccccaggatgatcttgccccaactcaggaattttacggtggatctcgccgccgccttccaccaaccctcgccggacaaaatcagagccaagaatcgacactgctctgatacctttgtcagatcccgtgattagaaatggaactcgcctctcgatctcaccgatgatagctctcgatttagtggccgccgcaagacttctagggttctaactctaactaagtctaagacaagtaataatatggttctcgatatcttcctctctccattccaccgattaataaaggtttacatgagtttcgatgacagcttgcattacagcggaaaaacagagtaaaattcagagaaaacgacaatgatgacgtctacagtggtcccatgggaaacttggacggtgggatttgccttcataacgcttcaagtgtctcctgggccgtccaatcttcatcagatcagtccttccagtaacactaaacgaaatttactgaataaaagtttagttaacttctgcatccttcagaatctccatttctcctgtccaattcctgacatgcactgcactgctgcctggaagctgatccacatccaccggtggttgtcgtgcaggcaagctgttcgacggaatgcatctttgcttgtcggaacaaggatccccgcggacccagtcgccggcggcggtggatcccagcttggacagatccggtgtgttgcttaagtcctatgtgttattgcatacgttcttggttgtgggtgatgtttgctatggagcgtgacacacccggccggtggctcgtgcaggtgtggtgctcggcggaatgcccaagaagatgtcaaggttggagttggacgcgggggtgtcgctgtgggcaggccttcaaccggacatactgggaatcgtgctccacttccttccatgccttgccgaccgtgcgagggtgcggtcagtatgccgtcactgacgagccagcgcgaacggccacgtcctgccaccgccgctgcccctgctggtgcttcctggtttcaagttctcgagcctatcagacaagggggatttcatgcctgtgcggtgcgtgccggtgcctaaggaggttgcagctgatgatctccgatgtgtgggttcttttcatggatggcttgtaggtgtgactcctaacaaggatcgcagcgacgagtacaacagagatgccgatggtgactgcttcctggtgaatgttttctctcgcaaggtcattcgcctaccgcagctgtgccatatgcgttacaattttcctgcttactccagtaagaccctccgcatcgtcaatggttctggtgaggtccattttggtgtcaatgatatatacacaatgtcactatgtaatgtggcactatctgcttcacctgagtcatccaagtacattgtggctgcttcctcagaccacaagggtgcaccagtaccagctctctggcagcctgggatgatttcatggcaggtttgctctggagttgaaattgatggcccaagagatctctccttctaccaggggaagctttatatgctcatgaggcacaggacacgcctattcacttgtgaacttgaggaggatgatcgtgggttcatggtctctcgtattgagctctctctcactgagctgcctcgcaatcatccctaccaggaaggtggtgcaataagttgcaatatggttgtgtggcgtggagagctattattaatcatcagacactacaatggcgattaccgtaagagacaacttcataaagttgaagtgtttgcactggatgttgacacaaacccttatggactaactgagattcacagcttgaatggtgactgtatctttgttggcttaggtggctgcaagtcctttcctgctggtctacatcatggagttgaaggtgaccatatctactttgtccctgatgattggaggccttatgatacatttgtgtatagcatgagagatggtaagatgaggtcctttgccgtcaaactattagcttccgaatttgatgtggaccagttgagtcgtgatttcccggtgtggttacttcctaccgaatgatgctgcgcagcaaagctgatctagctgggagggtggtcaagagcttacctttcattagactccttggtcgagactataatgtgtattatctgctatgttcatgttgcaactctcagattatcttttgtatttcctgttgaactggcaaccatgatttggtgctctctttcggagtctttcttgtttctgtttttctgggacagtggtactgttgttgtctgactgaggacatataaagtatggctgcattattctgctgttgtttgtggcatgtcgtttcttcaagtccgatctttgatggtgttttgagaaaaatatgtcatggttttgcgatatggatcagaagttagtatattattgctactatgtatctgaaggctttgatgttgcagttgttgctggatcatctgtagagattttatttcttaaggcgaaaagtttgattcatatactcaccagatattccatcttgttctttctactcaaggtccatgaagtttgtcatggggttgctggaacgcacaaacgggctccctgtctcttttattccattttctggttatttttcctatctattttgactatgaaactcgagacaaaatttagctgtgaaaatttatattttctcataaggcattagaatttggacaataatttgttcatgttctcatataaaacttttcacccaactttcaaaaccagataaataactcagcatttgcattatattgacctgcatgctgtcactaaatccttaacatgaacacccttgggttggggcagatggagaatctcgcatgaatggaaatgacaacactagttcttacgtgctgcatgcccactctgttcatatattggtgctccacatatgtgctagaatgttcacaacacttttttctctctctcatatctcaccaagaactttgatatatcaaaaggtctatcaattaatcatgtgaaatagtttcggactagtgaacatagttaagcggccggatggtgcgaattaagtcatgcctctttctactttttcaaaattacctactatccaggatgagtcccatgattttgttactacgaatgcgtctagagagcatataatttcaggtgttgatggaggagtttgtttcttcagataaaattacaagctttcagaatcaaaggttcaactgatcaattactcaattcctcaaagcaaagactcccagtccctcaatgcactacaagaccttatatatatggatggaatcatcaataaataacaaccctactgctaccgttttcctcggtcttttgaatttcttttggctcatcggaatttttttagtacagaagctcctcgatggggcagcttaaccgttcaagcatatcatatataaaatccatgtatagtacatccataaaaaaatattagtgcttacacattgcacagccagctcgatgctgaaaagatataaccatttaaaataactaggtgaaacctcgtgccttgcagcgggtgtttggtatgataataaaaattagaaataatgtgtaagataactagacaatagaaacttgcataagctgatttttttttttaggaaaccgacggcaggagctctgccggaatttgatttgagaaaagaaaatccgtgcaatacagaccagagcgagcaaaataaaaatacagatcaaggtggcttaaaagccgagctacgaaggtctatttcctgcttgacaaagtaagctacgtccctctctgatctaacagaactattgaaaattctattattcctttccaaccaaatattccaccatgttgtgaggagatctcctcttgttttcagcttttgctcatttgaaccttgacgatcgatttcagtccaccagttggatgttccacctgtggattgagcatttcctcctgccaagtttagccatgagcaaacaaggttccatacttgcctgacgaatggacattcactgaacaagtgatttgtgtcctcaaaagcacatgtgcagaggcaacatatccaattgcatggccaatgtctcatgagaaggttttgcgcagtgagagttttctgatgaagaacaagccatccaaaaaagagtgatgctccggtgcaatatacttgaagtattatactccgagtagaattaatctggaccgtttattttaaagggtaggtaagtaatcttctaatatcctttaggggtaattttggtagggggtgttttgttcggtgcgcatcttcggttcgcatcggttcacatcgtaggtgtggactccgtcgcgctattccttccccggcgtcaccgccttgcccgcatccgtccgtatcgctcgccgtcgccgccttgtccgccttctcagtcgccgtccctctcctccgcccgcgtcgccttatccgccccctccgtcgcagtccgcctcccccgcccttccccgcctcaccgttgtctccagtccctccggcgccgtccgtcggcccggccatcttcccctcccccttcggttcgcatctggtcggaggcaggcaccggcaggcggcagcgcgccccgcggctattcctcctggcaggcggcgtcgcggctggtggcgcggtgcgtcgcgtctgttcgacgcaggcggcggcgtggcttgcggcgctggtagtggctgggtgcggcgaaatcatcaggtaggtagtggcaatcttgtttttcagttcaatagcagttgaacttgccgaaatgggactaatgtgttacctgaattgctgaatctaaatctgaaaattttcttctggattttaaaagctattgtttttgtaaataccagtccataaaattagttgtttcccatcgatgttttcatatcacatcactggtagaagtagaaaacagcacattcccttcggtaatttggttatacacattgatatttgattcgtttctgtcagtttgatgcttcagtggtgatgttaacatgtcctacagagtagcaagtgcaaaatgcatcttgagtgaaaaacatatctgccaatgttgaatcattaggattcaataaagatgacctgattcttgtgaacgatgtggcttgtgcaaaattatttatctgataaacgaactatagaatacggtggagatttactcagtttgtcaacgactgttatgtgtgttagttcttaactgtaccgcattggctcgccctctgtgtgtgtgtgtgtgttttacaagttattactgttgtgcatgactaggaaatttagctgttaaaagaaccacactttagtttttttcttggtcatcattagcttttcctgtctcaggttgagaagtggaatgaacagagggagagtgggacatttgcaggaccactctaaatctcctgtttgagagtcttctcagatcagtccgctgccctcgtcggtgtcactgctatcatctggttggagtgggactcattcgggcgacgctccggtgcaatatacttgaagtattctacttcgagtagaattaatctgaaccctttattttaaagggcaggtaagtaatcttctaatatcctttaggggtaattttggtatgggatgttttattctgttcgcattggttcgcatcttcggttcgcatcgcaggtgtggataccgtcccccaattcctcccccaacctcgccgccttgcccgcctccgtcgccgtccgtatcgcattggttcgcatcttcggttcgcatcgcaggtgtggataccgtcccccaagtatgaacgatgaaactgaagaacaatagttttttgaaagaaatatgaacaatattaaattgattttgctgtgcatgtatggcttgctgccctagcgaactgaccattgatatttagatatgatttagcatgacatcttctggtaggataagacaaatgcgatatattttgacaaaaatagacaggggctgcattaacattggacttggcttattttgctagtttgtcagctaacttgattatgtccataggaatccacatgacctgcaaaagagattcaggaattgtggcaacgatctgactacaaataggtcttaataagctgcaatgacctggctccgtttcggatcttccttttttaagggtttcgacaatggtagaattatcagagaggagcatgtaaccgaagtcattgtgaaatacacaaatgcatatattctccagtggtgctgaaaaaagaaacagagttctgaaactactggatgatgtgcaacacaaaatttgactgtacagctgaaatgaaaaaagaaaaattatctctgaacaaccattttcagaaaatgtattttagtataacaatttatcgtacatacaaaatttgcagccattgtgggggaactgtagtaattgctcaatagtttagagtggcaatgtatttatgcagttgatggttgttctttttttatatatacttataaggtataaaggacgtaagcttatatttgggtgcttgatctgtttgtttttttttgtacttttccgtaggtgaggtctgacataatgccttcgagctatgtgagcctagaggttcaggaagagtataaaatgatgggccctgtggttttttnnnnnnnnnnnnnnnnnnnnnnnnnnnnnnnnnnnnnnnnnnnnnnnnnnnnnnnnaaaaggggtgtnatcaaagcaagggggnngtacaatgaggggttatcaaaatngcatcggcc

SEQ ID NO: 3982 - DNA, 730 bp, Oryza sativa
  unsure (1)..(730): unsure at all n locations
cggtcaaaactgctttgaacttactatgtactgttttaagagacctaacaaatctgtcttgggcttgcctaactgattggggagcacctactatccataaaaaaagacccaaacactccatggaatccatgttgtttgtggatttcaactcatatgattccacaagcacagaatgtaacctctcaaaaactggcctgtgcatcctaaacatgttgtaacaagcagttctattagctaatgttctcataacccaatcatgtccagactcaggtgctacccttcttggagccttattagagtaaagttccaagtaatacgtaccaatcatggcggcaagcatacatgctcttctcctgtccatttctcttttcttcaaaatataaatgataagatcaatctcatcatcactgctatcttcatcagagatatcttcatcaccactgctttcaccatcctgcaggagtgacatatgcatagaaagaaagcacatcataaatataatatgaccaaacttcaagaagaaaagaagggaaggtttaaataggtccacacatcacatgttcattacgtcacatcacatcaaacaagttgatagttcaacacaaaagtagatcataactaatgcagctaagacacaactaatgcagannnnnnnnnnnnnnnnnnnnnnnnnnnnnnnnnnnnnnnnnnnnnnnnnnnntcagggntnacaaagnccaaaattggcccg

SEQ ID NO: 3983 - DNA, 8230 bp, Oryza sativa
  unsure (1)..(8230): unsure at all n locations
gcagcgattgagaacacctctnnnnnnnnnnnnnnnnnnnnnnnnnnnnnnnnnnnnnnncgcctgcacggctggcctattatgctgccgttgttgggcgtctacgtcttcaccgaccggcttgccttcgccgccgccgactggtgtccacacctgcacggctggcctattatgccgccgctgttgggcgcctacgtctacaccgccggcctgcctccgtcgccgccgactggtgtcatcgcctatacggttggtcggtcacaccaccgttcatgggcgtccatgtcttcaccgaccggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactataccaattggtcttccattgagtagtgagtcgggggctacagatgttatatcatatttttcataatatttatcttgattgcttgcgacataatctgagtacaaaagtacctatcgagttatggagttctatcttcctatgctttccgttcggtttgccaatggatggttgcctttgggccgattcctagcacccgggggctcgttggatggaccgaataacgcaaggtgctaagtattattcggaataaatcaaaagcatagagataagataatttattttctgctcttaataattgcaaaagtacccgagtagtaaactccgatccgtgaaactttgttccattaatgacgaactcatgacactcatatgcatgattgggaagtgcttaggccgactcccagtgcttggtggctatgattagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgctgccgactggtgtttccgcctgcacggctggcctttatgccgccgttgttgggcgtctacgtcttcaccgaccggcttgccttcgtcgccaccgactggtgtcctcgcctgcacggctggcctattatgccgccgttgttgggcgcctacgtcttcaccgaccggcttgccttcgtcgtcgccgactggtgtctccgcctgcacggctggcctttatgccgccgttgttgggcgtctacgtcttcaccgaccggcttgccttcgccgctgccgattggtgcttccgcctgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgccttcgtcgccgccgaccggtgtcctcgcctgcacggttggcctttatgccgccgttgttgggcgtctacgtcttcaccgaccggtttgccttcgccgccgccgactggtgtttccgcctgcacggctggcctttatgccgccgttgttgggcgtctacgtcttcaccgaccggctgcctcgtccgccgccgactggtgcttccgcctgcacggctgacttattatgccgccgttgttgggcgtctacgtcttcaccgacaggccgcctcgaccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgccgactggtgtttccgcctgcacggctgatttattatgccaccgttgttgggcgtctacgtcttcaccgaccggccgcctagtccgccaccgactggtgtatccgcctgcacggctgatttattatgccaccgttgttgggcgtctacgtcttcaccgaccggccgccgcatccgccgctgactggtgtcaccgcctgcatggctggcctgttttaacgccagctgatgctatcttcttcacggctggctacatcgctgtcactactaataggcatcagtatcttcaatacaagctgcctacgtttgccatggctgccgactggtttcttcacttccatggctgcatgattctgccagtgttgattggcccattatgccgctgttgttgggcatctacatcttcatcgtcggtcgtctcgtctgctgctgactagtgcccttacctctacgtctggtttatacagctaccactactgatggacatcatcatcttccgtcgccgactggttatgccgccgtcgactggtgtttttatcttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatcttggcatgcgatgccatgttattttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcagctctcctccaattatttgtcttcacggttggcctactacgcaactgccgatagaggatctcatcgttatcatcggctgctacatcgctattgactggatcaccgacatcgtcatcttcatcaacatcttgttaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtttacgtcttcatcgtcggtttgcttttgtcaccaccgactgttcttttgttgttgttgggtgcctacatcttcattgctagctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaagcctaatatgtctgcaacccatgttttcaggtgtggcctgtcacgttcttttagggacttaggcactttttgcttaggccaaagtgcgcgtgatcaagtgcccaataccccaataccttaaaatccttttataccgcagttacttaactttttaggagttggtacaatgcatcttaaaaggtgtcaaacagtaaagctttatatagctggcccgctgactttttaatatagtcatggtgcttgttggttttttaagcaattggttagatacaatatctgtgcttttttgcacggtagtgtgcattttaatgaccaatattatggcttaggctgattatataatgggggcatttttcaagcgggtggtaaatcctttatgagtttatttactcggattttataccacatatgccatatatttccaggggtggtggaaccatgttgtttttagggacttaagcacatttattaaaacagtgtgggcatggcgtatgaccaatactttggaaatttctttattcacaacatacaagcttttttatagctgttttgctatgtgaattttcaataatgtagccaactttaggttacactcatcatattttacaaagcagttggtatatcactcggatcatgttattcagggatttacaccgcatatgctacatattaatatcaagtcgcttggttaactataattatcgaagccactcggttggttggattatttattccttgactatatgcttagtttgttcacttaaccgcatagtcgagggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacacggcatggttatccgactagttataggggataacttatatatatgaaatatgtaacatatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggaggccctctagggggcaggagacaacctgatcgtcagatctatactacacccggcggattcaaatccccaaacaggagtagggtattacctctcattgagagggcctgaacctgtctaaatcctttgtctccacatccatccacttttacgtctcgtgcgctaccccgttttattattgccgaatccatgtttcgacataaacccattcaaacaaagatccattactctcttacgtttcgagacgtatcttggtcgtttttttgttgcgttgttatcatctttcgttgtgatttatgaacagctcctgccagaaaccagagttgctggcttctagaatagcaaaggcagcggcacgcgcggaccaagcccccccccccccccccccggcgcgcgcgcgcatgtgctgacaattaagcgtcaaaatgaacgtgcgttggtgtgtgcgtggacaaatacctaactatcactgtgaattcagccagattggtgcgttatcgcacgcccaagttgcccaagttgccgagatcgatttggaacttgatcaaatccaaaacgaaaagtaggagatcgatgccgcagtgcagcccaaaactacgtacgctaggctacgtcctatatatatattcacctgctttaatttgcatcgatcccaacttaaactgagtgacgccgcgccaatatgcagccgcgctgtacgctcatccacgccgtcgccgtcgtcgcggcggcggcggcggccgcgctgctgcttcctccgctcgccgccggccagccgtggccaacgtgcgacaccagcgccggcacgtacaaggccgggagcgcctacgagtccaacctccgtgacctcgccgccgcgctccgcgcggacgccgccgcctcgccgtcggcgctcttcggcacgggcaaccgcggcggcgcgcccgacgccgtctacgggcttctcctctgccgcggcgacctcagcgtcttcgactgcttcgactgcggcacccgcgtcctcgccgacgtccgccgcgtctgcggcggccgccacggccgcgccaaggacgtggccctcgtgtacaaccagtgctacgcccgattctccaacaagggcgacttcctcgccgccaccgacaacgccgggggcgagacgctgctcatcagcggcaccaacatcaccgaaggcgccggcgtcgtggcggcgtacgaccgcgcggtgaccgagctgctcgcggccaccgtgcggtacgcggtggaggagaacccggcgaggctgttcgccacggggcagcgcgtgggggacgacgcccgcgacccggggttccgcaacatctactccatggcgcagtgctcgccggacctgccgccggcgtcgtgccgcaggtgcctcgacggcgtcttggcgcggtggtggcaggtgttcccgctcaacggcgagggcgcgagggtcgccggagcgaggtgctacctgaggtctgagctgggcgtcggcccgttctacaccggagctcccatggtggtgctgcgggcggacaaggtctagccagcgccgtcgccattggcacccgatggaagctgcggtagctacagcctacagttctacgcaccaaaatggtggaggtgcaccctacctatggccgacaaagtgcaagcaaatctctacacgtatacctatactattattaggacattccgacaaaatgtccacgttcacccgagaaattttagtgaataaatctggacatcgatccagttaaaaccaaatttacaacggttcaataactaaaataatcgacatgcagctcttcgccaacttcaggtagaggttcacaaataaaattcagtagttgtgggagctttatcttgtgttggtgtttattagtttgtgcttacttaatattttgttggtgcgcttctaaactcactgtgtgagattgcttttgtgtgaattctgtaataattggatatagctcattaagcaaaaaccgagatgttttattccatcacctataaaaaagctaaaataatcgacaacgctttcagttagacgtccaatcaaatagaaaagatagggcatcatattacccatgtctaagctacatggccgctatatgtgcatgcagtagcctatcttcctactcactagcattctcctcccttccgatgtcttttctacgtttttaaaatagcttgacatgagttttcttctaaattatttatattcaatttacaatccgattatatcttgaatttattgttattaaatatgtaaaaaaagatatcacataattatattcttatgaaagatatataaacttatgttttaaccatgaaaattcatgttcatacgcgatactgaaatgtttcaacatatgtttcacataatctttcagtatttcaatcactattttttttcaatgtttcacctgtggacaacttaaacatttcaccccccccccaaatttttttatggaaattaggtgcctggtatcaatttcatgttggtacttcctcccgtcccgaattccctgatgttttggataagattgagatccaccaattaaacctttaccatcaatcttcctctcatttacaatggtaggcattcttaacatttccacaatcataatgatgtttaagaatctagacatatttatttttcttgaatcctttacactcatataccatcaaatggatgggggaaatacttcgataacctacccttggaaaacgg

SEQ ID NO: 3984 - DNA, 966 bp, Oryza sativa
  unsure (1)..(966): unsure at all n locations
gcgccaccgggactaaggatcccggtgatctttagccccggttggtgctaccacccggaccaaaagtcccacccctatatatatgtcttcttcctcctccagctgcccgagcaagcttcaaaatttcttcaaaaaagagtggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggtcatgccaagctataattgttggacatcccacggagagcaaggtgttgaaatggaagaagatgaagtggaagacgacaatattnnnnnnnnnnnnnnnnnnnnnnnnnnnnnnnnnnnnnnnnnnnnnnnnngtacatcgaattgcattcaaaanngagctg

SEQ ID NO: 3985 - DNA, 995 bp, Oryza sativa
  unsure (1)..(995): unsure at all n locations
ggccggactgaatacttctcgacacacgccctctgacagaggaattcggtaccccttcgtctccgttgtgcccgtctgtctccgccgcgcccgttcgtcgttgtttttcccgcgcctcgtcgcgtggtggtaaggatccgtcctctcgcttccccgccctcgtcctctcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaataatccgcaaatctccatataacagcattaaacctcggatgatcatattttggtcatacgaactccgaatcgacccgttcaagtctcctaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgtaggttcggaaggccgttctctctgagcaaggcaagtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3986 - DNA, 726 bp, Oryza sativa
  unsure (1)..(726): unsure at all n locations
ngcgtgcactgatagcttagagcccatgatacnnnnnnnnnnnnnnnnnnnnnnnnntatcaaatgtagattacgtaatatggtaaatttcacataaacataacaggagcagacaaataattgacagcacaagtcagtgattatcaaacataactcgctaacctatctcacaagatacagaatgatctcaagatgaaacagtgatggattcttaacatgagaaagcataccaatgactgatgtctggttgcaaatccaatttgtcgctgacagattgttgcttcattttctcttcaaaaatatagccctgccaataagaatcatacttagtgttatatcatgtgtgcatgaactaaacaccaaataggtaaatatacatgaaaagaatgagctgagtgataattgtaggctataattccataatgaaaaccaattggttcttatggcaccatacaccatattttggtggcctgattactacctaaaaggatgcatgcaaccaaaagttctttcaattatatgaaaggagctgcgcttaagatgcaatgcatctgaatttggaaaactaagatggataatctataagacattatgatatatgtttaattgatgcagcaaactgtggaatggaaaacatggaaattgaaataatactccataaggaaatcatgacaatattacatttttgtgtgaggtcccttatanggtgataggaatatctagatc

SEQ ID NO: 3987 - DNA, 2085 bp, Oryza sativa
  unsure (1)..(2085): unsure at all n locations
acgcgcaatagatacccgtcctnnnnnnnnnnnnnnnnnnnnnnnnnnnnnnnnnnnnnnnnnaaggatcccaagggcttacctccaaggaggaattgtgatcatgtgattacacttaagagtggagctgaaccacccaatttaagaccatacagagtacctcattatcagaaggaggcaatggagaagatcatagctgaactaattgaatcaaaggagattcaggtcagtgatatcccatactcatcacctgctgtgatggtgaggaagaaggatggatcatggaggttatgtgtcgactacagacaacttaatgcacaaacagtcaaaaacaaattccctatgccaattattgaggatctgttggatgaactcaatggggccaaagttttttctaagctagacctcaggtctggatatcatcaaatcagaatggccactcaagatataccaaagactgcattcagaactcacttagggcattatgagtatcaagtaatgccctttggcctgacaaatgccccaaccacttttcagtccctaatgaatcaggtactggctccattcttgaggaaatatgtgttggtgtttttcgatgatatcttgatctatagtaaggactgggcagaacacaaggagcacatcaggcaggttatgaaggtgttggaggaaaataaattagtagttaaacttaagaagtgtgcttttggcctccctagtgttacttatttggggcacatcatatcgcaagatggagtggcaacagatcctaagaaagttgaaaagatagctacttatccaactcctaagagtgtgacagatcttagaaaattcttggggatgacaggttactataggagatttataaagaactatgggatagtgtgcagaccactgcatgatatgctcaagaaggaaggctttcaatgggaaagggaacaaactgaagcttttgaaactctaaagacacatatgtgcactagtccagttttgagtctgcctgacttcaccaaagagtttgtgattgaggccgatgcttgtggcaatggtataggggctgtccttatgcagtctggtagacccttggcctatttcagcaaaactctgggacctaaagcagctgctcaatcgatttatgaaaaagaagcaatggcaattctagaagctttaaaaaaatggagacattatgtgttaggcagtagattaatcatcaaaacagatcagcaaagcctaaaatttatgatgaatcagaggctagttgaagggattcaacacaaattgttgctcaaactgatggagtatgactactcaattgagtacaaggcagggaaagaaaacctagtggctgatgccctgtcaaggattccaccagctgaacagtgccaggccataactactgtgatacctgaatgggtgagggacatacagaggagttatgaaggagatgtgcaggctcataagatccttagtttgattgggacagagggtgacacagatgggagctatagtcaggaagctggattattaaggtataaaggcagaatttatgtgggggagaatactgaaatcagggaggagctgataagatcatatcactcctctgcttttggtggacattctggaatgagggcgacatatcacaggatcaagtccttgttttactggccgggtctgaaaaagcagtggaagggttcatccgagagtgcccgatttgtcaggtaactaaggctgaacatatccacattcctggactgcttgatcctttagaagttcctgatatggcatgggctcatattaccatggatttcgttgaaggactaccaaaatccaatgggaaggatgtaattctggtagtggtggacaggctgacaaaatatgcccatttcatagcaatggcacacccctatacagtggagcaagtagtggaattgttcatgaacaacatacatagactacatggaatgcccatggccatcataactgacagagaccggatttttannnnnnnnnnnnnnnnnnnnnnnnnnnnnnnnnnnnnnnnnnnnnnnnnnnnngtgcatggggaagtgcatntcaaggagcggg

SEQ ID NO: 3988 - DNA, 896 bp, Oryza sativa
  unsure (1)..(896): unsure at all n locations
gtgtgnaatgataatgcctcgccnnnnnnnnnnnnnnnnnnnnnnnnnnnnnnnnnnnnnnttgcttaataattatttccggtgctctgaaaattcaagtaaaatttgaggactccttttagaccaaggagaatttaacaaaaattctccgggccacatttaaatttttcttgtacgtattttaatgtttgccaatttctttttcgaattttaattaattctattattccttttagcgaatgaattttaattttgggatgaatttatcaggacgtgacaacaattgatgttcccgcaactttcccaataccagacggagatggtgctgatggtcttcctctgattgtgagtataccagaatatcatcaatgaaaaccacaacaaacttatccaagtattccatgaacacttggttcattaagttcatgaaaaggcaggagcattggttaaaccgaacgacatcaccgtgaattcatacaatccgtatcgcgtggtgaatgcggtcttcggaatatcttcttcacgaatacgtaattggtgatatccggaacgaagatcgatcttggagaatacagtggcacctttaagctgatcgaacagatcatcgatccggggaagagggtacttggttttgatggtgacttcattgagagctctgtagtcaatgcacatcctcttcgtcttgtctttcttctccacaaaaatcacaggagcaccccagggggaagtactcggacgtatataccccttttctttcaactcttccaactgtttcttaacttcagccagttcatttgctgccatacggtagggtcgcttgtacagaggagtggtttcttgagcaagatctattcggaactcaatctctcgtttgggcggcataccccggtagtctt

SEQ ID NO: 3989 - DNA, 6568 bp, Oryza sativa
  unsure (1)..(6568): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnttctaatatcctttaggggtaattttggtagggggtgttttgttcggtgcgcatcttcggttcgcatcggttcacatcgaggtgtggactccgtcgcgctattccttccccggcgtcaccgccttgcccgcatccgtccgtatcgctcgccgtcgccgccttgtccgcctcctcagtcgccgtccctctcctccgcccgcgtcgccttatccgcccctccgtcgcagtccgcctcccccgcccttcccgccctcaccgctgtctccagtccctccggcgccgtccgtcggcccggccatctccccctcccccttcggttcgcatctggtcggaggcaggcaccgcaggcggcagcgcgcccggcggctattcctcctggcaggcggcgtcacggctggtggcgcggtgcgtcgcgtctgttcgacgcaggcggcggcgtggcctgcggcgctggtagtggctgggtgcggcgaaatcatcaggtaggtagtggcaatcttgtttttcagttcaatagcagttgaacttgccgaaatgggactaatgtgttacctgaattgctgaatctaaatctgaaaattttcttctggattttaaaagctattgtttttgtaaataccatcggattgatttagtacaataaattaagcgctcaattgttaaatagtctttcaaaatgattatgcagtctcttttcttttccagacatgcatgaatctatggttggcttaaaaattatagttgaatgggcacaacattaatgttcactgtgtacaaaaaactgtggttgtattttgaattttgtacatgatccacgacaggtaatctgcattggttatttggtatatttgtggagcatattatagatcaagatatatgtgaactaatagcattttaaaattaaaatttgtccagatcaccatatttgcatgaatatttttccttcaaagttggtccattttgttcagacaggacaacattgcacttcattttttttttcatattatggttcaagtgcagatattgtggattgccataacactatcaccttccaagtgcaaattagcactgagatttctgggttgatcagtcgttgtgagtatggtattttgattctatgttcttctatgattaccaggctctggaaggatgtaatctatgatatatacaggtggtgatcatagcatgatagcaatcaaattccacagtgttggtaggaatgaaatttcaaaggttgtttgttcttgaatccattgtattgtatattgattatttgattgaatggttgggagcagggtcagtttgcaagacggtggcatgcgcgaagggtggcatgcgcgaaggggatccgcatgccggcgaaggggttatcggtgtcaaggtgcgacattgtagcagacgcacgtcggtgacgtcgacagctgactgcgctgagtcaccacgaagcgtaaggattcatataccgctccttctcaaatggattgaaatatgaactatgaatattatctcaaaaaggcatcaatgtttgggatccaaaaaatactcaagtagtatataaattatttaataagggtaagagagcatagtaaggtaattgtgataaatgtatgacagatgatccatttatgtcgtggttggtagcagtggacgatctttaatgttgttcagttcggagttgatcaaaattccggctaagtcctgtcgaaatgttttcacttccttctgcataatgtaaagggagtgcattttaaatggtttttcgtattgggaagcagtggtgcaaaatatgaatagaggttgttgtagttacctgtagttgaatttttgggagataagatccggtccaatgctccatgaacttaagggtgtacaggccgcacgagacgctacaagaatttagtcgttaggctaaaatgtttccgtaattgaataatgtgaatatcacgtggaagagtttgagtcacccaccagtctccttgctttggcaatttttggactttgttgtagtcccattcggtaattttgaaatcaggccaatcgtgttttaactgtgggtgctgattctctgtcccgtgtaatcccctctcgatagctagcagctgggaagttttgtgcaacgttggtacggttaaaatatagcaaaaccgatttgaattatacaagtggaagtgtatcgcttaccacacgccttagatcgggtcgatctttactgattggctttgcgagcgaatctagtatttgcacctcacgtcgcttggcgttaagaacggctaggtaccagtgtgtatctttaatattaattgggaggaaaatctgcagatggtcaacagtaagattgagtcataaattgaaatccccattacatagatagcttaaataagtattaccatgtcaaatgctagatagtcgcgtgccatatctctaatccatcgtttatctcgaggttcgcttgcttcgatatgcgctccctctacatttagtagacctgttttaatggccatctctaggaaggccttgccatctcccctgattcctttctctttatagcggaggcattggatgtatgcatccatgacctgaatttgagtttagttgagttacataacaaatatagttataaaagaatagtaggcttgttaaataggcgaacttacatcatcattcaagaaagctggttgtgttagtactttcattcttatccgtttaacctccacttcttcaatatgcaccatcactttgttatcctccgtgttattaatgtaggtaatgaacgggtcttctttttcagtcaactctacgaaggtaggacaaattagtaatagatgtatagaaatgttaaatggttagtcattaccttctgaattttttaacgttgtttggccattcgtttttttcttcttttgacctcgtaaggcgttctttggtgggcctttgtctatgtttttttgggtaagatcttccttctcgatgtacactagaaaagggtaagtcaaatcagtaacacataaacatagaatataagtaaaaaattaaggatgatgtagagagttcatacattcggatatttcattcggtgtttgattgtcttgtttcctcttcttttcaccccgtaattcgtttgtgtctggcaaagggtaagtcaaatcagtaacacacaaatgtagattataagtaaaaaattaaggatgatgtagagagttcatacattcggatatttcattcggtgtttgattgtcttgtttcctcttcttttcatcccgtaattcatctgtgtctggcatgtaagcttctttattcgtttgcgcttgaaaaggagtaaagttagtaccattgacatgagcatatgtaactatgaaatagcatagtacctattgttttctttgtctgtgcttgggttttgattatgtcctttttaccccttgtttcgtagatgaagtcagtccgattagttggtttgtatgttcttcctgtaggacctgtaagcctcttcctgctttgattgctctggttacttctgtcctgttaggtaataaagtgcacgttagtattatgataagttgtagtaacgttagcgagagaaataaaattctgtttaccttcgtttcacaagtcatgtttacattttggtttatataggtctcttcgttatgatttgatacatgctccctgggatcaatttgttcttgttcaacatcctgcaaaagcatcaacctttttttagcggtgttatgtaagtaataatgattaacagtgtagcatatgatctttacctcaaacacatgcgtactatcttttcgatctgggcattttgaaccattttccatgcaatctagtatcaatgatcgcatacgtggccaaaaatcctttgtgaaatcgttgaaattatcttgtaaagtttggatgctttcttgtaacctttcttgtaaagtgatgtcggctgattgttcagtggatgttatagagtgtacctgcatagcacaagtgagaaaatgatgtcgaacatttttttgttaaatagagttcgtattaaaaccccataatatatacctcttcagaagtgccttcaaaatcttcattgctacgtgtttctgagtcattgtcctgcgctttttcttcggggatttcattgcaatgtatagttcccctaatgtcgttgacaacctatttttagtgaaaaaggtgtattagagattttacagacagttgatataattagtacatagtattaaaaatgagatagttaccttcccttgtccaaaaaggtaagaaattcgctttttttctttttttttatcccagtactgaattagtggcctttgacggctagaatgatatattgtcgcagccaatttatctattcgcactttttcccaataccaaatctgcaagcatttgaacattagataatgagtattgctatgaaaatatgttcatgacaattttgtaaacatactaaattttgaaacgaacctgtaagaggcatacgttcccctcaatgtttgttgtcttctctctaaattttattatgcctttcagtaactgattcagtgttagactagaccagtttagttccctcattttgtcaacgtcgtcgacgagattgagatattctgagcgcacatatctttgagttgtaggacatatgaatgatccaattgagaaaagaataaatcttcgaatgaagtggtcatcgtagctcgaggagttgattattgcttcccgtaatgcttgtaaagtaattgttgtttggccttcctttttgtacaggttgaacaattctggtttattgatttttggtgcctcaaatatgtcatctccttttgatggcagtccaagcaaacaatcaacatcatcgagtgtcatcgttacgaaggtaccattaatattgaatgctttcttctccttgtcgtagcttcttgcaatctcattgcacaagtttcggtcaatatgtatgttgtcaatctttagcaagttgccaagacctgaaccctcgatagcttccttttgacgtggacttagatggagtattacctcgtacatggcatgtggagagcaaactagagttccctgattaacagaaaagataataaaagtttagtccttgtgaaaatttatgcaagtgctcatatatacagcagccataaatcctaatggtgcactgtattgcacatcataaggtactaatccatattaattttcttaacatgagaaccaatgtgattgaagtgaacaccttattaccatttggggtcatataaatcataatgtactatattcttgctgatgtgataattatgcaagcatatattttttttgtactatatctttcttagtggggatgggcgtgggggtggggtgggggtttggctcgacagggatttctgaacatataggatgaaggtgttagtcaatataagagtgcgtaattggagacaaagcattaattggttcacgggaaaatcagggttaaggttgtaaatgctttttgagctttcatatggtgttttcttttcttgtgtctgtggaaggagctttcattggaaggtattagcaatgtaaatgtatttcatatttatctctgcaagattaataaaagattttatatactaaagtacagttgcaaaatgggtataatcatagtatacttctgtcctgtttttgcagttccctctagtatgtatgtgtggaacaatacgaagaatggtagctgaatccaaggatccagatctctcaaagttggagcttgtacatgtaccagggggagctttagcatttcaacttgctgccaagttctgttatgggagctttagcatttgtttcattcactacacaattggttctatatacgctctgttaggtgggaaaatcagctatatgttgggtaacaaaagtgtatggtgctgtagtaggagttatacctgacccctttaaactgttgcctgtattatcccatgtagcaggcccgtattttttgggacatctagccatggtgttttgtctgtgaggctgctacgtcctctaaacatttgatacagaaactagccagagctcaaaagaggcacgcaaattcatcacgaaagagactatcttcctaaataatctagacatatctgctatacttatcatagcaccttagatcggatgtattttttgcttgaggagtgtatgatttgcagtagtgatgtttacaagagctgagagtgaaaatttcatgtaaaaagacgtacaccctttttcttctgatggcttgtgccctgcatcataggagcagagtgtttatgcatgctcctaatgggggtgctcagaatttggcctcatgttgtacagaaaccgaatactgtctcatatatccgacatatatatatacatatatgtatatatatttaaatccatttaatttgctgcattacggtagggtccattgaacagaatgaatggtttcttgacaaggaatattccgaactcaatctttaatttgggcgg

SEQ ID NO: 3990 - DNA, 4437 bp, Oryza sativa
  unsure (1)..(4437): unsure at all n locations
gctgtgnaacggttagagctgtnnnnnnnnnnnnnnnnnnnnnnnnnnnnnnnnnnnnatatatatatatatatatatatatatatatatatatatatatatatatatatatatatatatatatatatatatatgtatgttacacctgggattagcttgttacgaaaaaatagaagatcaatatgatatacagttattagctattgtaaatccgcggctacgagaaacataaatttcggcagggaaaaataacagataattcggtttaaaaaagaacagataattcggcataaaaacatctgagcaaaattctgcaggaaaaaaaacagataattatgcatgaaaaaaattcagttagagtacggaaattctgttatacttctactacctaatctcagccgagttcggtagtattagttttaaaaacctcgtgagtttaaaacggaataaaaagatatcgttaatataacacaggataagttccgacaattttttatagttgtgcaaaataatccgttccgctatattatacgagcgatcgaccggaaatccatgtttttaaaaaaagcgaccgtccggacggtgcgatttaattttttatttgtccaaatttaatccgtgccgctataatatacgagctatcgaccagaaatccatgtttttaaaaaagcgaccctccggacggtgctacttaatccgttccgctatattatacgagctatcgaccggaaatatttgttttattaaaaatcgaccgtcccggacgtaatagttattttgtccgaattaatccgttccgctatattatacgagcgatcgactggaaatccatgtttttaaaaaagcgaaccggtccggacggtgcgacttaatcttttatgtgtccaaaattatcagttgcgctttaatacactagctatcgaccggaaatgcatgtttttaaaaaagcgaaccggtacggacgtgtaacaccctgaaaattcgaccggcaaaatcaaaactctaaaaatacggattttcaaaaactttttaaattaattgcatcatgccgatcttattcgtctattttatctggatttgatctcaaagattattaatcgtgagtaaagaatagttaattaggaataaaccttaaaaacaaattggtaaaataaatacaaaataaagattaggtgggatagaaataaataaaatattatcgcgaccatatttggatcaattaaatttaaatacgatggaataagaattaaccctaattaaaactcaaataaattacataaaaataaaatatgagtaatattaatctagggtgaattcattagttgagataatacacatattgagtaaacttcatttatgcaagatttagaaattatagaatcaaatttatatagaaaataaactaaaattgggaaaaataggaaaaaggcactattcattagcctctaggtgttcgacgaggctccctagccccttcccctcccctgccatgcgcgcctcgcgccccgagccgtcgccgtcgccgcctgccgccgtgccgctgtcacctgccgcgctgtcgccgtcaccgtcgcatccctcctcgtgccgcgtgccaccgctgccgccccgtcaccgcccgccccgtcaccgctgccgcgccgtccccatcgccatcccgctgccgctcgtgtatgtgcacttggtatttcagctatgaattcgtgtgtaccagactacttgatccagggaaatggtactgtttacacgattgattcctgttataaaaacgggggtctacaggacggtgcgacttaattttttatgtgtccaaaataatccgttgcgctgtaatatactagctatcgaccggaaatccatgttttctaaaaaatcgaaccggtccggacggtgcgatttaattttttatgtctccaaaataatccgtgcagctatattctatgtgcgctcgaccggaaatcattgttttctaaaaattcgaccgtctcggacgttatagtagttattatgaccgaaataatccgttgcgttttacagcgtgcaggtacatatatatccacagaaaacggaacaacgaaaacattggaatgctcaacttgagtcgtgcacggtcacatgttgatccggccggatgtagcggcaacaatacaaatagatatagattccaggaaaataggtatttgttattctgcttttcttgttgtctcgccagattagtttcaatcaagaaacttgccgatcgccagcagtctccggtgacgacgtcggcaacgacgcacccgacggggtctccgatcacgatgtcggcagcgacggacccgacggggtctccgatcacgacgtctgcagcgacgcacccgacgaggtctccgatgacgacgtcggcagtgaaccatccgacgggggattcttcagcggcacggtctagggccagtaagacttcgaaggatgatagcacttgcaccgtttcagatgaccccgtcgttacgggtgttatcgatgctttccaatctccaccgattcttcaaaaaactgcggtatttttgctcacattcctgttgtcatagatatttatttttaataactgtcattgtgtactccaattttttttttggtacatagtccgcacatctatatccatttttttaatcataaacttgtcaattatataacattgcaaatccatgtctaccacctctgtgttgtatccaccatattagccggaagctataatgacgtactgacaatatgaagcaaatgattgtgattgtttttttagtacgtgattttgtatacgggaataaatgaatgtttgttttctggttttgtgcatgaataataaattaatgtttttatttgttcaggtcactggattgcaaacacagattttgctttcactgggggacctttcgagccaaatttgtgaaacgcaaaagatgttgataaagatggcccatgataacactgaatttcaggaaaatatgaatgatagaatgacaaacgttgaacacattcaacagctacaattacagcaagtcacggtacattttctgaacatttatgtttgttttttccacatggcaaaatgctttgacacatatctttcttttgtgcaggatataacgcatggagaacaacattttccaaggaaaagatacatcgaggtcgagtatcctagcactataggaaagagggttcgaggagtcaatggtagggccgttgtaagtaacaagaaatttgattgttacaaaagatgcttggtagacggtaacgatgacttcgattttgtttgcactacggacgaaacacgcattgcgttgcgtatattgtgtgcaaagcctactgagacgataatccatattgatgacgtcgttttgacgaaggccgatttggtatgtcttgtacagacttatccgtatgacaattatgaaaaaaacattagcacaaaggtacgcctatgcactatttttgcaaaaagtaaagcaaaatcatctctaagtaatgcttcataaattgtattgttgatgcagatcattaaggcgtttgtcaagcattttggacaaagtagatcaattaaacgacataaacatatgtaccatgcctacttagagaccccgtcagttgtgtcaatgcttatcaagtatggctattatgatggtgttgagctaggaaacactgatgaaaatatgtacaaatccgctggagtcagctatgtgaataatgatatggtaaaatcataccttacaaatttgaattcattatattatttaactattttgtaaattgtattgatttgacatacagatttttctaccaataagaacttcaatagaccattggtacgtagcggttctggactgtaccagaaaggaggtgtgtgtccttgactcaatggacacgactgaagatgacttgaaagaacttaagtttctggtactttttccccataaagtgttagcattatcagtgcaaccaagtttgtagaatattaattatcacatatttatttcatgtagatgaaaggcatccgcaaatgtgtccgacttgtcctcgatgataaaatagtagagaaccctctgtgggacgattacaatgttcaagcttggaaaatcaggattagatataacttgcctaacaaaaaagacaggttagatatttacaaccctgagagatgactttgtaaaaaaattcatttcggaataattttacatctactcgtactcgtacaggacatccagtgggctttactcaatcaagttcatggagttatggacaggagattcgctaagcaaacaattttatcaggtatatatgttgtacaattagcacggaagcattcctatttatttcacttaaaactaataatattgtnnnnnnnnnnnnnnnnnnnnnnnnnnnnnnnnnnnnnnnnnnnnnagatgtcgaactcaagggcgg

SEQ ID NO: 3991 - DNA, 1697 bp, Oryza sativa
  unsure (1)..(1697): unsure at all n locations
nnnnnnnnnnnnnnnnnnnnnnnnnnnnnnnnnnnnnnnnnnnnnnnnnnnnnnnnagacaaaattaacatgaacaccatataacagcttaaaccatcacgtaggctaaatataaatcacatagtgcatatcataattcatcaattaatttagcttgttttcttcacatccttttcaagagggtataagtcatttaatgacatgtaagtacgtaatatacttaggaagtgcaatatttatacatgtcattgtcagacaatcatatctcaacaatccattttgagatgctgataccaacgcaaccaaactgaagtactgaacatcgcatgagctgaacacgcaaacttctgatgaagtcaaaatcatgaactctaaaacacagttcagttgaacaggccggccactgacaatcgcatcagctactgacttcggagatgctgtgcagcgatgggcgccattgacgatgccgggagtgtgtcgccgagctgctccgttggccgtctatatcatgctacgcaaaccgcgataggatgggcagcagaagagtaatcagaattcagaacatggcactttgtcaaaatttaataaagtttaggagactttgcaatcaaatcaaattaaagataaacctaaattatgaaggctaaggtgttcaatactggaatgtcaagctaatgagattagatcttgccaaattacatgctattcctgacagggaaatgtagatggctagaagatgaataatggtcttttgcaggaactgaaaatccctttcttgtcgcaacaagacatttgatgtttattattatcacccataaactgtttcaagaattgtcggtgatttttttaaaatttaattcgtctgaagttttggaactgacaactaggttcgaggccttagtggagcacttcacttttctgaggcattcatagttcatacaacatgtggacactctgttcatgtaatcttggatatttaggaacatgacagtactaatgtaatcttggatatttaggaacatgacagtactattacttcaatctgaaaagttgatgtgacagaaaaaataaataaaaccaagatgttgacacaccataaagtaagcctataaatccaaacttatcactgctcacaagtttgtatgattgcaaagccttactactgccataggctcacattggaggaagtagttagcagatcgttctataatcatcacaggaaaaaggtttcctgaccaaactactagtgattaaaaagcttcccaagtccagcagccatatgcagttgtattgtaccttataacttacaagatctgattaaaaactgctgcaatgtttctgcacatatggaaacgcacgcctaactttcagaagagattttacctgatgcacacagcaaaatgatctgttcccatgcatgcagtcttgatggctatagaaaaggagtctgttcttcacctattgctaagattggagccactgaactggtagaaataggaaacagtcagcaaacgaaattgaaatggattcagaggagggtgtaactagaagaataccccccccccctccccaaacaaaaaaagttttcagtattaatggcacaagtaatcttgcgttcttgccatgatctggctcctgattacaagtctcttgtctgaacctgaattggtaccccagactatgttcaactaagactt

SEQ ID NO: 3992 - DNA, 844 bp, Oryza sativa
  unsure (1)..(844): unsure at all n locations
agctgggatcgttatatcattgcgccctgcaannnacnnnnnnnnnnnnnnnnnnnnnnnnnnnnnnnttcagtgactcactacgttggttgctgcgcatacccaacaagtatttcccatctgtataggcagctgcccatttctcccttagtcggtacatcagagcgatccattgtccatttcccgtgcctccattctccttaaaatcagcccaacgtctctcgaactcctcttcatccatactctcataaattaattttcttagctcgtcgagttttggcttacgaaggtgacgactcatattctcctctatatgccaagtacacaatctatggtaagcacccggcattaccttactgatagccttcgccattgctaggtcgccatcggtaattaatgattttggatgcacttgacgcattgcctccaaaaaagtctcaaggagccaacagtaagagttgacagactcatttgatagaattccgcacccaaaaattgttgtacttctgtggtggttaactcctatgaaaggaatgaaaggaagattgtacttgttcacacggtaagtgctatcgaaaataacaacaccaccaaaagcagcatagtctaaacgtgattcagcatctgcccaaaacacattcctaagacgcccttcctcatccgtggtgtatttgaagaaaaattctgcatcttcttcttgcttccttgttagatatttcaacacatcttcagcatcatgacccttgatattcttcatgtcgtannnnnnnnnnnnnnnnnnnnnnnnnnnnnnnnnnnnnnnnnnnnnnnnnnnnnnagccataggtncttcattggcacagct

SEQ ID NO: 3993 - DNA, 1241 bp, Oryza sativa
  unsure (1)..(1241): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtttatccccattgactcctctcatttccccataattttccccttgaatggtgcccccaatcgccgggaacggccgcgccattcccggccgccttccattgccgcaggccggctttcccgccgccgttccgacctcccccgtggccggctccctcttctctcatataaaataggatccccgcactccgttctaccgttttaaccccatcccgagcctccccggggtctctagccccatccccgccgtcgccctctctctcccacgccgccggcgacctccagccgcctgtgccgcctcgctcgtgcgccggccggccgcgccatcgcctcctccagcgtcgccgccacctcctccacgccggcctgccctccgtttcgcgaggagacccccggaactacgttcccgccgtcgccctcctctttcattcgcgccggccacctccagccgccttcctctcctcgcccgagcgccgcccggccgcgccgtcttctccctcggcctcgcagctgcctcctctttcccgacttcgcctccgtttcgcggggaaatcaccggagacgcgtcctcaccgacgactagtggtgtcgccaccactccaccatctccagccgtcccggccgcctcgcctgagcgtcggccgacgtcaccgtctcctccctcggcgtcgccgcatcgccctccaccccggctgctcctcggttttcgccggaacgccgtcgccgcgccggtctctccatcctcttcgtcgccggcgtcctttcggccggcccttcctcctccccggctcgtcggcttgctgcaccactaccacctccggcatcgcagcggcaaggcccgcctcggcatcgtttcccctccatccaaacccctccgtggtccatcatcatcgtctccgaccgttctcatcgtcgacgtcccgtcggtcgctcggctcgtcgtctcgcggcgccgccttcgtcatcgtcatcgtagcggcgtgttcctcgtcgtcctcgtccccgtgcagccgctgccggctgtcctcgtcaccttctcgccggtcccggacgtcgacgtcctcgtcctctcgtcngtcccg

SEQ ID NO: 3994 - DNA, 4713 bp, Oryza sativa
  unsure (1)..(4713): unsure at all n locations
cgccgtgnnaacgtanagtcgtgtnnnnnnnnnnnnnnnnnnnnnnnnnnnnnnnnnnnnnnnatcatattttggtcatacgaactcccaatcgacccgttcaagtctcctaatgtttgttataacctaaagaaccctgggctttctttttatgtattggtattgcttctttataggcttgtagctttgcttgtgtgcttcgcgtagcttctgtcgttccggaggttcccgaagcgtggttcggggtcgtcgccgtaggttcggaaggccgttctctctgagcaaggcaagtcacatcatccttgagcatattgaatcccagtttacaaaattatttttaatttaaattaatgcattatcgctttgtttaaattcccgcgttatcactgttttatttagccatgcctatttacctttgttatgaccttattattgctattgttattattattaccttgttcaccctagattaaacaaaacctcaactagtgggtactctattcatggttccactagtatgaatttaggtagatgcttcgcggtttgaattagacaacattaggtggttttacaactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttgggaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggaggagctgggacccaggtcgggttgccagttcggtccgaatcatcgcaggccttgggttaaggcaggttcgtgagggttcacggccttgtttaataatactgtgtagctctaggatcgtctttacaaaatggctttgggtaactaagtggcttttaaatgctgtttactgcaaaacttaatccctatattattattcccttgtacctcccttgcattaattatgcatccccggtgtggcttgctgagtactgtggttgtactcattcttgctcaatctttccccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccaggttgactgtaggataagccaagtggataaaacccaaggacatattttataaataaaaattatttgcgaaagttcatttttctccttcccctaatgctgtttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagtgtttcgtttgtagtgtgtttccttgcttgtgtgtgtagcgcatggtttgcatcggtgggttgtgatgtgaccatgctaggttgtttgtttaatcaacttgcagaataagcaaaacaaacaacacatcaacaaaaagagttagttcctttaaggtcttgtcccaagctctggtctattctttccttgtaggcttcctctctcaacccctaccttgtgacagatggataacattggtaacaaaggctatgggaatgatggatccgatgactcaagaacccaagccaatgggaatgagaaaagcctcaacgaaacctcaccagagctaatccaaattgtggttaaccaaaccaacatgttggcaacagcctttcatctattacagaatcggaacatcccagcaggggcaaccaacgttcaagtacctacagtcccgcaacagtgcaagttatcagaatttctcaaaacggggcctccaacctttgccatggccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccacaggaatgatcacactaagaaaacgagagtttcgctacctgaagcaaggagatttgaccgtcacagagtacctgcatgagttctatcgtttggctcactatgcaccagaagatgtggaaacggatgaagacaaacaagagaagtttctccaggggttaaaagatgagcttgcagtgcaactacttctagaggattatgaagattttgagaaacttgtggacaaagccatgccactcgaaagtgagcataatcggatgacgaactgcaagagaaggattgtcaacatcccagtatttccaggtagtaaccaaagacagcgcactgagccacttcagatcaccggatcttctgttgtgcatcaagagttcctgccccaagaagatgaatgcaatgcagacatcaacactagcaatactaataatgatgacacctccaacaaccaaggttctggccccattagtgaccactcgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccaattccaactccaagtcacaatgatcatccccagatggacagctcagcaaagaagacgttgatttgttacaactgcaaagaaccaggtcatttctctagagattgtccacagccgaagcgtaacttgcgccatcactccggccattatgcaagaagaagacaggtcactcgccttgtggtcactggagcaaacgccgtacctgtgaggcctcatgttaattctaacccatagaggaaacaatgtaccgatgttaagcacctccctttttgtttaagacagtgccttgtattcatgtaatatgggagagatttgtaataaaaccaagttctaagaggattcttttggaagatgcggatatgtgatcatgtgtataattgtttactgacaaaggagactagggtctcgtgccagaggaactatattctaacctcgagctaataaccaacctgaggatggaaaagaaaatcaagcgattaccaaagagacatttgtggggattaagagtttcagatgtgtcttttcggatcaaagacaaagacagtcagtacagctttgggcaaaacacttgaaggtttcactgaaaggcagcagaccaaaggaccacatcgtcaccaaaagcatccacaactcttggagtgaagagtacttggttgacaaagttcaaaaggttattgatagaagataccagcaaaggtgtttattatcgggcaaagaagtaggtcgaaaggtgattgataagagaaatctgaaaagaacacatcaagggttaaatgtgtaaaggaatactttgaatgctaaatgatgacaacatgaagagaagattccatctgcaacagtggatcgagccaagcagtccagagtgaagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccaaaattaaaattcattcgctaaaaggaataatagaattaattaaaattcgaaaaagaaattggcaaacattaaaatacgtacaagaaaaatttaaatgtggcccggagactttttgttaaattctccttggtctaaaaggagtcctcaaattttannnnnnnnnnnnnnnnnnnnnnnnnnttacaatgcgtctctccgtt

SEQ ID NO: 3995 - DNA, 856 bp, Oryza sativa
  unsure (1)..(856): unsure at all n locations
attcatgcatttccattccgccactgaaaaggttgaaaagtccggcccggtcgttggtgctttgccttaaacgttggcacacatcacatagacccacaaactctgcaatttcccgcttcatgttgacccaccagtatttctccttcaagtctaaatacatctttgtactgcccgggtgaatgaaataagaactttcatgagcttcctaaagtatcacctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaaggtgggcttggcttccaacgcggccaaaaatccacgaccaactatgtttcttaactccagccagttcatttgctgccatacggtagggtcgcttgtacagaggagtggttcctgaagcaagatctatccggaactcaatctctcgcttgggcggcataccaggtagttcttccggaaacacgtctccgaactctctgacgatggggatttctgacagacttatctgatgcagttataaacttctgacaaaggttggaggtgcaaagaaaacaaccggttgttctggtcctcggtacagagtaacagtgcgtctcgggcaatccactactctttgaaattgtgccagccacttcatcccaaggatcacatccaagtaaatgagtctagaagaatcaggggttgaaatccaaaagctggntcgtaacgtaccgtncctgaaccaaccagnggtngtcattgcaaggcattcatgccgg

SEQ ID NO: 3996 - DNA, 913 bp, Oryza sativa
  unsure (1)..(913): unsure at all n locations
ngcgttccagttagcnatgnnatgaacaacccctgcttttggtctnnnnnnnnnnnnnnnnnnnnnnnnnnnnnnnnnnnnnnnnnnnnnntaaagctgcagccatacagacaaacagcttttggaattcgcggtgcacttaaattacgatccaagttctatggacctttcaagatcatggagaaagtaggaagagtggcatataaactgcaattaccagaagggagtaacattcatcctgtgtttcatgtaagccaattgaagaagcacattggttctagagctgtaccaatggcgaatttgccttcagttggtccggacggacagatcaaaactgaaccggtggctgtgttgaaaagaagaatgattcccaggggaggagttgcagtaacacagtggcttgttttgtggcacaatctaagtccatcagaggcaacatgggaagatgcttcgatgatacaaagtatgtttccgtcttttaatccttgaggacaaggatcagctcaaggggaaggtaatgtcaggaattggacaggagaaatggagattctgaaggatgcagaagttaactaaacttttattcagtaaatttcgtttagtgttactggaaggactgatctgatgaagattggacggcccaggagacacttgaagcgttatgaaggcaaatcccaccgtccatgtttcccatgggaccactgtagacgtcatcattggcgttttctctgaattttactctgtttttccgctggaatgcaagctgtcatcgcaactcatgtaaacctttaataatccgggggaatgagagaggaatatattgaggaccatattatactttgtctagacttattgtgagggggaccccacaagtttgtcgccgtcactaaatgagagctttcttcgtgagaacaat

SEQ ID NO: 3997 - DNA, 8658 bp, Oryza sativa
  unsure (1)..(8658): unsure at all n locations
cgtcctcgtggtttgttggtgatgcggctgacgacccgcgattaatgccaacggtgggcctcctgttttggtctgtcaccttgggccattattttttttgcaaaatagaacatatgaacttgtgtgttttttttcttgtgggttcgttttatttaaggggccaccggggccgatgggtagtgatcagattcagagtcttttatccctatgccattaagaaagttggaggttacgtgtgtgccacaaaaaatttttgagtcacttgtatgccatgagacaaactttcttttacctgtgcaccactttggatggaatcagcactaacggagactaacggaggtttgaaagatctattttgcccttgctctatttcagccactttggatggaacatttggaagagaaatcggcggcggcggcagcggcgactagaggcgcgctgccggatagacgaggcgaggcatcggcggcggcgtgccggcgacggcgaggcgaggcggcgtgccggtgacggtgaggtgaggcggcgtgccggcgacggcgactaccgacggcggcggcggctagagaggcggcggcggcggatagacgaggcgaggcggcggcggcgacggcgacgactggcggtggcggcggcgtgccggcgacggcgtgctaggctagggcactggagaaattgcacgtgagaggagtagtgagatgaaaatgcttcaggggcaatttagtcattttcatacgtgggtcccatatgtcagagctcattctctaacagaaggtggatggaatggcacacgggtaaacgaaagtttgtgtcatggcatacaggtgactcaaaacttttttgtggcactcgcgtaacctccaactttcttaatggcataggggtaaaagactctcagattcaccccctccacttggtttccttttctggcaccgtattactttcttattttggtaaatttaagcaactaaagtttatacacctcaagtttacacatctaaagttgagagaccaaaagtagattcaaatttgaatttgaattcaaatattttttatatatagtatttctatacatctaaagtttatacacctaaagtttatatacccgtttcaaatttgaatttgaattatataaatttgaattcaaatattttctatatatagtatttctatacagctaaagtttatagatccaaagtttataagtcaaaagtttacatacccgattcaaatttgaatttgaattcaatttttttatatatagtatttctatacataaatttttctaacttttgttttttttaaaaaattttgtggtgtactgtagttgaaagagaaaggggaggaggaaggggggaagagggaggagtatagggggaggggagtgcgggtgatcacccgtgcattagcagttccaggtggcaactgtactgcttttggtctcttgatagcctaaaccagagacccaactattttcataactagtatctcttcctatgtggtaagtatacaagcatgcaacagcaaggaaatatagtttaatagttaaacttcaaatatactttttctttcaaattacatatcatcccatctacagtccgattataccattttattcgttgtaattaaatctttataacaagatcttatatgaatatattctgatgaaaagaaatatatatgttgtaaattacttttattatatatgtaagttacatttatcatatatacatatacttctaagtttgattaaattacatcactactagaaaaatgatttttcaggacggtaccctatttttttcgctggcggtgagtttagaaccgccagcgaaaatccgtttttgctggtggtaggttaaaagatccgcttgcaaaaataagcctattttagctggcaggcctcttaacctaccgtagagcccgtcaaaaaaatcatgcgcacttaaaaatatcatagcctattaaaaaatcgccacccatcactccttatccacctacccatccttatcctctcgttcctcctcctccctccagatccaccagacagcaccctctcctcctcccttcctggatggcagcagttgttccttttggtggctccggtggcggttctggtcctcgggcggcggcacgcggcggctccagcacctgtgtgtggcggcgacggcgacggaaggcgagcatctccagcggtgccgcccaacctcggttgtcttgttggaagctaataaggaggccttcttgacaagcctccctcccctcccccttctctttccttatccaacggaagcaagtgcccccgtctgatagtggaaaaaaacggaccgagctagctatcctgaccggcctcgctcccactcccccttctctttccctatccagcagcggcaagtgcccccatcccatagtccccctcccctcccctttctcttttcttatccagcgatggtgagtgcccctgtcccatagttgaaaaaatcagaccgggtcgtcagttcgactggaaaagtacggaaccagaagtctccatagttcggttacgcttaaagatcagacatgcattcgacccagattgaaccagccgagtttagactaaaccgcgcaataaggtttagactaaacggagcattaaaccgtcttggtcggacccggcattaaaacaccttggtcggaccgggcattaagcccctttggtcgaaccaggcagaggagataaatgggccaaattaaggcccattccattgcctttagccccgtactactgtttttggttttcaaaaatcatagaaaaggcttgtggcatggggactcaaaccgggatctatgcgttgagagcggttagctctagccatcctacccttgttcccttatgttttagagaaaatacacattatatatttggaaccaagggtcgcctgggtcaatcaccggttcccttttttctctacggcacatcccaccatctttcccatgtcctaaccacaaagctctggtttgcccccgccgcgcaccattgctggccagtcgcgttgctccatccccacggctctaactgctcaccgcctataggaacgctgcctcccacaactatccctctaagccctcttccctctcccttgcctccattcctacctccaccccaacccgggatcctaaaccctaactcaacatgccggcgccgggtgccgaagattctatagagctagaggagaacgagttggaattgtcggagcacaaattgtgacacaaatcccaaggtctgattgtgacacaaatcccacaattttctatcaacagccatttaggttgtgttcgtttgtactgattgggaaccttcccttccagcatagaaaatggaaaagcacattagcacatgtttaattaagtattagctcttgtacattctttccccatttttttaatatagcgcagtagaagcctctcctgctgtttaaccgtaaaaaaattaagtattagctaaaactaacttgaaaagtgaattaatatgatttttaaaagcaactttccaatagaatttttttgcagaaaacaaaccatataatagtttgaaaagcatgcacgcggaaaacaagaggatggagttgggaaccattgcaaaagaacgcagccttattaattccattttgtttagtaattccattcacggtgctcacagcggcccaattagattcacgggtattgaaatggagacccaattttttttggtatatgtatgtttataaaaaagttaaaaatatatataattagtaaataaacctgtctttctaggcttggctccctctcctatgagggtccaattcacacaacttttatggcctaataatgtgattcgtgaaacaacatacaaactgtcaaagataaatttcttttacccctttctactttgagtacgcttatacgcaacctcaaaatcgtgggccctcccctgcatgacgtgatttttttgctgcttgcattgtaatgattttccctgggaaaactaattaagaggcagataaacaaacacacacttctctaattaaacaacactgatacactcttttcccttcattttatgacaagtgtgcttcaatggggcaaaaagttataagacaacaacttgtgttaccacatgtgtactctagtacgttttaagtggatggtttctagctacgaaaagaattggctatagttttaaggcagccagagattattaatggctgagatgcatgttgctagcttctacacaatccgtttcagaatgtttgaagcgttgactttttagtatgtatttaacgatttgtcttattcaaaaaatttaagtaattatttattctttttatatcatttgattcattgttaaatatattttcatgtacacatatagttttacatatttcacaatttttttaaataaaacgaacggtcaaatatatgctaaaaagttaacagtgtcaaatattttgaaacggagggagtatatatttgttggaagtgaagcatttccacttatgattcactcggtcattgcatccatcctaccatacattctatatatctatgtttggactgggaggtcccaggaattgttgtgctgcagtgacgccacgaaatctgtcagttttcttctgatagtttacaaagttctgtggtttcaccactccgccaatgagaatgttgacttaagggcagggtttgcaatttcgttttgaaatttcggtaattttgtcccctactggaaagctcacatctcgcccgaaattttcggttttattttttttttgcaaatttttctgattttggtcaaatttaattaaaattcattaagacagtcaaaatttcaaataatttcagctaaaaaaattcaacatttccaaaattttggtaatttcggtcccccgggaaagaatttcgaaattgaaagctccgacggcaccggcgggaaagaagtcgcagtctactccagctgctttgtgcaactctgccgtgtactagctagttgcacattttgttgctgcgctgcatagttgctttttacaacaaagatagacctcaaattaattgacatgattcagtgtacatactcgaagtaagaactgatgaatttatattttcggaagagtatttttttacccagcatatacatgtggatatatgcagccatatgcagccatttaagttaggaacttagtccttcaaataacccaatctgaaattcactcttacgtagatttgaactcaatatcctggggtgctacgcaggtcattacgactactcaaaattaatatacatgtatgtatatattgtactatatctgtgcctgtttggagcaatgaactagggtagtatatatgctgggaaggttgtgcatgtacttaaatcaaacggttgaaatgattgttagtaaaagtttaacaagaaaaaaaattagtacatgtagcattgctctttgtataataagtccgaaatatatatctaaaataaatttgtcttatgttacctttttgtttatactggttttatttagagcaagggacatcgacatagtaaacatacttatcttgatttcatatatccagttattctaatgcagctcagctggttaggttccgtgcctatacaggtttaggtcatagacttagtacgagttcttgcattttatgactatttgttgtttcaatgataggcaacctaccaatctttatcagttcaaatatatgcctaacggcctagtcttaaaaagtgccagtgtgtatatttataggagtgagtaatatacgcgcgtgcatataagcatctataactatattgagtttcacaaacaaaaaatatagcaaaattattgtctttacttacccatgttccaaaataaatagattcctagtatctagaaaaagtataatgtgaggattataaaagaaaaacaaaatgctccgaattaataggaaagtagtgctgaacttgtcggttaacagagaatacatatctgttcatctaatttcactttttattctttccattctatagaaatttaggtattaattttccttgtttgaagtaaacattctagattgtatttatctagagactttcgattgtcctaacgcaatccttgttgctgctatattttttttccatttaatttcactatttttttttctaattttctagaaacacatgatgctaacatgaagtgacttttcctcgttctgagtaattgtagttgaatatttatctctatcccaaaaattcacgaatatttgccttgggcccgttcagaacaaaataattcaatattaatattccaatataaaaaatatatattgcccttcaacctataatttcatgatatatatccttcgggcttcagccaaactttccttgctacgaacctttgagaaaaaacccttgaatattgttctccatgccatatttcacaacaaccagcattggcatcattgcggataaaattcacgaatgtacacattaggacaaaaaattcatgatttttaaacatttctccgacccaaaatttcaatagtattagccttgaaacatttctacataaaattcgtgaatgctaaccttaggacgaagaaaattcaatatttttttagcctttggcctaatatttcatgatcttttggggaaaatgcataaatatttttttcactccaatatttcatgagtatttgcactgggatcgacgcacataaaattcatgaatattaaccttagagtaaatttcacaaaactacaggtactttggtcaaattatcacaaaactacagatttaaggtgatgtatcacagaactacagatttaacaataaatttatcacaaaactacaggtttaaggctaagtatcacaaaactacagatttaataataaaattatcacaaaactacagattttgaggctgaaatccttagcactaatgttatgttggacttataattgatcaagtaatgtgattaaattgtcattaaacctgtagttttgtgataactttgttactaaatctgtagttttgtgatattacatcttaaatctgtagttttatgataaatttagcgttaaatctgtagttttgtgatatatcatgttaaatctgtacttttgcgataaattgatcaaattacctgtagttttgtgaaatttactcttaaccttatatcttataattttgtgatttttagccttcagcctataatttggtgagttatagccttcgaaaaaaattgatgaatatcaaacttctgaaaaaaaaagaaaatcttaaaaaataccgctgaaaaaataaccaccttattttttaaaataaaattggtagactcattactttataccaacttaattgttcagtggcgaaccaataaaaaattatgttggcactacgcatacaaattatttaattattgattgatatattaattaacatgacatgaattatctattattatatactaaaatttcattaaatgtcctataaactctaaacattcctaagccaccacatgatgctctaataaactaaagtaaatataagagattctgagaaaaaaaatcgtattacccaaacctatgtaccttattttaaactattagatctatatattaaaaagattattgatcgataagaccgtcagatttcatatgtacaatgcacatatctacttccctcctcacggacgagcatgtatccactttcttcctcacggacgagacgagcccataggttgtcgcctctttttctccatacggcaattaagttaaccgctgaataaaagaaaatcctaaaaattactgctgacaaaataaccacctttttttaaaaatacaattggtggacacattactatgtaccactaaacatgtgacgtttttctaccatcttaattatatctctcaacgtgtatatgaggtctatttaactatagaaataggtaaagctaaatcaatccacaaagatacaaataaatccttctacgaattaagctctttttaattactatcttctgcctaaaatggatcatataattttataggaaataaggaggaatgaaaaaaatactaagaagcccaacaagggatattttgccctcattcaataagtctcattaaatagggtagttggcgaattataaggtggttaaagtaatattggataaaaattaaatgagagatggttggatggtacgagtagtatttataatcccttataatttaccataaaatttaaatatttcgatttatggatggaggtaggagaagcaaacaagagtacgtgggtatgtcttaatttaataaattagataaagaaatcatattaccacatttttaataaaaaatttcttaaacttatatatcataaaatctaaaaaacatttttagtataaaaaatatattacgggtttaattaatatgatattttttttaaaaaaattaaacacatgttatataaattatagtttcatatggaaccaagtggttcatttcttgggacatattacgacatgaattaaagtaatttaagttaacaatttgtaacaacctattatattagaaccccacaagcttacttaatcaactaaggccgccactttaaaaaataacccacttacattttggtcttacttggggtaaaaaattn

SEQ ID NO: 3998 - DNA, 3942 bp, Oryza sativa
  unsure (1)..(3942): unsure at all n locations
aaataattgataattgcagatttttaaaagtaaaaaagatatattttttaaaaggacctattcataaacatgatacgaaagttccaaaccccattaagtaaaggtgccgcgcgggctcaccttgttagtttgaagaaaaaggtgaaaacaaacaaagggctaaatcacgtgaagataaatgtgacagttcacacaaatcacacaatatgaatgacgtgaaaaacagtggcggaacagagctccgaacaaacaggggaaaaacagaggcgctcaaacaaatcgaagtgtggaaaaagaaagtttgaagcctgttgatcgatcaggttaagatttgtggaacatagtagtactagacaagagtcttctccgagccattccttcccatgtattagtaagttttgttatacatgctggacataccatatgtagtgaaaaccaaaaactataattgaataaaaaataagatttatccatatcgccctgagtaaagcatttaggcccctttgatttaaagaaaatacataagaattttggaggatttcaatccaatagaaaaaatttcctatgaaaacctttgaaacaaatgattgaatcttatattatcctttgaacttcatatggaatagacaatcctatagagattttagacaatttagcaagagctccaacttcgtagaagtttcccttttagtctatctctctcatctgattcctacgtttttctgcagtccaatcaaacggttatttctgtgttttttttatattttgcaattctttgttttacacttttttcctatattttacaatactctgttttgcacttataatactattagaatgccgtgtttttctattcttgcgattcaaaggtaatcttaattccatatttaactatgagtaaaaaaaatattcttggtgacgtggacaagtctttctgtacattaaatcctgatatttctataacttaattattgaagattctgagatttgaatcgacataagttaagatagtaatagttttgaggtaggtagtctgccaatttgcgcacatgaacacatatatttagaaggtactagtagtcagttctctggctagagatatgcatagtttgaaagaaaaaactttaccgttcttatacgacgcaccgagaggacgtctataaaaaactaccattccattccacgtatgtgttggctcttattaccagaagaaactagggagatgcgccagttactgtttaatcacgcatcgtgtcttctctccaaacacttgtgcctgggacttggaggcgttgggaaatgctgtgctgcaattacactccctcatcttcctttgccgatgactagcaggtaaggttgagagtgattcggataattttcgttctaggatagtttcgatctgatatatccgaaaatttttgaattcggatacttttttcggatatgaaaacgaatatgatataagtgatatccgttggaatcggatatctgtcggatattatcctgtatattcgacttacacataaggcccataagctagctcaacccaaagagaaggcaaatcagacttcttagaaaaaataaatttcgaattaaattttatgatactaaataaactcatatgaaaaagttatcaaaaacatagttgtagaactcattgagacctaccaattttgttttcgtcatttctccatccgagtttgattgaactatataaattttaaattttaaaatataagaaattcaaataatttctttgggtagtacatgatttcaaatgaaaaaattatcaaaaacaaagttttataacttatcaagatatataacttttattttggtaatttttctatatgactttgtttgaacaatttgaatttgaatttgaaaatatgacaacttcaaacaacattttcaaatactaaatgatttcaactgaaaaagtcatcaacagcaaagttatataactcatcaagatctataacttttatttcggtcatttctatatccgacaaagtgatagtaacattgttcacaaaatttacatatctctcatttgtttttataaactataatagagagatttaaattttgtgaacaatgttactatcactttgtcggatgaagaaatgaccaaaataaaagttgaatgtcttgatgagttctacaacttttatgttcatgacattttcagctgaatttatttactgcttcaaaatatcattcgaagttttgaaattcaaatttttaattgataaaacaaagtaaaaaaaaatagccaaaataatagcagtaaaaacacaataacatgatagagcatgattttaaaaacacaatatcaaaaatcgtttgtgagtagtgaggggtttttatattctgactaatattcgtcaccgtattcgtttcgcttcgtattcgctccgtatttgtattcgataatattcgattccgttttcatatccgggtttccgattccgatttcgattaaaaaaaatatgaaaacgaatatgatagagctagtttccaaccgtattcgatccgttttcatccctactagcaggcccaggctaaccacactttggtgctttgggtgcagttttttagcctctgtgataacatcttgcacaatgataaacctaaagtctatgccagttttgtatctgccatgaactaggtactgcagtttaagtgcttgtgcatatatattccccaggttatgtcagaatttcactgttgtaaactagttcattcatagggtctatgtctccaggacatgcttggcagagtgatggggatattgtagccttaattatttcgaaagctgcgtaccaagttgggatggtttttgatcttccacagaactttctcataaatcaatcgggttattaggacaaaaccgtacgattcattttcagatgttttttttttacgtgtatacaggatcgagcactacaccaactgatcatttgtactttgataagaaaaaacatgataaaccccggagggattcatttgctatctttgccatagtcaagtctgtaggacatcttttcttgtgctggtgtgatgtaaaaatccatatcagtctagcacgatttatctggttcgatttcgagctgtgaagattgtccagacgttctagtcatatcttaataataccgagacgccaccttcataaaacacacactataaatgttaggatacgcgtaggctacgatagcataaattaaaattttctatcgggtaaactaggaaccatgtaagtattagatcatagatcgttaccactcgacgcgctgtgcagcggaagaagacgctgagaagtcgaaggaactctcgcgtagtagcgcgcgtcgatgtagaggaagtagtcgatagcaccggctcgaccttctcctccttgtgcgttctcctcgccgtactcccacgccgatcagcaccgcaaaccagcggcgcctctaccggtatccacacgtacagggacggaacgccacgcgcagatgtgctagcccccgcgcggctagggttttgctcggggagggaagtgatgcctaaggtttctcacgtgatgcaatgccttcgccggtcacacccctcacgaatatataggattcatcactcgggcctccaaggcccgtaggactcctattcggatccctatccgaattaagctcatattggatctctatccaatccccttatttcggcccattaagcgtgcgacactggaggttcatatatactcggctgtaacccgaaaactccttttcggtccacgtgtcaacagaggcccctagcagaacgtattgacctaccgggcatacataaagatcatatcggctgaacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3999 - DNA, 2849 bp, Oryza sativa
aggaaccatgtaagtattagatcatagatcgttaccactcaacgcgctgtgcagcggaagaagacgctgagaagtcgaaggaactctcgcgtagtagcgcgcgtcgatgtagaggaagtagtcgatagcaccggctcgaccttctcctccttgtgcgttctcctcgccgtactcccacgccgatcagcaccgcaaaccagcggcgcctctaccggtatccacacgtacagggacggaacgccacgcgcagatgtgctagcccccgcgcggctagggttttgctcggggagggaagtgatgcctagggtttctcacgtgatgcaatgcctccgccggtcacacccctcacgaatatataggattcatcactcgggcctccaaggcccgtaggactcctattcggatccctatccgaattaagctcatattggatctctatccaatccccttatttcggcccattaagcgtgcgacactgtaggttcatatatactcggctgtaacccgaaaactccttttcggtccacgtgtcaacagaggcccctagcagaacgtattgacctaccgggcatacataaagatcatatcggctgaacctctagtgtatacttgtatgaacccctttgcctcacgatatcgattaagctcaaggttagatatgtgccatcctctaatagctcaatcattcactcgaacctgttgatagattatataacttgcgattgactcctcaatcacctttggcatggccatgcacttccataatctacaacatcgaggggccccagagatatctctccataggaggggcaaatcccatcttgattattcatacccactacatgtttcacagcatacctgaaaactacttttataactacccaattacggagtagcgtttaacagtccctaagtaagctactacaaatgttgagaaccatgataatctcaggtctaaggattcaacaccaacactcaatgagatcactgatgacacaatacatatggctcttgcagtgtctcatgttgggtctatccaacaacatgttcaccaacatgtgtccacattattaatttggtatctctatatcatgatccatgagacatgatcatcaattaatacatgtgctgatcatataaacatatttgttccacatatgatatttgatcagggatcctttagaaatagcaacacataacataaagagtctcatgaaagaatcacatattcattaaccaataaggagttatctatttcaaggaacaatgttggataaatatgtaaacatagtatgtgatacaatcatctctatgattgcctttagggcatatcactgacaataaataatattgggtttaatttgcctcacttctatattgcaccattgtctgtaatcgatctactccatcccacactcatgtgcaatacacataatctacgagatcccactcaccggcaaacaccgatgattgggagagcatttctcttaaactctctacttcaaagtcctgcactaggaaaaggatattgggaaaaaattaatatacttttaatgttaaatagggatccactaaaacaaacgataaaatctactaagacagacgtaaaacattaggtcgaactcttctccggtgtaaaggaagtagttgtgtatagtcatcactgcaagcgaataaggtgtttgggaagtgctacgtgtggcttcccgctgtatattcacggtgacatgtcttcatcatttctcggttgcgacgagtcatcgtcaacatttcgtagcatgcgtggtcaaagcagcaccctttacgccaagtgcaaatcatctagaaaatatctagctgtacacattaattatattccgtacatttgatttattcatgtgcgattttatctctaggttatgcgcatgagatggttttgctagtttacatgtttgatatcaacatttataagttaaaatcaattaagcccacatatgcttatattttcttccacttatacagcctatatatatgatctattcatacattgcagttttctcatacttactacttcctccgtttcatattataagactttctagcattgtccacattcatatatatgttaatgaatctagacatatatgtgtgcctatattcattaacatctatatgaatgtgggctatgctagaaagtgttataatctgaaacggaggtagtattatatatatgtactctctctaacctaaaaatcatatgcgatatgcttaggcatgcatgcagacccttcgttcgtccaacagtttaggactgggagacatgaggaaccctggatatacatatgttatccttcggttgtgttcttaccttcaagttcccaacccctctccctcgttttctgcgcgcacgcttttcaaactgctaaacggtgtgtttttttgcaaaatgtttctatatgaaagttgcttacaaaatcgaattaatccatttttttaaaaaaatagctaattcttaattaatcatgcaataatacatgcttcgttttgcgtgccggagaggaggggttcctcccgaaagccacctttggctcaactattatggaggcagcggtcgtaaggacaagtgcagctccccttctgctgttgctatcaggctgtgttatggtacttcgtgcccttgtacagctccaggtacccaatccgggttgcgtagcccgagtccactagatagtacttgcctgccgcggtaaacacctgtatgttacacgtgatggatgttagaaattgcaaacatataattagtagcattgtacctggaggtggatgagggaaaacatgattgtatgtactcaatggcttcgtgcacaccc

SEQ ID NO: 4000 - DNA, 8075 bp, Oryza sativa
  unsure (1)..(8075): unsure at all n locations
agagactttnnatggagttgcacatccacatgcnccnnnnnnnnnnnnnnnnnnnnnnnnnnnnnnnnnnnnnnnnnnnnnnnnnnnnttgccagaactttgtggaacatattgtgaattgttgctaatgatcgctcaaatctgtcctcaacttgcctaaccgactgggagccccagccatccaaagaaacaatcctaacgcctcaatacttttagatttcatgctagacttgagctcatacttgtcgaccaatagatcatgaagactaaagaacatatcagaggtcattctaaacatgttgtaacaccgcttcctgtctgcaagcttcttctctacccattccaacgcactcattgttgtgctaacatctctatattccgactggttgcagtacctgtcaatgtggtttgcaagatgtaacgtaccgcacagaaacccggtggatgcataatcgtccataaagtactccatcataactctgccgaactctttgacggaatcttcatcctttgtatccacaggttggagccgcgcattctcctgtaataaaagtaaaacaacaacggtaactttcaaacatcctcatattaagaaatgaatttggaaagacagccttactacaacttatatttaattgccaacattacgcatgacatatttcgcaacacaacagtagccaacataccataaatgacatagctaacagacatagcacctcatagcttccgaagcgtacataacccaaaagatataactaaggctgatacattaacatgttaagcaagcattagaaggtctagttgtcgacccgtgcgaggtgctcaaggagggcctttctttcttcatgattggacagctcaaagacattgatggcatctcgatccttgagcatcttgaacatggcaacccacaagtgtggagtcgcctctgtgacccagcactccctactgagtgccatgatacgctcagccttttcccccgcgcgagcgtcatcatcatccctcctcttctcacgctgtgccgaatagctgtccgttgctatcgctttctccttctgcagctcgtgtgcaccttcaattcgttcaccacggcgcggacggctaggctcttcaacttcttgcttggactagtagccctactccgcgtgcttggtgtgctcctcatgctgtgcgacctcttcgtcccaacactgatggggcttagggggtcaaagtcgtcatcgtcagattcttcgtcatcctcgctgtcctccacatccacaatgggggtggccggctgggttgtgggctatgtaagaacaaatgaagtcgatccgttgacaaccacccccatgaacatgcggtccatttcttcgcgatagtcgggcatcccattcttcaacttcctaaattcagggtggtcctgcacaaaatgaatgcatcggtcagatgcataggaacgatcatgtgtaaaactgcgcaacgaaaaagtgaagtttttgtaccttagtgttgtcatcccaccacttgtctgaagcaaccatggtgccgtcaggtcttcggcccaaaccagtgtctgtacgcaacctcaatatgaaggtccacatatttttcaaacccctgtatttaaatccgaattgctcattgtcgtggaccaaatcagtggtggcataaaaaccctttctgatctccttccaacctgctttactcatgcttccccttatgtagttgccattatctatttgcttgcaatacagctcacaaaaaagtttggtgttctcatttgtccacgtagctgtaatacatttcgcaagtattgtactagctgtacttgacaagttacaacaactgtagtatgtagcaactaatcagatgaaccacttgttaacctcaaatgaaatgggaatccacacattgcaaaacctaaaaacgttcttacctctgtcagccggcgccatgcgctgcgacccctacctcggcctcgaccctgagatgcggctcgagcttgaggccggatgggaggcacgaatacgcctccatggcctgaacctccaaatggcggtgccattggcgcttggaacccagctccaatcgcatgcggcccgtcgactcctgccgccgacatccgaccgccccgtcgcggcccagatccggaagctccttgagcacttggccggcccctcaacccgagcgtgcgatgcacggtacggggagggacgcctacgccaggagggcattgactgccatcccctccgccactgcgaagaaggtcttggtagccgtgcatggccgaccacttgtcgccgtagttgaggtcaagagccccgaagtcgaaccgggagggttctggctgctggaagaaccctcgccgaagctacccgagttgtaggacgtgaggccgccatcacgggagagatggagaggctgcgcgaggaagtcgcgcgtagggatgctggcgccgaatcgatgctcggccccgtacaggaggatggtgctcccgccgccgtatccgccaaggttgttgccgtcgccgaacacgcgcccggcattggcgtctccgtagccgtggccgctgtcgccgttgccgtacccgccgccatcatggccgtcgccgtagccgcccccgttgttgctgtcgccctcgtacgaatccattgcgtgctcccgtcgattccgctgcacgcgccgccacggatgtgctggatctggacgaggaacccttcgattcacccagggtagggttggattacagcggcggggaggacagatgcgacgccgacgagttcgagagagagcggacgtgagggagaagaaccttagggttagcgcgtgtgaagaggcgatgaggaatggataggatcggcggcgtcggcgcctcccaggggtataatgggacaccctaaccctaggctactgttgggccttaaatgtgcaatatggccgaatttcaggtcgctacccgtttagttccaaagtccagactgcaccccttgtaccgatttttttggcactttggccctatctaaacacggcctcaatgtagcacgaggaagcaagagaggctcgagaaactaggttctagttatttgctggtttgtgctttgatgtgtccatcggaagccattgatgcttttccaccatgaaggattctggttcatcgagggactgaatgtattcctttttttttcttatagcacattaggaatatgggacaattgatcgattgaacacttcattctccgcggtttcttttgtttgaaatcacaagtttctccatctacaaatgaaagagacataggttttgtagatatgcaggatttaatttgcaacatcagctcaatcatgtagacagggcatgatttcctcatatggcatgatgactacctgtgtacaaattgttagagtatatatatggtacttagaaatgtatgaggatagtattgatttgtgtaaacttatttcttatatgtaatcttttcttatctctaccacgtatattttgtatatatcggtccctgagcttaatacgtacatgtctaatatttcgtagtatttttctccatttactattctacacaaatatattatttccataggccttttgttagatgtcatttagcgaactgtctcttgaaacgtcatttagccgtgtgtaagagggcttttacagggcatcgaagaaagtcttcaatgattttcgtggcagtgacagtccgaatcgcataagaccagaggagctttgctctgctagttttcttttgttgcacacggctattttcgactcgacacctctgattcatggcagcgttcgtgctgcatacagttcgctcaagcgtcttgcctccttttctatcatgtggttacttttccagatgaatacagagacatttagagaccataggaaaaaagtacgaattacccctaacaatcgggacagtacgaattaccccccccccctccgaatctcaaaaccggacatttgataccctaaactattgaaaccggacaaattacccccttggctcaacacagagtggttttttttttttttttttttggggtcttttccccctaaaccgttggcaacaatacatgggcgccacgtggcaatccaataaaaaaaatattaaaaaactgtgggcccacttgtcatgtactcctacctcacccctctcttttttctctctctcatcagctagggggcacggccgggcatgccgggagggcgagcggcgatggcgaacgcgaagcacggtgtcggcgaccgcatccgtggcggcgacgcgtgagttgcgcgagatggagcttttgcaggaggcggatggctgcagtgtggtggtggtggtggcccgggcagagaaggcagcaacggcggtagagtgggggtggcggtgaggggagggagagacggggagcgacggcgagggagggggtggcgcgagcttgtaggggcaacagcagcagacgacgacgacgagacaaccttccccgccgagccgaggtcgtcctcggccaccgccggggtgccgtgctcgccgagagaggggaagaggagagagaggtgcgggaggacctccgccgccggccgcggtcgattccttcacgtgagcttcatcatgggccacgccgcacgccctgaacgccccctccacacccaccgccggcctcggggtccgctctcccgacggcgctacggagagacagagagaggggggaggccacttgccgtagtcgccgtcgtgggccgcgccgcgtgccatcaccgcctccgcaacgcccgccgccggcctggggtccgctctcccgacggtgccagagagaaagaggggaagagccttgcttggcgccctgccgcagttgccgccgctcgccatagtcaccacagcttgacagacgacggcggcgccacccttcttagctcgcgggatggaggatcggcgtagcctgctcagcccaccgccagcctcgcctcctggcccgcccgccggcctcggtctctgcgcccgcccgcctccggccgcggctcctcgcccgccgcctgtagccatccccgccgccggccgccagtcggtgtccactcctcgcccgcccgccattagcagtcacctttgtgctcgtccgccgcctgcagccgcctccgcgcatgtctgctgcccccagccatcccctccgccggctgccagtcggcgtcggcctccgtgcccgcccgcctctggcctcggctcatcacccgtccgccgcccgcagccatccccgccgctggccgcccgtcggcgtcggctcctcacccgccgccgcccgccagccgcaagatctgtcaaccgagagagagaaggagtgaaaaaaaacgctaaaaggtgggccccacctgtttttatttgtttttgctgactgtatcgccacgtgtgtgccacgtaggctgaaaaccgcttcaaagcgagttaggggggtaatttattccgttttaagtgtttggggtgttaaatgtccggtattatagtttcgggaggtaaatcgtactaccgcaatagttcaggggataattcgtactttttccaattaccatatgtttgatgcatcgatgcaggctgatcgtgcatgcatgtttaatttcttacatgcctgtggttgatcatcaggataccaagtctccgaccacaacgtgttctttatgggaaaactgataaacaaatttcatcacttcagttaaacggaagaaactggatatataaatatggatgtctatgcctgattctggaagccatacagatatacagacaaaaacatctcgagcgagcacctgacaggcatgcacagaacctcccaaatggtatactattggtgcctagaccgatctctgcacgctcttgtaaccacagatcaatctgtagcccgaggtattgtgccgccgactcctgcaaccataggatcgatggtgcaccattcaatctactattcaatatttaatatactaactaagtcacttgggcatagttttagatcttggacccatggtaaatttaaaatttttacgttaaattatagcggtgcaaagttttaaattttatctaaatcgggaattaaatgatttatctaaatgttatcaacgtaatcgtagatctagattcattgatttgtaaagctagaaatacccatctctaataaatcttaatttgatccaaaaatgtaccaaaaagatctaagtacattgtcagatttatacaaacgtattggtattgagttgcacatttgcataatataatttagttggatttctcaccacacaacgcaacttactattgctttcatgatatgccacgttgataaggtaaggatcctgctgcattatagggactatagctagtctagagattccgtgaacgaggtggaaacaaacaagcacacagattcacaatattgacagaaaggtattggaaaaatacttgcggcaatctattcgtcaagcgaataaatttttcatagatattaataaataatgttggaaaaatgctcgtggcaatctattcgtcaacttgttttccacattggagtatgccgtgggaaaacttagattcaaaaccacctaaaaatgtccgcatgtgattaaatgtccggatttaaccgatgaggtgtgtgttgtcttttttttttcatagttgagggcggtataaatcatattaattttttcctatagtagatatggaaaatctagttattaaccctatacaaagctgtgttgtttcacattttatacaagtttaggctatatgtattgtaactatagtcggttaattaagaaacaagaaaaatcgcataatttgatttggttactttacaatgaggagatacccttctattgtttgaaaaattcctaagagggtaaaacaaatatctaataaataaactgtggatattatgggtaccccatacccacacggcatggttatccgactagttataggggataacttatatatatgaaatatgtaacatatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggaggccctctagggggcaggagacaacctgatcgtcagatctatactacacccggcggattcaaatccccaaacaggagtagggtattacctctcattgagagggcctgaacctgtctaaatcctttgtctccacatccatccacttttaggtctcgtgcgctaccccgttttattattgccgaatccatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccaccactgctgataacaacaacgacttcaccgccggcctgcctccgtcgccgccgactggtgtctccgcctatatggttggttggtcacaccaccgttgttgggcgtctacgtcttcaccaccggcctgcctccgtcgccgccgactggtgcctccgcctacacggctggcctattatgccgctgctgttgggcgtntacgacttcaccgccggcctgccttcgtcggcgccgagtggtgcctccgcctacacggctggcctattatgcccgtgcttgtgggcgtctacgttttacccgccggcttggctccgtcgccgccgattggtgccctccgtctacaccgcttgcctattattgccgcgttgttggcgtttacaatttcaccgcg

SEQ ID NO: 4001 - DNA, 712 bp, Oryza sativa
  unsure (1)..(712): unsure at all n locations
ttgcccgccaagtggtgcctccgcatacacggtgggcctattatgccgccgttgtgggggtccagaacttcaccgcgggcccgcctccgtcgccgcngattgaagtcctcgcctatacggtcggttggtcacaccaccgttgatgggcatcgtcatttacaccgccggcctgcttccgtcgccgccgactagtgtcatcgcctatacggttggtcggtcacaccaccgttcatgggcgtccatgtcttcaccgatcggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcctgcacggctggcctattatgctgccgttgttgggcgtctacgtcttcaccgaccggcccgccttcgccgccgccgactggtgtccacacctgcacggctggcctattatcacaccgctgttgggcgcctacgtctacaccgccggcctgcctccgtcgccgccgactggtgtcatnnnnnnnnnnnnnnnnnnnnnnnnnnnnnnnngggtcggtcggacgcnatatccaaannncacac

SEQ ID NO: 4002 - DNA, 724 bp, Oryza sativa
  unsure (1)..(724): unsure at all n locations
cactggctttgtttgcatntccnattgaagaacctctgctatgcactgagagatcccctcataatttccccaaagcgtaaccatgtgtgaataaattttgagctagtagggttgcagccacgagtaagtcttcccttggtattgggtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcg

SEQ ID NO: 4003 - DNA, 6836 bp, Oryza sativa
  unsure (1)..(6836): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatctattcgaatagccgcgccctcggttatgggcaagccgagcaatgtacccaagttagtgttttaattcttaaaacctgcttaacaattaaatatggaatggttggcctgggttggcttgggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaattttcccaagcccagatgaggagttcctggaagatgaaggctttggtgtctagctcgtgcctgccgtcaagtgcctgtggtcgtcgccctagtcttccgctgtttttcgttgtctttgagtgtgctgggccttcgttgcccgtgtaataatttttatttacgcttccgcttgttaaactctgaattgtatcaacttttggtgtaccttgcctctgggacaaggattaatgcacgcacgtcaggaaagcccgttgggttatttccggtcgtgacatgcagtgatcctcgctggctctcccgagcggacttcgctggcagtcaccgcgggtggagattctttccccgccgcttgcaaaacgccgcttttctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcatggttatgccggtgtgtggtataactgtgtcggagcctgtctttattttatttgcctaagcaacttgaactttaatgaacccatttaatagcagtaataaattcaagaattatggtagtcgtggatggttagctttaattgtcagctctccctctgtttgctggttctgtgtggggttttcagatggtgacgaccaggagaagtgctgccaccggtgatggcaaccaacctgaaggcagcaaccaccaccagggcagcccacctccacctcctcctccgcctccaccaccaccgccagataccaacgccattctcacccaaatcctcgcccagcaggccaacatgatgactgctttcctccaccacctccaaaatccgccacaacataatgctccaccaccacctccccaacactctaaactcgccgagttcctccgcatccgcccacctaccttctctagctccaacaaccccgtggatgcgttggattggttgcatgccgtgggaaaaaagctagacactgtgcagtgcagcgatgaggagaaagtcatcttcgccgcccaccagctgcaggggcccgcatctctatggtgggaccatttccaggctacgcagccagaggggcagcctattacttgggcccgtttcaccgccgctttccggaggacccatgtgcccgccggagtcgtggcccttaagaaaagagaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatctggatttccaacgtctggtggacaaaagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgctaccattctgttcgactctggagcttcccactcgtttatgtctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttccgaacttcatcagataggactgtcagaaatccccatcgtcagagagttcggagacgtgtttccggaagaactacccggtatgccgcccaaacgagagattgagttccggatagatcttgctccaggaaccactcctctgtacaagcgaccctaccgtatggcagcaaatgaactggctgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgaagaagatattccgaagaccgcattcaccacgcgatacggattgtatgaattcacggtgatgtcgttcggtttaaccaatgctcctgcctttttcatgaacttaatgaaccaagtgttcatggaatacttggataagtttgttgtggttttcattgatgatattctggtatactcacaatcagaggaagaccatcagcaccatctccgtctggtattgggaaagttgcgggaacatcaattgtatgccaaacttagcaagtgtgagttatggttgtccgaagtcaaattcttagggcacgtgatatctgctaaaggagttgctgtggaccccgaaacagtgaccgccgtcactgaatggaagcaacccaagacagtcactcaaattcgcagtttcttaggtttggcaggatactaccggaggttcatcgagaacttctccaaagtcgctcgacccatgacacagttgttgaagaaagaagagaaatttgtgtggagcccgcaatgcgagaaggcgtttcaaactctcaaagaaaagctggtttcctcgccagtgttaatcttgccgaatactcgcaaggatttcatggtgtattgtgacgcttcgcgccaaggattggggtgcgtgctcatgcaggatggtcatgtggtggcctatgcctcatgccagctacggcctcatgaaggcaactaccccacccatgatttggagttagctgcggtggttcatgctctaaaaatctggcggcactatctcattgggaatcgctgtgaaatatatactgatcataagagtttgaaatacatcttcactcagtcggacctgaatcttcggcagaggagatggttagaactcatcaaggattatgatgtgggaattcactatcatcctggtaaggccaacgtggttgccgacgctctaagtcgaaaaagccattgcaacactcttaacatccgtggcattccaccagaacttaaccaacagatggcagccctgaacctaagcatagttagtcgtggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccctatggaacggaaatcgggtatgcgttccagataacagagaacttaaacagctgatacttcaggaagcccacgaaagtccttattccatccaccctggcagtacgaaaatgtacttagacttgaaggagaaatactggtgggtcagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggttgatatgattctatatgggtagttgtggatcgattaaccaaggtggctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcatatcacccgcagacagatgggcagaccgagcgtctaaatcagatcctagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccataacctggaattcgcagtggacgattttgtgtaccttcgggtcacgccattgcggggtgtacacaggtttcggacaaaagggaagctcgcacgtcggtatgtgggtcctttccgtatcgttgcccgacgcggagaagtcgcttaccaattggagctgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtaaaaatcctggacaccatggagcgcaggaccaggaactgggtaatccgtttttgcaaggtccagtggagcaaccacgccgaggaagaagctacttgggagcgtgaagacgagctgaaggcagcccatcctgatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaatggttttataaaaagaaaacccttaaagaaggcatttccccctccttcctcctttttggggcgggtttgacccatttccttcctctttttttatttttcccccccggaccattggttcccaaggcttgggcccggttgaaagcggcccccccgccgtcttgttg

SEQ ID NO: 4004 - DNA, 1554 bp, Oryza sativa
  unsure (1)..(1554): unsure at all n locations
ggcgcggctccnccgcgccggtggtcgccggcggcgaccatcggggcccgggcgcgccgcctcccgtcggctgtgccggggtgaccgccttcgggcgcgccccgcggctgccatgtggggcccggccgtcagccgcccgcgccctcgggtgcggctgacgcgcgggacccacggcgccggccggcgtaagccgcgtgcacccggtccaccgtggaccgagaggctgccgtgtgggccccactcccgtggacccggtccgcgcgctcctctctcccggctgacgcaataaatatgttttttaaattaaaatttaaatgaagaaattcgcaaatattcaattaaagagcatataaacttcaaatggccataacttggccatttgaactcggaattggaccgttcaagtctctaatttttccttaagaagtcaagaactcatttttgtgctttgtttctgcttgttatatggagtttagtagagtaaaagccgtttcttttccgttggtcgtgtagacgctgcagcttcggaagatccgctcttcgtggaagttgaagccggcgtttgggaaagcgagcaaggcaagtcacatcatccttgaacatattgaatcccagtttataaaattatgttgctttaaaattattgcattatcgctttatttaaattcccgcgttatcactgttttatctagccaggcctatttacctttgttatgaccttattattgttattgttattatttccttgttcaccctagaataaacaaaaccccaactagtggacactctactcatggtaccactagtatgattttaggtagatgcttcgctgattaattaggtaacattaggtgattttacaactctagactttgggttattcatatcacctggacactatggaatggtttggttattgtggaattggcttcacaccgctccttctattcaaaatccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaagtgggattgggtcggtactcttgtctatggctaggatgggttggaaactatgtcacgtctttcgtctgtataccggggtggtatgtggcacgttggtacacgtgaagaagatgtgtcttgggggtaaagatgtacacctctgatcaagagtataaattctttattttttcccgcaaaaaatttttaaaggggggcccccccgcgccctggttttgggcaagccgagcaatgtacccaagttagtgttttaattcttaaaacctgctcaccact

SEQ ID NO: 4005 - DNA, 2393 bp, Oryza sativa
  unsure (1)..(2393): unsure at all n locations
nnnnnnnnnnnnnnnnnnnnnnnnnnnnnnnnnnnnnnnnnnnnnnnnnnnnnnnnnnnnnnnnnnnntttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattactattaccttgttcaccctagacaagcaaaacctcaactagtggacactttactcatggtatccctagtataaattttaggtagatgcttcgctttaattaggtaaccttaggtggttttacaactttagactttgggaaatattcatatcacttggatactctggaattgttggtttattgtggaattggcttcacaccgcccctctattcaaaatcccctaaaatggttttaggctgggctcggggtgcgtggttttgatggtagcacctcggccgtataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacatgctccagggcaaatgaaggctacacgagctgcggcccggtagtcgagatgtcaaaaagcacagggttggtgccctgctgcgaggggctcagttccgtctgcctgtcccgggggttccggccgtaggcgggattgggtcggtactcttgtctaaggctaggatgggttgtaaactatgtcacgtctttcgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaattttcccaagcccagatgaggagttcctggaagatgaaggctttggtgtctagctcgtgcctgccgtcaagtgcctgtggtcgtcgccctagtcttccgctgtttttcgttgtctttgagtgtgctgggccttcgttgcccgtgtaataatttttatttacgcttccgcttgttaaactctgaattgtatcaacttttggtgtaccttgcctcctgggacaaggattaatgcacgcacgtcaggaaagcccgttgggttatttccggtcgtgacaagttggtatcagagccttccttgaccctaggacgagccgtagatcccaagccttagctatattttcaaaaataaaaatcctttattatttgtgaaaacccgctattctctctttgtcttgctgcttcatttatcgtcaaaatctgatcttttaaatgttgcttttcttttgtttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggcggagattccttccccgccgcttgccagaacgccgcttttcttcgcatcggaaccctttaccagcgcttcccggacgaggtgcagcactcgcctaacgtn

SEQ ID NO: 4006 - DNA, 1684 bp, Oryza sativa
  unsure (1)..(1684): unsure at all n locations
ngcgtttccaaagntcattgnagngccnnccgcgnggtgggtataggcccccccccancgannacaacccctaatgaaccaatttaatagcagngatttttttattaataatagcagncgcgggggggggggtttaatcgtcagctctctttctctgcttgctggttctgtgtgggggtttcagatggtgacgaccaggagaaatgttaacaccggggaaggcaaccaacccgagggcagcaaccccaacccccaagggaatccacctccaccaccaccaccagacaccaacgccattctcacccagatcctcgcccaacaagccaacatgatgaatactttcctccaccacctccaaaacccgccacaacagaatgctccaccaccaccaccccaacactctaaactcgccgagttcctccgcatccgcccacctaccttctctagctccaacaaccccgtggatgcgttggattggttgcatgccgtggggaagaagctggacactgtgcagtgcagtgatgaagagaaagtcatcttcgccgctcaccagctgcaggggcccgcatctctatggtgggaccacttccaggctacgcagccagaggggcaaccgattacttgggctcgcttcaccgccgctttccggagaacccatgtgcccgctggagtcgtggctcttaagaaaagggaattccgggagttgaagcaaggcaaccgctccgtgatggagtatttgcacgagttcaacaatctggcccgttatgccccggaggatgtgcgggaagatgaggagaagcaagagaagttcttggcaggaatggaccctgagctgtctgttcgtctagtctctggagactatccggatttccaacgtctggtggacaagagcatccgcttggaagccaagcacaaggagctggaatcgcacaagcgccgcttggcgaatttccgcaatcaacagggtgctaaccagagggtccgctacaccaatccctacccagggggatcctcctcgcaacagcagcagcagcagcaacctcgcccagcgcctcgacctcaattcgtggtgcgcgtcccacagccgcagcagcagcagaatcagcaagggactcgtgcaccccgtcctcctacgccaactgtgcagcccgttcaaggccgcagggacgcttcaggtccgcagcggctgtgcttcaactgcttcgagcccgggcactttgcggataaatgcccaaagccaaggcgtcagcaaggccaagcgcctccccgctccaacaacggcgggaaggatgtcattcggggccgtgtgaaccacgtgacggccgaggacgtgctgacgactccagacgtcatcgttggtacgttcctcgttcattccatccctgctacaattttgttcgactcgggagcttcccactcgtttatatctgtgccattcgtggggagaaatcagttgggggtagaaaggcttagaaaccctctgctcatcaccacccctggcggggttatgacagcaaagtattatagccctgccgttcctatagaaattcaggggattccttttccctcggacctgattcttctagacacaaagaacttggatnnnnnnnnnnnnnnnnnnnnnnnnnnnnnnnnnnnnnnnnnnnnnnnnnnnnnnnnnagaggttgacagcaaanaacgtcg

SEQ ID NO: 4007 - DNA, 1602 bp, Oryza sativa
  unsure (1)..(1602): unsure at all n locations
aaccatatggacgaaaatcgggtatgcgttccagataacagagaacttaacaagctgatactcaggaagcccgccccccggaaaaaaaaaaaaaaagggtttccccctttttattttccatccacccctggcagtacgaagatgtacttagacttgaaggagaaatactggtgggtcagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtaattgtggatcgactaaccaaggtagctcgatttattcctgtgaagaccacctatggaggaaataaactagccgagctctacttcgctaggatcgtgagtctccatggcgttcccaagaaaatcgtatctgataggggaagccaattcacctctcacttttggaagaagctccaagaagagcttggtacccgactaaatttcagcaccgcctatcacccgcagacagatggacagaccgagcgtctaaatcagatcctagaagatatgctccgcgcatgtgtcctagatttcgggaagacttgggataagagtctcccctatgccgagttctcctacaataacagctatcaagccagcatacaaatggcaccctatgaagcgctgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcagacaaaagggaagctcgcacctcggtatgtgggtcccttccgtatcatcgctcgacgtggagaggttgcttaccagctggagttgcccgcttccttgggtaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgggtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaaacgactctaaaattcatcctcgaaattgtgcaaagaataattaaaattcatgtgaaagcctccaacaattaaaatgtgcaaagataaaagtcaaatgaggcttggagnnnnnnnnnnnnnnnnnnnnnnnnnnnnnnnnnnnnnnnnnnnnnnnnnnnngggcatatcgtncatcattaaannnnttctcacc

SEQ ID NO: 4008 - DNA, 1016 bp, Oryza sativa
  unsure (1)..(1016): unsure at all n locations
accccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacttcttaaggaaaaattagagacttgaacggtccaattccgagttcaaatggccaagttatggccatttgaagtttatatgctctttaattgaatatttgcgaatttcttcatttaaattttaatttaaaaaacatatttattgcgtcagccgggagagaggagcgcgcggaccgggtccacgggagtggggcccacacggcagcctctcggtccacggtggaccgggtgcacgcggcttacgccggccggcgccgtgggtcccgcgcgtcagccgcacccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4009 - DNA, 731 bp, Oryza sativa
  unsure (1)..(731): unsure at all n locations
cgggncttgatttgcattgcnnnnnnnnnnnnnnnnnnnnnnnnnnnnnnnnnnnnnnnnnnnnnnnnnnnnnnnnnnnnnnnnnnnntcagtgttgccactggctgtcgaaaactttgtcatgtgatgcaagcatgagtgttgtaaagacctctcccctgtgtgcagtgccggacattttatgcacaaaggaccatgcgacggttgcccaaattttctctacctggaggggaaatacacaacgccgtcacttgaagaacaacgacccgacttgtagaactcctgcggtatacaaacttagtgtgccaagggtacactaatcatttcaacagatgcatgaataaacaagaggaaattcttaattgccctggcaaacacaagcgctatcaggatagggacaggtcacctgatagagagtaactttaaaaacggccagtgtggggaaggactgcatgccgtcaagttgaattgatatcaacctataagagtataatatcgctttcttccctttctatctttctaggttgaaaggctaacaatcgtcaagatgatcaacttgtgagatagattcatgagatgaaactgnnnnnnnnnnnnnnnnnnnnnnnnnnnnnnnnnnnnnnnnnnnnnnnnnnnnnnnnatggacctcaacgtgatagaggtgtctagacctttaagagctgtatccagcttctttatagtgcactcatgaaacgaacttggacgactc

SEQ ID NO: 4010 - DNA, 1961 bp, Oryza sativa
  unsure (1)..(1961): unsure at all n locations
ttgcatttaactccagtttttaaattgcacttgtagttgtagcatggaagaagctacaaacttacctccaggttttccacttcttcccttcgaataaagagctcgtcgtccatttcctccgtcgcaaggtctccctcctcccatgccaccctgacatcatcccgacgctgcttccgcatcggtacaatccatgggagctgaatggtaagtctgcaactgcattgatcaatatgatttcactaatttgttctcttacaagtcatgctgagtgctgatagaaattgcaattttaaggcaaagcactgcaagctgggaaccagtggtacttcttctgccatctaacacaaagtaggacctcatccaatgggcactggagccccattggagttgatgaaacagtaagaagcggcggccgcaatgttggcttgaagaaaacgctgctattctccattggagagccctctgaaggcatcagaaccaactggatcatgcatgagtaccatctgctagacggggattgcgtcgctggcggtagcagcaacttgactagctcgagctctaacaggaggtctcataggaagagaggccactcaagcatggtaagtgatgcatatcctctctatcttgctgctcgatcagcagtcaacagttcagtaaattgcgtataaggagtaactggagcacaaaatactaaaatttatgcatgatcattacaggagtccaacaactgggtgctgtgccgagtgttcgaatcgagctgcggttcacaagtgagcttccacggtgagggcaccgagctttcatgcttagatgaggtgtttttgtcactagatgactacgatgaagtaagtttgccgaataaatagaaatatagaacctagctaagtcagtactcgttagagctgacagtaggtcctatgcctatcaaaccatttgattagctatggccgggttatgttgatgatatctatacataatctgttgcattatgaataattaaatggtctgggaggcattgaacccaatccagtccatcctagataattaccatgtaattagttatcccccaacgagtatgttgggcttgtgtcagacaactgtggcatatgtgtgaagcacaagtcgcttctaaaaagatgagtttttttttctcgtttctcgcatatggtggtctactttggctcatgaagcattcaaaattttaatataatcaaagcatgcacttcatgcagcttgtggtatatacaaatctagaaatataactatttataagcttgtgtagttgcttgctacatcaaactatcttcgcatctgtatggacattgtgttctatcaccacaaagaaaaaaggaaggtgggtggagcttacgcgatcatatggccatctatgctgtcaatggaaatcatgcatgcttgtgtggaaatcgcgctcagatgaactcatcaaacttgccagccccggttatcatgtaggtggaccctgctagagttttcaaccctgattgatctattgcctaatggacggctttaggacattaatagtgggacagtgcctattgagtaactttatactgaaaagtttttgacaaattgagaagtttactcttggaaatgctatgatatatgactaatgcatgtacgagggggagttgttaatttgcccactcatcacttcagatgcatgttattactttttaaaataactaaacagtcatgatgaagtttaatatatatgtaagtgaatggggacacttgacaaaaaaagttcaattaaagttatgttagtggtctatatatgttactcatcttaattacttcctccgtttcagattataagactttctagcattgcccacattcatatagatgttaatgaatctagacatnnnnnnnnnnnnnnnnnnnnnnnnnnnnnnnnnnnnnnnnnnnnnnnnnnnnnnntctaggttaatcaaatctcc

SEQ ID NO: 4011 - DNA, 13799 bp, Oryza sativa
  unsure (1)..(13799): unsure at all n locations
tactcagactcttggnngtggaagnnnnnnnnngggnnntgtcttccccccccccccccacacaaaaacacagtcgccaggccgagcgctatcctgagggccctttgttttttttcccccccaccgcgggggggggttccccgccgcggggnaactaatataatcctcgccgaaggaggggaagagaaaagggaaggtaccggggtatcatccaaagtgggggcatatgtgaaaagtcagtgtaagtccctctttccctgtcatctctcccctactaggcccatttgccctctcccccctccatccatccatccattcatccatatctcccttccttttgccgtccctttttcttgatttgattcttcttcctcccatggtctctcctcttctctccccttccttacactaacagagagctcttcttcttcttcttcttcttcttcttcttcttcttcttcttcttcttcttcttcttcctctcagctagccgtgctccggctgcgtgagatgtaagacgacgcgcgaatcaaaaatctcaaaatctcaagaagccaagaacagcagcagcaagtagaaggaaaaaggaggagagaattaagagggaatccaagaacagtggtaattaacgctttaccaatctctctctctttttctctcttaaattatttctctcctggattctttggtttgccttgtttgacggtagattagaatcgtgttgtttttcattttcatttttatgtttattagcgtcgaatgattgcagtcttcgtcaatcaggtgggccgacacaaccgacttgctgttcgggtctctgtttctttccttcttcttcttttttttctgttctaagtatttttcaaaaaaacaaaacaaaaaaaaataaaaacagagagagttttgtcttggttcttggctggtttgcatcatgttgattgggaaagcaaaaatctctctttcgaagccccccatctgccctactgttgctgctgctgttactactactgcctccatcagccgtcggctgcagtcgccgaccggtgggccccactcgtccactttgttgcaaaatctctgtgtctttattgtttcttctggtcgcgatcagagggaggagagaattaattaattaattaattaattaaaggggaaagaaaatcatggatgttatgattggagattggatggttggcttgtgacggcgcatgtacactgtagtcgtatctctctggtagcaccacgtacaattaattagttaattaattgcatagagttttttttttgttcatttttgtttgcttgttttgggaagcctttgattgatgtagcagtagcagtagtatagtactgtagttaccgtgccacacgctgctgataggaggaaggggggcgcgtggcctatctggaccgtcggatggagatcggacggaagggagtgctccacgtggcatcgagattccaatcggggaggcgccgccgcccgccgcacctgcggaaagcggattccctttttgggaaagcgtaaagcgcgcgtggctggctgcctggcctcctctcgcgcagcggattgggcccgcctgtcggtgacaggtgccccaccgggccacgtggctggctgaccaccagtggtagttgactactccgcaattaactactcctacctggataaaaggcaattatgtgccaatcagaaattcagaaatgtgaattcctcttaccagttgacttgagaccatgtggattaccaaggcaaagatgatttggtctatcaccctgctgattaatctaccctccgttcaaaaaaaaaatcaaaccctatatttaaatttggacatatttgattttttttacagagtagtaggttaggtttaggtcttaggacatctctgtgattagtgattaatccccaattgtttcaagtacttgcttgcctatttgtaagtaactttatactctctgtttgtttcagaaaaacaacaaaaaaaaaggaacatttcacattagtatcttcatacaaaatcgttcacctaactacaaactatatacaatagtgaaccgatgacctttctcgcacttaaaaatcttgaacaagattacttgttttgttaaaaaaaactattcccttcatcatgtggatatagtaatctacaactgaaatggatgttttataatagatgtatcccatccgattctagattgttatattctgagacagagcgagtaaatctgatcattttgcatttaacttttcacgattatttgctctttaaactccatattgttcaaaactgggcaatgctccatctattttaaaatacaagacataactatccttagtccaaagaccaaaaaccaattattatcatttttcttgttcatatcatcataataaatacaatacatgcacccaataaaattagagatattgagaataaatgatttaaataataacatttaacttaaagttgccattttcgtattcaaacacgtgctactaactgacaggtgggccctaaccgcggcatgcaacgctggaaaaataagacctaatcaaccgaattttttatttatattaattaataagtcttgaattaaataagtggtaaatcttaaattgaatttgtaaaaataggatggacgttgtttcaaagggcgtccagatttggacgctgttccaagaagtgtccagaggtggacgctgtaccgaagcacgtccaggctcggtttggggcgcccatgccgccatgcggagaggcgccatcgtcgactctcctctcctcaggcccaatgttggtgcagggctcgggcaaggtgctgccatgcccgccgttcacctcgactctgggagactgcaacagccgccttccggcttccgtctccacaatgtcaggaatctgccattgcagttcacctcaactcacctcgaaggctctcgaatccggagaggacgccgccgctttttgccttcacaccgggaggtcgcagccgctatccacgttctggttgagtcatgctggaacaataacccactcgtgccggcttgtgttgcgtcgtctgtccgcccctcttggttcctaacagcaagtccaggcattgcctcactccaggtggctggccgagcaagtatgctcagttcatagattttggtattcaggtgtatatgttcctgcactagaaagtttacaaagaatgcaaaattacgaagggtaggacgcaaacattctacttttatcagatcatctgtcgccccgatgacttccaatctctggcttgttgcaaaaggaaaaaaagcatcgatcgaaaacctcgcatgcagttcatctggcggccgcttctcaagattcagtcagcagagagctcgatgcgtagtaaacaatggaccagaacaaaaaccaaactaatcaaatatctcaaaataaaagtggtggctgttcacatatgaccccgagtagagtgtccgtcatgcggaacagcggaagcattgaaggagagccgggggatggcgaccctgtctggcagatcaggtagagagcggtgcctactcggcaagcaagcaatcaacaagagacaatagtctgcataggagtaacgaggcagagttcgaccattgtgtgattggatccaaagtccaatcttagtccggtgaattggacggctctgtggggtcttcaactgcagcattatggacgcccttgtaagaagcgtccccatctggacgttgtctacaacagcatccacacctggacgtcctatgcaatagtgtccttcctattttcgtaaaaattgactttgctttattatatatttaatttctgcattattaattattatgaataaaaaattcggcctaatcaacatcacaacaagaacctctgaaataaaaaaaacacagtaataacaggtataagtaacaaaccacaacgaaccctaataagttcagataatagaaaaggtcttctcaagattcagtcatggcgatcgccgcaagcagggccaacgccaacgccaaccgaagccgccaccatcatcaaccgaggcggtgggaaaaaaattcctcccaatgctggcacgcacgcgcactcgctcgagaatccggcgggtgggactgaaaaaacaaaacaaaaaaaagcagatcgattttgtcatctgcggcgcaaagcgggtgtgcatttcttttcttttatccccacatccagtcaccgtgacgtggttcttgattcctcaggccgggcgattattctagctctagttgggatgattggattggatccccagccagcagcagcaagcaattcttggccatcggttgtgggtggctgttgattcatgcatcacgagcactcaataaagtatgcagatctgtgcgcccctctctgatttgttcatccaggcaaaagagtatcttgcttctgtgaggtgaggtgattgattgattgatcaatgggggtggattgctttcagggagatgtgtatatgttgtgtttgcagtagcccatggtttcttggcaattgttagttttctgatcacagtggttcaagttggttgcctttttttatggttataagcgatgtgctctgaacttctgatccagatttcgatccagttctgcctgcgattcttgagtttttatgtgttccatgtcagtgtctgaatttttgacaggcagttttcagggtgagcaggtgcgttcaggtttcaggtatcgttgtacagaaattgactcgaaactgctcatgactttttcaggatactaaagcgtgaagtgttgggggttagcttttgattgaagccatcgaaaattttccagtgaactttcaggccctgctgaaagaagaatctactgaaaggttggtctaatctactctctaaagtaatttagatcttctttatgaggagcccatcattggtccggtgatgattttaagatcgaagtttctaccctcatgattggaaactatcacagatggttcacaagacgaaactgtgtacttctgtttgcttatatatatctgcatacctcgcatcatgacagtgctggttttcaactcgtaattctttcagagggaagattcgtaaccttggaagatatgctgccttactttgatccggagtatgagaacttcagtcagcgcatcaaccctcctaggtggatctctaatttaaacatctaaattccagagctcctcatatcattatcctgtttcatttcaggctattgtcggaagctccgctactttctgtagctaacaagctgataattttctgcagggtatgcattgacaacagcacctgcagcgactgcaccttagtgaaggtaagaactacttactactctctctcaaaacttgactggataatcttactgaacactgcttccaatattcaagaaccgtttcactgattgcttcgagcaccgtctgtttgcgtttggaggtaggtcgacagcatgaacaagaatggcatcctgttggaggtggtgcaagttctgagcgatctcgatctcgccatctcgaaggcgtacatcacctctgatggtggatggttcatggatggtaaggcagcctatgctatgcaattatatcatatatatgcaaactcatgtatggttcgcggacatcaattgccggtttattcatgatgtctgttacaacctgatgcagtgtttcatgtggtggacaagcaagggcagaaggtgactgatgagaagaccattaagcacattgagaaggtttgtaattttttttccacctgaaaattggtcttaaaatttaccacctgaaagttgaaaacctattttatcctctatatcaagctttcagaattatttttggtgcaactgcatcctgatagtgtttggtttgaaagtattggtagtttaggtgaagtattttcgtatctgttcatcatgtcagtatgtgtttcagtttttgaaaaacattttaaaggttttcctttaatgaattgcaaatttagacggcagtactatttttcatgaggtgtttggaatggatagtggagatatgaagccaacaattcctttgaaaactttccatgaaatcaagaatttttttgtgactatagatttacactgaagtgtaaattaaagttgaagtgaaaaactgaaaactgaagtggcagtatcaatttggttaaaattgcaggcgttaggcccagacagcaacctgctgggtggcgcgaagggcgggtcgtcgccggtgaggtcggtggggatgcactccatcggcgaccacaccgccatcgagctcaaggggcccgaccggacgggcctcctctccgaggtcttcgccgtgctcgccgagctcggctgcaacgtgctcgccgccgaggtgtggacgcaccgcgcccgcgtcgcctgcgtcgtgtacgtgaacgacgtcgcgtcggggcaggccgtcggcgacccgtgccgcctgtcccggatcgagcaccggcttcgcctcgtcctccgcggccacgccggcggcgacgacggcgacggcgacgacggcccggcgcacgccaacttcttctcctccggcggcgccgggtcgaacacccacgtcgaccggcggctccaccagttgatgcacgccgacgtggacgccgacgacgacgacggcctcgacagccgcgccatcgtgtcgggcgaggccgggaacgcggcggcggcggaggagaggccggtggtgacggtggagcactgcgaggagaaggactactcggtggtgaacgtcaagtgcagggacaggtccaagctgctgttcgacatcgtgtgcacgctcaccgacatgcactacgtcgtctcccacgcctccgtctcctccgacggcatctacggcatccaggtgtgtactctggactctagcatgtcaacagctgctactaccatatcgaagctcctaccacgacaatgctaagaatttcacatgaaataattcgatttgtagaaagaatattcctgcatttcaaaggagctctgcgccgcgactcggtcaacgttgacttttgacattgcaatgaacttccttttttttattttaatattgtcaggagctgtacattcgtcggaaggatgggcgcacgctacagaaggacgaagcagggagggtgatcaagtgccttgaagcggccatctccagaagagtatctgaggtctgaaccttctttgccactgtctgtacaagcaactagcatcactgcatcagtagaagtagtaactgttagtagtattttgcaaaagaatttctgagcttggctgcatctggaacaagggattaatcaggacatgttgcagattatggtgtatagttctcctagtagtaaagtcacattgattgatcgatacactcacactgaactctgttactagtatgtcggttttgctacagcacctggtaccacattaatctgttcatttttttcagtacactgtttcagttcatcatttagttctattaaccagtagtaacatactgcccttctacctgtcttttctccattttcatatatacctttgactgaattctgattctatttctgaaaaagaaaaaagataaaagtcagattgagttacatgcaccgaccagtacaatagctcgaacaccgagaagcaaatcctctgacttaactacacatgcatacacatacaattgagtcactgacatgtgagttccactttgatatggcgttaagtcagaggatctctttcagctcgaactggagcttgaatatgtgctaacactggtggttgatgatgcagggattcaccctggagctgtgcggcagggacagggtcgggctgctgtccgacgtgacgcgggtgctcagggagcacggcctgacggtgacgagggccgacgtcacgacggtcggcggccaggccatcaacgtcttctacgtccgcgacgcctccggcgagccggtggacatgaagaccatcgagggcctccgcgtccaggtcggccacaccgtcatgctcaacgtcaagaaggtgccctcctccccctcctcctcctccgccgccgccgccgccgccgccaacggcaagtcgccggggcagcctgcctccggcgccctgtccaggaccagcttcttctccttcggcaacctcttcgccaagctcagagcatgatataattcacctgaatctctgaagaattatggtccctttttcgggttgcgcaaatcgccataaggagaaggagatttcagttgaaattttagagtttagggggtgagggtgagaaactgcgtgtggcatatggcagaaaaagaaattgctgttgttgtatagtccataaaccataaggagctctacctaccagtgtaggaaatgagaaaaaaatgctggatccatggtgttggttctgttctgtgcaatgcagattgcagaatgcagactgctcttgagttgcatgaatgagctttttgagctatctgttcatcttttgtacagcatctttctagcagaagctcaaagaaatttcagtagatcactctttttggagtttgacagcattcatctggcaggtcagcaatcagggatgtcaatatgagatagaagatctttagagcagaggatggtgacagtaggcagacgataggatcaaaagttgatttttcatgtcagagttttacatgtgattttaaaatcagagagaaatggacttccagttacacttgttcttgctttctttcttttgacaactcccaaaccaaacaattacataaacaccacacaattcgataaaatctatatcaaaaaccaagaaagaatctactgttcatggacagaaaaagaacgattttgagctaatggcctgatcaccagtgctgcagtagaatctacaatgcacacccagacaaattatggtgatgcatgatccccaactgttcagaagcacataatctggaaagattcagggatctcttaaatagttgcaacctctctgctactttaccactcatttgcgtggttcaaagtcatcgtcaacatcatatgctgggttgcataagcatctgaataacctgccaattccctgaaccacaaaacatgggaactaatattagcaggcacttgattatgcaatgctttgctatgcaacataaaagctgcttagtttagtaattgcctgagtaactgcaggagtccgataaggcactgtccgagccacgtcgtcatctgaactttcatcagagctgctgtcatcatcgagaatggtcggttttgatggtcctggcaatgcctccttgtccctctgtttgtagtccaattgaattaatatggtatttgcaaattatgataaaataaatctcatgtagcggtatgaattatcctaatgaaaaggccaagtaacatatacctggaatatcttcccaagaattttcagtgccattgcacgagccttgagatcctctttcttgacattgttttcatgcaacacctaacaagttcaagagaatcaattcaatttaatgtactaatcattttgacatgttaacctggaagataagacaggcatgtcgtgctacttggcgatcgcagttcagatactaccaactaactattaatcatatcactgcaaatttctatgatatcttgaggcataccatttcacaaacgtgtagaagggtcacttcaatatcaacaatattcagcttccacagtgagctcatcatcaggtctttgttcatcctcatctgcagatcgacatccctctcggtggccaagccgtccttaccgctctgccggcaggcctcctcttgcagctgcagcaactgcaaggctcctgcattgttctttttgtcctctaatcagtcagcaattttaatgaatacacaccaaaagccccggtttgcgagattttcacctttcgccgcggtgatctgtgacctccataggtgacccttgttcctcacccactctgccaggaatgggactccaaggtacatggccttcttgccaagctcctttgcagcttgccgggagtacacatatccaattgtgcgaagaatgtctagtccagatgctgagcaatggcatttcagaacagttaaaagaagcttttcttagattggcatagagatcgaaatgaattgcggggatcgatcagactgacaagtgctggacagcctcttggcctcggattcggcacggcttgcgaatccttcctggtcaccacgaacgtattgcgagaggaactccttgaggaatcttgctagcttctcttctctttccctttgcacaccctttgtcacaataaacatagaacagaatggttagtatcaactagtctagtgccaacattccatcagaaaggagagaaaaatcaaactggctttggagcatccataatcacagatggctgcaatggctattgagctcactgaccttgagcctgtcctgaagcttttcagggttgtcattgtcgctggccatctcggaggaagccattgttgccattgcaaggtggccaatgtagtcctcaaacagctcactcccgaaaagaagggtgaacaccacagtgccatccagcatgttctccctgaaaaaacaaacaaaacaaaacaaaacaaaacatttgttaacctgaaacttgaattgccacagactgcagagagtcaatcaatcatctcagatgggtttgtttggctacttggaaatgctggtcttgccatagccatcgtaggccttcctctgaagaggatcactcagcacctggtaggcctctccgagagcctgcaaaaaatccacccaagaaagctcagctggtcagacaaagcaaactgaatttaattaaaaaaaaaccatccaagcaagaaaccaacttgagctgagtagcaggaaacaacctggaatttctcggcggcttgcggatcattggggttcttgtcaggatgcacctgcctcgcctggacatcaagaaaccaaaaaccgaaaaaaaaaaacaaatcagcaccgactctccgagcagagttggcataacaagcaagaagcaagaccttgatgtagtaggccttgcggatctcgtcgtcggaggcggcggggcagacgccgagcacgtcgtagaactcggtctccttcgccatgaccgccgccgccgccgatgctgctccctaccccaagaacaccctcccgcaccaagaacaacaacaacaacaagaagaagaagaagaagaagctgggacaggatgaagcagacagagcatggatggggaactggaaagtgcaggtctggcgatcgatctgggcggggggagggagaaaaggcgcatcattcattcataccgcagtggagaggggccagagcagaggggggccatctttccagtgaggacgcgcaagcgcagcggcagcagctgggcggcgaggcgatgctggtgagggaaggtggtggcggacatggcgagctaaacaaatggcgcaaatgcgccgcgcggcgcgaggtggcagaacagcacaggtcgcccggttttctttctcttttttttgaaaaaagaaacttatttctccttttgtttttctatatttcctcgctccttgggggcaaatgggcagtggaccccggggaatcaaatcaagcatttttaaatggttactactcgtctgctccctccatcccatttcaagtacggttgtgtatttaagcgttcaacattttaccgtacttcttatttgaaatgctttttatgattattattttattgttgttagatgacaaaacatgagtagtgctacctccgtcctaaaatgtagctatttgtagcacagtaccgtgtctcaaaatgaagctatttttctacctacctcctcctctcaaccaatcagaaccattatccttcacctactttttttttcaaccaatcacacaccttctccaatcattctcacctacttttttaatgtccgtaccaaccttaaaaatacctatattttgggacggaggaaagtcttttatacatgacttaattttttatgtttttaaaataagacagacggtgaaacgttagacatagaaaccagaactacacttagaatagtacgaagtgagtagattattatacccttaccttttggttaaacaggttattaattaatgtttgtgaaagagatgtactatgagtctgtgactgtatgaaactggaaccacagttaagcgtaagtgcctagcccgtagcccacttatagggttatagggtaagcgacctaaggcctcgtttaattccaaactttttcttcaaatttttaacttttctatcacatcaaaactttcctacacacataaatttctaacttttccatcaaattatttcaatttcaaccaaacttttaattttagcgtgaactaaacacaccctaaagggggtttgcggactacctactttctcccctaataccagacccacaacctatatattcaacatctccacttataagtaaaatgagaggaacgtactaaacacatagaactatatagccgggacatgttagtgaatagtgaccatgatagggttatacataaaaggattagctttgagggatggggaaaaaggaatttgaaaatttcggaatataggtgtgttctttttagagaaacttttgaaacaggggttttgtgcaaatttgtagttagctactccatataagataaaatgggagtggctagaatttagctgagaattttcaaaatttccagtaacttatctcgttactttaatgtcaatccaataattatcattcctagtccttttttttcttgtataaaacgttgaaaaacatttatacataagttttacaaaattacatgcaaaattttttacaaaattacatgaaaaatatttaaacatggataaaaataaagtaaatccatatagcaacaaacttacagttaaatagaaataaaaatgcaccttgcatactattataattttagacttatgagtgtgcaatttcaggtgattgaaaatatgcaattttccatgtgcttgaaatctagtaataccccaacaaaatagtgcacacatatatatagtaacataaattggtatttatatagatgtatctttgatttgattcagtcttatgtcaatatatatatactaactcctgcatgttattaatcacttcggtttgagatcccgcagaccttttttaaatgaaaggattgtgccttttgcttttccctttcttctttagagtttgttttttttttttgcgggattctttagagtttgttaatgaatggatgtgcatgattacgacttgtggacttgtggtagccacattgtttatgtaggagcaggtaaaaagcctagtcgttagtaagccatgacattttttgtatttttttcccacaaacttgtaaatgaaccagatcatctttttttaaaaaaaaaaacaaactctgattttttttaaaaaaagaattaatatctggaagtcttggaacaggctaaggggttgggttttggtttagcatgttaggtgccttgttttagggtgtccgggggtgtgttttttctgattgttgggcctctccagtgatacctatgctccagcgttagtctgttcccttaagtcacttgtttttctttgtgttgtgtaagacttctgtgccgttatcttcggctttgtttaaaagccgggtattatgaatgcctgttataaaaaaaagtcttgggggcaaatccaaaaaaaaacttaattattattttaaatattttagaaaaaataagtaccaatattttacaacatcctttctcttcttggggttttaaaattaaaaaaaaacccacn

SEQ ID NO: 4012 - DNA, 3984 bp, Oryza sativa
  unsure (1)..(3984): unsure at all n locations
tataaaacgcttgttatataatctactcgttttatataatnttcantccaccttatattgtcttttataactnnnctcnnnnnncatttancnnnctnnnntnnnnnccccccccnccccnnccaggcgttgantttgnantgtgtattnccacnnnnnnnnnnnnnnnnnnnnnnnnnnnnnnnnnnnnnnnnnnnnnnnnnnnncanaggnctgcgcanacggcacggattacgtttaattttcattctgcttgtgagtatgtcttactgataaaggcctttcagggtgcagatattgatataagggttgtgcgggacggtcgtggtccagattgcaatatttggagcaactttgagcaggtgattgattgaagttagctattattttttgcttagattctttcatcctgttgagatctgcttgattctgcgtgagctgcaattcttttatgacagttagttcttaaacgctgctcttgcctagtttttgacttggtatcatatagcttatgcagattatgtgtactaactatagtgacatttcggcatttatcacttgttagtaaaacacccgaggttcgtgtgaagtactaattatattgtcttcttcagtacaaattgccggaaccattatgtatactaagagcggataacaacgtcccaccttggcgtccaggattgaaggaggtaatactctgttgtgcggtttatacattgttgtatttttttgaattttacagttttgacagtgtaagcttgtactatatgcgcgactaaaaactgaaacaaatgtgaggaacgcataaagtgattcctgtacattcatgcaatattttagttgtgcttgaaatcttggatttgttatttacattcttgcattgctttatttggttgacattgcttgagaaaatggttgatgctgaagtaattgaattctcacgtagctttttaactgatgaaatatttcctacaactgaatttccatatgaagctattgtagcctacaagcgcatgggccttaatttccatagcttttttttttaataaaactttccataaccattggcttgatatatcttctgcttgtatgctacaagatactctggaaagttactgatttactccgttgtttcaattttttcgacaagatatgataaacacactattgatgcttgcgatcaatcaggttttcgatgccatcatctgtgatccaccatacggagtccgggctggaggccgcaagtccggtggccggaagctcataaagggcaccgtcgctccgtacacggttccggacgagaagagggacagccacatcccatccaccgcgccgtacagcctcgcggagtgcgtccacgacctcctccacctcgccgcgaggatgctggtcatgggtggccggctggtcttcttcttccccgtcgtccgcgaggacggcgtcgccaacccggccaagtacccggagcacccctgcttcaggctgcttgcctcctgcgagcagatcctgagcatgaggtacagccgggtcctgctgaccatggtgaaggtcgggccctacaccgaggaggtcgagaaggcggcggaggagcggcgccgcgagttcagggagaaccaccataagtggatggaggaggggaacctccactccgccgtgttcagccccgccgatcaggccgccgccgccgccgacgggaagccggccatagacagggactccaagcctaagtacagaggcaagtatgtgtaggtgtaggcaggtgagagacgctgaactttttgtctgaaaatttttctgacgctgtaacgaacaattttgtcgatgtcatgtggtcgtgtatccttcagcttaagagagcccggaggctttggatcagccgatttttagagcataaattagtgcaggtgctgctgtactatgatgtaccatttctgagatgatacgaggctgctaattcatttggtcgatgatgaggatttgccctattgaattatctatctatttgtactagtagtgttttggtttatcagaactgagaatcgtgctaattgaactaaaattatatttttatatgatggtattgtagtagtcgttaaaaattatattttttatatgatggttggaaaaggatatataaactttacgataccactcacatcctaaggttgtttaagatagtggttttgcatatttgaaagcttaaatcagcaattttgaatggctaatatagcatgtttacatatcgtcgatcattgatcattaaattttaaattatactctagtgatgtcatattagtattataatattgtcaactgtttgtaaatgagagcaaaaatatgttgttaaaacgaaagatttaggtggagattttaacttatctaatgcatatgtcacctagcaaaacttattcaacatagataaaaaccactttgtaaaactatattaaggtgttatataaaaggtatgtttgggggttggatgtctgggcttcaaagttcagaggtgctagatgaactttcaatcaaagttttgggggtataccttttattgctatattataaaagaaattaacgatcaaagataacatgaagaccgtgtaaaagtctaatactctccatatcattctactccaggtaacacaaccatcagtttttaaaagcctggagtttagaaacatgtaaattatatgtaaattatatattataaaagtagtgctcatggtaaatctaaaaataaaatataaatcgtacgatgttaaattattgtaaaattataggaatcgatggtcaaagattaaaatgtttaacttggaacaaactagcaatttaaaacggactgagtatgttttatattttataatttagaagggatatcttagaactgatggatgctttaaaatgtagccacttaaaaaacttcagatgcaacatggacgagagcagatcattgactgcaatcaaacatggtgagcatgatacgatttatttactatatacatcttcaccactgattgacatggatcagttaaataaggttcccctactaactgtaaaaatctatgaaaacgaaacaagcgcaaaagtctaacgtgccagccacatctgcttattcattcggagatagaatttgtatgatccggtgtaatatttattacttctacttctggtcactgtatcgcatgatgccgtacacatcaacaatacccggaggaaacactggatcagttgctgctcttacagcgaccttcgccacggaggcaacactcactggaggggtcaacagtgggccaaccagcggcaatctcgtcaacggcttcgcactttggagaacctgcagtgcacagggagatcttcaaattaagtcttaaaaacaactttacatttggaataagagcaaaaataactgtgttgcaaggcttgcaaaaacagaatgaagagacttttaccatttgcataggagaaccaacaagtccaagaggtatttttacgctaccgacacggcgagttccatgaataaaaccaggcctcaaaatcactcctgaaaaatatgtaaaaaattgatataaaacttgggctagaaatacttattgagaggataattgtgtccaaagtcatctcaagtgccattgaattaaaatccaaattgaaatgataaataaacttctcacaaagtcacaattcttctggttatgccttctctttagtttttctactcttattacatgataataataatggaatagttggaatcagcagaattctcaaactacagaaccagccgctttcacacagggggaacaagattggagcaagggccctaagaatttagaagacaactcgagaaaaaggttttagaacccagtacatcatatatgtacaccagttatccaaagtatnnnnnnnnnnnnnnnnnnnnnnnnnnnnnnnnnnnnnnnnnnnnnnnnnnnnnngcaggnggttatcaaaaagtcaaantcatcggcg

SEQ ID NO: 4013 - DNA, 7846 bp, Oryza sativa
  unsure (1)..(7846): unsure at all n locations
attatgattaggtttatatatttcgctgtttattcttcttgtcattttagttgttanntgtatctntcttctttntnnncncnnncnnnccnccccgaggtagacaatctcttnnnnnnnnnnnnnnnnnnnnnnnnnnnnnnnnnnnnnnnnnnnnnnnnnnnnnnnnnaggaaattgagctttaatttgctttcatgaattactaacccactagtttacatctcgggcgctgagcctcttaacgggaacaactatggctcatgccgagagaagatagagatagcacttgcgctgtagctctcaccgagcctcgccccactgagcttgttactccagtgagggcagaaggtgagagtgaaggtgactttaaacagaggatgctagaccatgctccaataagattgaagtatgatgttgatcgtgcgaagtgggagtcatcaaaccgcaagtgcttgatggtgattaagagctccattgtggaggcaataaggggagcaatcccagcttgtaccacccactgagtaccttcagagagtggagaatcaatttactggttcttcaaaggcctatgccagcaccctcattaagagcttagtaaccatgaagtacactggcagaggggttagagagcacattttgaagatgagtgatatcacttcaaagctcaagaagatggacttggtgctccctgataagtttctagttcaccttatttttgcctccttgccttcagattttgaggcttttgttgtcaactacaactcacagccagaaaactgggacattgagaagctcattgccatatgtgtgcaagaagaggatagacccaaggctcgtggtgattccgccaactatgtgaagcacaacaagaagaggaacaacttccaccagaatgttgcctcttctaaggcacaaggaaaggcaccacaaagtgatccacattcacgaccaagcaatgtaaaagtggacaaggacacttgcaagtggtacaaaaaaaaggggcactattagaaagattgccctgatttcttaaagcatctcataaagaaaggtgaggacattattacatttgaagatgaatcactgtacataagttatttaaaatccacttggtgggttgattcaggtgcgatcattcatgttgcaaattcattacagcgattccatatgaggaggatgctaacaagaggagaaagatgcattagagtggcaaatggagtcgaggctgaagttgaagcaattggagaacatccattagaattgaataatagcttcacacttcatttgcacaatgttctctatgtaccctttttgagtagaaatttggtttatgtttcatgtttagcggatgatggatataattgctttttcgatcaacaattatgttcaattatattcaagaataagtgtgtgggtcttgccatataacaaggccagctttatatgttgcctaaacatgagaatgagaatgttgtatgcaatggagagaatgttgcgtgcaatagtatgtcttccccgtctacgaatgtaagaaataagcgcaaacgatgcaatgacgaaacatctgcgaaattgtggcactgtcatttaggccacatttcgaaggggataattgaacgattaattaaagaagaaattttgtatccgttagactttatggattccgaatattgcatcgattgtattaaaggaaagtatgttaaacaaataaagaaaggagccctacaaagtctaggatccatggtttacgggaaagcctatgatccttggcttaaaagggcctagtgtttatttcgaaatagggaggtattgtagctcgtgcgtctgatggctcaccggtgacttgcatgatgaagcgttctctatacaataatctatttagaagtgaatattgagtatgagaagttagaaaggcggcgatcaaaggggagaatgttagttgcaatctcctggggaatcaggaaaccgattccccactccgcactcacacgccctgatctggggcgccagccgtacgatggctgtggtccctctcacgcagtgccaaataaaaaggggggagtggccggcacactaaaagaaacgtttgacggcgcacacgcactccccacaaaaccctagaacccttcgatccgggaaggcgttgaagtggggggattccttacaggcgcaccaccaccaccgtcatcgtccacaccgacgccgtcacaccgtcgccatggccgcatcaagctcaaagaccgacgccggtatgtctctctctctccccttccccgttcactccctaagtcaatcatctttatctccatgaggtagttcaacccctagatccgcaccgaatgatattagaatcctaacaacagttgcccattacggtgtgcacagtcaagttatctagcttacgccttgacattatggacctgtcctttccactggaagggctgtaacagtgcttcctaatgtgcttgagggcaatgcatcaactacctgagtgtttaaagttaattagctgcaacaatcattggccattgtcctcttgttgcgaagaaatttggtggtttggcctctttatcgtggaatcgtgtgctgcaacaagaaccatgaatactggcaaccacttgaaatgatggagtataaaattgattgcagagatggagtatcaatggcaccatcaagaactatccacacaattggcagcctatatgcacctcatgggatagggtgcttgagcagccatcaataagaatcccaataaaacaattaggagttgaggacaaagaaacacaggccccgcacgagcaggggccattgtcagagcctctgaactggtatttcttttgttaagacagccatattgccgcttactccatggtatatgtggtggtatatcaaggccgatactggttactggacacgaatntttgaaacctaaggttaagataaacctctacacctcccatttccaaatctgaatgtattttgctatttgcaattcctttatagctggtgctacagggcaatactgtcatgttggaagagatcatggtgttgcgaagatatggacacgccactcgcaatgatgtggagcatggcagcacacgattgccatgccacggtgtgtgctgtagaaagaaggttcatttagaaaaggatacccccgtaactttattttagaaaaatgatttcaaaaggtatagaaataatttcttccaataaaagaagggcaagaacacattggcatgaaaataaaaaggttacatgtgaaagagaactcaccgccataggtaaattttgatagcagttcagcttcagttgccctcttcaaaggataaatgaaaccaatcaaatttatatcaataacgattacttatagggtcagaaaaacaagcaacactatggaactatgaccttgccctcataacatggaaaaacttaccttgccctcataataaccttgcaacaagtagttcacaaaaccaaagtccgctgctgacacatacacaaatctcttaatacctgcaggtagagcatgatgtggaagcagttaagtcccaaccaaaaataatgtgcatcagcatagacttaattttactttgccatatcatatgaaataattgatcaaaaatgaaagattgggagtgattcctgcttccggcctaagcaagcaccgggcagtatatgcaactctagtgactagatgtcatgcatcgtcactgtccaagcagtccaagctacagtacatggctgaatggtacctctccactttttgtgtacgacagacaagcccaatatgcaaggaagtaaagtgcatgtttctagataattattcttccagagataactttgtgaagtactagtaagaaattgtatttatttatttttttggaaattatgacacaagagttagtattctgacatttacccttttgctttaattgatctgatcataagaactacacactatactgactaaaggagattacaaactagtggggagaatcatatcaatacatgtgaaaaagagcatattgatgaattgacagaaactgcaaacataacatagaaaatgaatatggtgctgcaacaatatgttctcaaacataaatacctttctcagctgcaacactgatggcattgatgtttgcagttccattaattttgtacatgtaagaattttagccaaagcctccaacacatgatacctatagcaatttctctcatatgagtaatgtttcaagattcataaattcatgttagcataaagcagttactacttatatgttataccttattagagtatcggtgcataataaatttaaaaggtatcaacggtgttccagggatgatgataaaaggtttaacacgaagtggaaatatttccatcatactaattaatccagtgctcatagaacctagatagtatgacccaataatccaaaattatctgcaggcaagggaagtggcagggatggatttgaaaacctaagtgataacaatttaaaaagatggcctgtaaaaaaccatttccacctagatcaaccaagagttatgagcaatttgagccaagggagtgcaacggatggagcttggaaactaaatgatattaattgagaaggatggattttagaaactaaaagatattaacctacaagactgtacagatccaccagatactcattggtgccgacatgtatggagtaaaggcatcagatacctcttggtagtttcaagtctagtagtctaatgaatggtacctttaattagatttccatgacaataacagcagaaaacagtcataataatgcgcatacaaaataacaaaaaccctaaccccaacccaatcactaataaggatttgaacaaagaaggtagcaataagttagtatttgatgcttgaggtgcccaatatatcatttcagaatcatatattaacttagtacaatatcctgcagttgtttcggcatcatgtaaagaccagacaagtgagtctgtttcaactttcaagagacttgccaaagatccaggaaagtacaagggtaaaaaaaaaaaaaaaagaggaaagcataaatgcaagaatgcagttttcagtacaaaaatgtgcaccaagttaacaaattcgaaaataaaagtgtaaacataccacagcagaaacaccttccataatatccttcagggaatcaggttcaagtagattgcctgcccaataaaagagacattaagcaacataatcatttataagcacaataaatttatctcactagcaaataacctttgttccatataactttgtcagcccaagattcacttattgatggctttccagatctgttaaagtcaaaaatcaagagaatggtaagtcattgattgaaaataaagattgatgattttgaagtatataaagtctgatatttgtttgtctgataatacatcagatgtgtcaataaggaaattatgaattcaataaagcttcaattatctaaaaataataaaaatttaggaaattcaatgcaagactacagctactgaacagcaataagtacattcataaattacatgagtattgctctcagaatacaccattgacacccccttgaaaacactcacagaagaataagatgaaaaagaaaagatcaaactaactctgattatatttttacattgttaacaaacttctagaatcgaaatctaatatgagtagaaacagcttcacacagttctgttcagtgaccacaatagaggaacaaaaggagaatgagagtctcccatgaattttttctaaagctaaaggcatcaacacaaacttaagagaaccatataaagttatctacagttagattagaggattcagagtatccattgctcttccatatcagatatcagggcaaaaacgtgtttaagtttcaatagacatacagcctctgtagcaatagtttatttatgattttggctagttacaaaaaaaaataaaaaaatatatctcaaaatcaaacagtctgacaacaaaatgagaatgaacatgtcaacagatacagcttacagaaatacctattaagactagcaacagtaaatcctttgtccaaagcctccttgcaaacatgtgaaccaacaaaaccatttccacctagcacaagaagctatgtcgacatatatgtcagtagcaattcagtaatcttcaccaaatggaaagcataaagaataactccatagaaaaatgtacataatttatctaaaagctcgaataacacgtagttagctgttaatattaaacaatacatttccaaaaatatattaattgctgttaaacctgcaggaacaccattcaaaacagaatacttgttataatatttttatcggtctgtaatatattgctcaggataatgaagataagaaaacattggaaataggctaagcacttgtctacatgaatattttagttatatatgacctttctgttggaaatgaagaattgctttcccttgaagataagcacactatagagatttaaatatcataaagcaggatgtatccgtgacatattcagggaaatattttgggaaatgcttaatgcaaaaacacaatatgctgcacaaagggaaaaaagaggtttccatatcaaatcaatctgaagatctggtaaaataacattgtcggtgtagtgaacttacagggcttatgtagataacatttcaagtctaactgtttcaacattgagagcaatgacaatgaaatagttccgataaaacagcacaaaagaaaggcgagatgaaagaaaagggaatatgttagcattcgaatcaaactagcacgtttatgtttcctctaatgcattttcagttcgaaggactacatcgagattatcgaattcattttgcaacttttcagttacgtaactgatggctgcactggatatctccccaacagccaacatgtccattctatgacaataatctacatcagatacaaccgcataaaccaaaattcatcccgctgatagtttaaaatgaatacactaggtcactagcccactatgatagattgctcattcagaaaaaaaaaaaagaaagggaacaatgcaccttataatatatgggtaagaaaaggataaaacgactgctaccaagaatgactgccaaacaagctaaacacaagaaaaagtcttaaactagtgcattttacgcaaactagtaataatcacattaattataattaccttgtccggggaaggcggtggcaccttcacggtttctgcttcctccaccttgaaaggctcctccacacgcttggaagcatcctcgctcaagaaagccttcccattattgttctttaacaagtttgcggcgctgttggcatcatcggtcacacaaggtagaacagaacaccactaatttagcatcataataaaatccacaataatcataacaaaatccccctattgtggtggataagccaacgaggaggtaaatgcggctcctaattccccatcctaacgaagcacgcgcacctttgcacgccatctcatctcatctcatctgaatttaagggtttattgtttatctcttcccaaaaacttgggggatgtttcgacggcgggcgcgcgcggggaggggctcacctgagacgggagggcgagactacgggggacgaggaacggatcaggcgggtcatggccgacctcatcgccgccgacgatgccgccgccgccgccgtactactcctttcctcgcgatctatcgagagcggaagcaaagaatacgcacgcgacgcgaatggtctttttttcctcttgcgagtttgtttgtaggcgagaaaaaggtgaaaagcggtggcagatggcaccgctacgg

SEQ ID NO: 4014 - DNA, 8186 bp, Oryza sativa
  unsure (1)..(8186): unsure at all n locations
gacagttgaggaatcgccaaagctacagcgacaataacaatgtggattgnatgagtcgtaggagcggttaagcggagagacatgatgagaacatattgtgtgtttctcaatgcatcttcctctattaggtttattgaacagtttttagaaagaaaaaatctcaattctcctctcacctctatttatctatgaaaatcatatgtggcacctattctcattcttatgccattatttatgctcttacttatctcaattgaaacatgactatatgggaaggcatatatggttcacatgcatacaaacaaaacgaataccttatcccctctcccacatgttcccctcgctcccatggcatcacagcaccactacccttatagtgcctttgcttaatgccacaagtaaaaaccacgcccttatctattttcctcctccaacgagctctccactcctactctgttcctattttcccaggagtagatggtacgtacaatggtgaggcaaggtgggcttggttgaggtcacgagtgaggcgatgattaggctggtggcgacaactccaatgtgcatgaggggccttcttcatcctccctgacaaggcaacgcgtggccaaaatctcatttttcttcctcccctaattatgtgtcgggccactagtgagtggtggttagaagtttatgatttgaaatagaaaggttcacatatccggttggaaaaaaaaatctatttttgagcaaacaattccaaagattgttgaaagttaatgattttgaatagaaagttttggcgttttttagttcatttgaaatttcatgtgcacaactttctatattgacaagttctttttatgtataaagcttatagactgaaagttcatatgtacaaaaaaagtttataaatcaaaagttcctcaatgtattacatttatacattggaagtttatgtaaagtttatagattgaaaacctctggattgaactcgaacatccatctattccatgcataaataaataccaggaaaggtgtttaggtgcgtcaaaaagagaggacaaccaattggcactccgagcacatgtgactgaacgttcactcattagggtttttgatagctccaagcttccactaacaagcgaaataggttttttgccacttatttgcaaggcggaagtaaatggcttcgctctataattaagtggggtattatccttatatatttttgtattttttaaacgtggtctatttatataaaaaagatgaaaaggatacctacaatagaagacaaaaaaatactttagtagtaaacatttctagaactaaatacataggagaaaatggttgtatgttaataccagaaccattatgtgggaacaaaattttcttactgctttgaaaccgagaacttcgtataaaccacaatattaaccacaatattaagtaccacaattgatggggtcgccgaacaactttggcgtcagaatcttcacgcacactaagggggtgtttagattcataggtgtaaaattttggcgtgttacatcgtatatactgacacatatttgaaatattaaacgtaaactaatcacaaaacaaattacatattccgcctgtaaactattagatgaagttattaaacataattaatccgtcattagcaaatatttaatatagcatcacattgtcaaatcatagagcaattagacttaaaaaattcgtcttgcaaattagtcacaatctatacaattaattattttttaaaacttatatttaatattccatacatgtgtccaaacattcgacgtgagggtgaaaaattttatcaggtgatcagccctaatagaaaggccagcaatgaatggattttgtgctacactcggtacgacttcgaatatttctatgtaaattatcctttccaattcctattatttggcatgaacgtctccaagattactctttctaccattttatttcgtgtctaaccggagtgttttgtcgaatagtttgcaagaattgaggaatgtgcctctgtttgaaagcgtcggaaatgggtgtgtgcgcaggaaatcagttcagacatttgtcatccaggcttatcaagccttccctggctgcttcgatcaattcattcagccaattcgtcagaattgtcacccagcctcttactaaaattcctgcaaaatactgaactcatactacaaattcaggtcctaacattcaggtattatgctaaattcatactaaaattcagttaaaccatgtgtttagttcctaaaagaagttgaaagtttgaaaaaaattgggagtttggaaaaaaaaagttgaaaattcatgtgtaggaaagtttttttatgtgatatgatgtgatgaaaagttaagaatagtgggatactaaacatggcctaagttctaaatactagtaaaattaaatccaggagaggtcctagtccacatgttaaatccaggagaggtcctagttcacacgcaggttcttcacgttgataggaatcatttggcaaagtagccaggtatgaggtatcccccgaatctgctttaggcgatgactgcttttggcaatgacaactgttctgtaattgtttggcaatgacaactattctgtaattattcattaaagttcgcaattatttcacaggttgtatttagcagttttataccatgcaccagaaaaggataaattcagacattacacgcagctaccggactgaaacgaaaccaaaaagaaactgttttagaatggaggatttgtgggacaaagaaccatcagcggcaattagatttgacctcaaggaaatattcagtccgcatcatggttggatcgccaaatggcaaacccacatcatttggttcttcccattatttttatccacaatgcacaaaacagaaaatgcaggagaacaggaaaacaatcgtccctgctcatccaagaacaagagaacaagaaacagaaaaggcagcaattttgtttcttcaggtgaatgagatgaacaggctcagattgataatgggtagtaagtctgcttgtcagcaagaacaggagagagatctctcccgagttcagagtggtgcatgactagttcctcatcatcgccatctcgaatctcgatccaagaaaaacaacatccacaaattgaaaggaaaagaaaaacagccaagcaggatgaatcgaaaaccccccaagaacccaaaaccagacgagacgcgagatcgaatcaaaccgcaggaagcgtaagaacgagagggatcctcggatccacgaagcggaggagggagagggggagagattcgtcgcggcggcggaggcatcgcaggaggggttcgactatttatgggcaaatcctcctctagctagggtttccttctcctaattcggaccgacgagaggctgacaggcctggcccaacaacccgagcctttctcagctagctttgcccggcccggttgcaggagatgggccgagctatacaaatggcccatgtgccaagcccatctagcccatgattcccttttattattatttttttttgaaaaaagagggagcccacgccaaccatgtgggactgacacgtgagcctagctactcgttaagagaatttaggcggtcttcggcaccatttttcccaacctccaggcgtgtacgtttttcaaacggcaaaatagtgtgttttttgcaaaaaaaaaaaaaacttctatacgaaagttactttaaaaaaattaaattaatccatttcaaaaaaatagctaatacttaattaattacgcattaatagactgttccgttttccatgattaccggttgggaaccagcatgcccgaacacagccttaagccggtttggacgcatatgcccttctcctcccttcttccttcagcattgcgtgagtttctttgtttttttgaaagctatttatataataggctttttgtttgatcttttcttttcctcctaggtcaaggtgttctagttcttatccaattaattatttattgtgtttaatttcaaagtaatatattaggccaacacacattagatgatgacgctaacgtatacgtcgtacttgtagtgttggttataaatatttttttctcctaccttcttactaagaacaactttgggtttgttcgggggtccagtctgcggcaacgctgtgactgggttgtagcagtaaaagacaaaaaaaaaagttcatgctggttttctgctgcagcccgcccagccgcaaggtagccgaacggagccttttgcatccaaagctatgggttttttttgtgccatttaaaggccatcatcggtcatattactatatacctccaatcacttgccataagatgccaattgatgaagtgaaagagagaagtgaggagagagagaagaatgcacccattatgaagggacaagatctatataaactctaatataattatgagagtattagagttatttggatttatatgttagagataactatttatgtgttggtgtctcttagtctataagtagatgagataaataaaattagatgtagtagtcatggtaacatggtgttcatctatatatgatcttcgatatggtataaaagtttgagtactcatacactatggattttcattgttgttaatataaattatatatttatgtataaatacctataaaaataaaaggtttatatataggtaccacacaaaatggaggttttcatataggttttgataatgcctccattttgcatgagaaataaatgttagataaaatagattatcccttatttatcaaattccaatgcaattatttcttattttatctactctcaatgcatttattttctactctcacaaacttcaatttaataactacttaaaaataaacttattttgggagaaactggataagctaaaaatgaactcgtttcaggaaggagggagtatatttttagcatcacatttttttaatttctttttacgttgtaaattgtaagtagttatattgtaattacaccatacttactacaaattttaataggtgtaattctttaattactttgttatatgagatatggaactaaaaaataattataattgtgtagtagtatcagtatcctaagattgggtttttttttaatacggagggagtagttatactatctatgcagattaacaaataaagtaaaaaaacaaaagcaaaaacaggagagagaggccaaggcgcccggcccgtgcacacgatgttcaatcaagggcatttgaaccgttaagatctgactagtcccaaaatgtagcgacacctttttagcaaatccatttgatcaaatagactaatttaaagctgatgacatcaattattgttttcacacagagctaacgctgacgatgagaacgcgtccattgaatcttttcagtttctcgacgtcctttctcttaggaaaaatccggcaagcagttacgggttgacccctacagttattagtacaaaatgagactaaagatcattttctacatggagcttattctaaatttccaatctaggcgacaatagaccaacatcagttacccttaggcaggaagatagagctagtactccctccgtttctaaatatttgacgccgttaacttttttaaatatgtttgatcattcgttttatttaaaaaaattaagttattattaattcttttcctatcatttgattcattgttaaacatatttatatgtatacatatagttttacatatttcacagaagtttttgaataaaacgaacggtcaaatatttagaaacggatggagtagctttttatccttctgaaaagcttacaaagacattgcagccaacaatccaacataagctgaagtttcaccaaacagggttctacttttcctttggaacggaggaattttgttggagaaattttgaagaaaacgaattacttgaaaaatccaataaaattccatgtgtgaaatgtattcattggcatagtgataggtgcatgtgtgcgattttaaccccaagatccccgtgttcagctcttaacacgctcacactgtattcttaattattcgacaccaaaattctccttggttaccaaacgttctcagttgctgtgatataaaatccacatgtgtttgcccttaattgattctccagtagcgtgtttggaactgggaaataacaacatgtgttcccttggttagatggatatcactgtcttggccagattctgacgtcttgttcttggttagttaggaccatccactgatccgtggtgacaaattgacaaactgaccacttctcacgtcaagaaacccccttccttttacttctacgtgtcgctgcaggcaagagatttcagagtaagcagcagcacgcgcgtcagagaaggagaagaggacaggtcaaaggaaagggagcagttgggaacagatgcatgcagaaaaacctgagctatctcttgatttcctgcaccctcaggtaagcaaaagcaaagcgaagcaaaggagttttgaactctttttttttttttgcctacctccatctggaagcaaagtaagacctgttccgttaatcaacatcatgcatgcccacaaaatataatcttttcatgttcatactcaccatacacatacacaacattgtctttctttggccttaaaaaaaattaacatatgccaattgatggtggctatactgttatagtagtgttttttttttttttggataatggaattcaatccggtctctgcatcgaagatgtacacggccacataatagagcaataactctggatagttggtgtttcagagatttccatggaatagtattcttcatgcttcacctaaaacattggatggctcactttggttgcaggtaaccttcaaactattaggcctactggttgaatcgtagtcaaatcaagattcctcctctcttttcttttcttttcttttttctgtcctggtttttgtgtgctgtgctgtgttgtgtctgccttttcaccacattcacttactcgcttatgtagtaaccttctttgtaagcttcattttagcagtttacctaaagcaatttcagattcagtcatcccttgggtgcaaaggcactgcacattttttttgcttcaggtccaaccaaactcttcccagttgatcagttgggtttggtgaacgtcagagcttctcctgcttgtgtatatggtagccaatctacattggaagtacaggaaaagaacctctgtttcttttagttttcttttctgttcatgtctactcttccattcacctgtaccaagaaaatgtcccttgttgatcatacattactgaattatcatccagaatgattgagtagaagtagtatgtagtacagttctgcttgttcttcagttgtgtacatctctgtcagagttgcacaccaactctgtctttgcatataacataagtaaggtcacacctgaagcaaaaggaatgttaagagagtgagtgagatgaaatgaaaacacgcatgcgaccaaaggaagacaaatggaaacaactgaacaacccttattcagacaggactgtgtcttaggtttgtagtaggatttttgggactgattgctccctacatatgcactcacctttttgcaggccaaggattaatatcctgtgaattaaattaatgtgattggttgcgtgcatcttagttatgtagaggttgagaaacgctcaggggtcttccggctagctccacaaggtggtgggctagccggcctaggttcgaagccttacccccttctatttatttgatactagatccttccctaatacctgtgttttcttttttagttatgtagaggttaagagtgttcttagtacggttgtatcaccttgatgtaaattggctaagttcaataaagcttccttatcttaaaaaacaataaattaatgtgatctgttccaaaaactagtgacaaggaccaggtcttcaacagttcctgcaggaacttgtcaaacaaggggttgttcttctggtcacagcttttctgccaaatctataagttgctctctctctttgcctaagtttggagctcttatcatcttttggtgtcaagccatgcattccatttgctcctgagaaccctccttgataaacatctcattttttttttgtcataaaccctctctgcaagtggggtgtcttccttgcttct

SEQ ID NO: 4015 - DNA, 2944 bp, Oryza sativa
  unsure (1)..(2944): unsure at all n locations
ctctccatatacgcacgcacagttgagaatcactactttctctcacctcccagtncnnctccctctgtatcctttccttntnntnnttttttnnnnnncnnnnncccccccccgtgttgatgacatgtcgcttccaccnnaccnnnnnnnagancgaagaagcccggacccccgggcccaacaagcaaagaaaagcaccgactcgacacaacccngngagtcttttcttccctccagtagctataggggacttgcttcctctgcatattcccgctaaaaatttagcaaacacagctaaaatctagataaacctggctaaaatttacatttttagaatctcaggttcccagtgaaaacttaatgttatcttcacccgagcatcatgcataacggcgccaatgattccttgagcaccgaacattttgaattccatccatgcatctatccagtatttaatcttgtccatgtaaacttgttttacatcgttgcatattcatcatcgacaatgatacgcttggtgataaatactatgcatgatcttaagtttacctgctatcaagttttaatcctgtttaaatacggttcttagcgtgttttcgtggtcatgttcctgagcccatggaaaaggttacatgaccacgtatgttagcaatgcaaaatggtcgttttgaagtcaatatttgcgagtatttttataacatagagtagttattaactaccaacaaaattgcagttttttccaatcacagtacaaaagtacgtcatcctggtgactttagcagagaaaaattactccctgaagtagttttttttttccaccaatagaaaccagaagtgatgtgcccaacaaaccaatttgaattaatcctcctaatttcgtgtgctctgaaccaagagagcccaattctccaaagtttggcgagctctgctaatcaaaattcctacctttaggtgagctaacagtccaataaaagattaatttatagtaaatcacgtcgtaggaagttacatatatagctagcaacctgcagtttcaccaactccgtttgcaacttctgaagaagaaaaagtcacaatggcgtcacgagttctgaagaagtctctcttcaatctgcatgccaaattgccaatttggatggaagaaaagaaaactgtgttctgaaattaacagaatggtgaaaacaaataggttcatgtaagaatagagtcaaaggtagaaaaaaagaaaaataataaggaacaaagctattagggattaaagcgataatgaagagggaattggcacgatgatggagacgatgactagttgtagatgtaagcctggaccgttgaagcatggaactgactgttcttgatgacttcttacaagaggagatgaagaaagagagccattcctttaaaaaaaacaagaagaaagaaagaaagctatgacacatatgactttctggtcttggtctgaaagtaatagaggagatgttatgaaattggtcgtttgaagaaaagtagaaaatgaccaaatgcagaaatagtgattgctgatcacatattggtaaaagccaaagaaaacttaacacctaagttttttttaaaaaaaaccaacaccttagtaaagactgacaagtaattttagttacaggtaatgatttggtcacaaggggcaatcttgttcagttcaaccatatgatttgtgacctttgttagaacttttgaagccctcaactgcacatgctatcgttttctacatatggtctaaatagttatgcaatattctgaagaaaatcgcaaccggattatgaactaattgtgattatttacccgtgttaatttcagcaacagcctgagcaagaggggatacataggaagctaccactacgagaaggatgccaagtacaggccattcagtgcactgctccctgagggttcaaaccccaagatgctctatgtcaagctcgtcctcatcatcctcatgtgtggctccttcgtcagcctcctcaactcgccatctatccatcacaacgatgatcaccacacagagtaagaaaaaaaaaccatacaaaattcatgtttttattcgcaagatttttttaaaaagcaataagttgtaacaaatatttcttttgaaaagataaaggttacgatcattaccacaaagctaccaaattatgtaacataaaatgtagtaccgtttggtgtcttgtaccaggagataccatatttcacaataaaatgtagcacatctttgtatctcctcaaatattataaaattactctttgaaaaaatgattttaatgtcgttgaggaggtagtgaaatgtaccaattttttaagccaagggtcataaaatccgtcttgcagccccattgtttggctgataagaggaaataacgaaacaacacatttgcaaacgaaaaataatttgtgaataaaatttttatatgcgtgttcttaataatctaaaaacaaaggttgaaaaataaactacgatgggaaaaaaatcccaaaatcaactctaaatttaagcataaacgaaaagatgaggccgttgatacgatggtcagtgattaatcctttgcttcgtctgaacttgaaacgcgcaggtcatcagctggagtgccgagagtgagctacgagccggatgataccaggtacgtgtcggacgtgacggtggactggccaaagatctccaaggcgatgcagctggtcgccggagcggaacacggcggcggcgcgagggtggcgctgctcaacttcgacgacggcgaggtgcagcaatggaggacggcgctgccacagacggccgccgcggtggcgcgccttgagcgcgccgggagcaacgtgacgtgggagcacctgtacccggagtggatcgacgaggaggagttgtaccacgcgccgacgtgccccgacctgccggagcccgcggtggacgccgactgcgacggcg

SEQ ID NO: 4016 - DNA, 3415 bp, Oryza sativa
  unsure (1)..(3415): unsure at all n locations
ggaagcgtatacacatgttagcggtattacacatatagacgctgtcgagcttaaacacgctatacacatattagagtgatacacgaacagacgatatagacgtaagagctgtcagacgtaagcgagttaagcagttatcagtatagaatatgaagcgaagattacatgttagcatatggagcgttaggcttatgcggtatagcagtagcgatattgccatgtagagataacgataacagataatcgactatgggtgaagcaagtcgaggtatagtaaagactatagacggtagagatttgagtatcaactagagatatcaccaaagaatgacgaatcgagttcacgtgtacgaaaaagttaagattacagttgcggtaagcagaacgtgaacattgaagatcacgtacggcttaaagtagagtaacacttacatttgagagaagttagcattacgaaagcgaaaataagatatgggtaaaatagaaagacagaaactgaatatggcaaaagaaaggaacggtactaaacgttacggtagagataccggaagatagtaccataagtatgcgaaggaaggatacaaagccatgcagatattattaggaaactaacaaagagaattaaatgaaaagcaaaactaggatgctaacgaaaaatggaatataatataggatgcaaagaagggaaagagccataatcatgacgaacgaagcagaatttccttcgatggaaataaagaaaatagaagatagataatacatacttagatcggacaagatggagctaacaacatataaattagttctataccgatactaacagtaggaatgagggtaaaccaagacacgctgttcaactccggcgtgatggtggtgaagccgtgcggttgcacgctccgcctgctcatggaccacatcgccaacatcgactcctacaacggcggcgaccaggggtacctcaacgaggtcttctcgtggtggcaccgcctcccgtcgcacgccaacttcatgaagcacttctgggagggggactccggcgagcggctcgccgccgccaggcgcgccgtgctcgccgcggagcccgccgtggccctcgccgtccacttcgtcgggatgaagccgtggttctgcttccgcgactacgactgcaactggaactcgccgcagctcaggcagttcgccagcgacgaggcgcacgcgcggtggtggcgcgcgcacgacgccatgccggcggcgctccaggggttctgcctgctcgacgagcgccagaaggcgctgctccggtgggacgccgccgaggcgagggcggccaacttctccgacggccactggagggtccccatcgccgaccctcgccggaacatctgcgccaccgccgccggcgacggcgaggcggcggcggcgtgcgtcgagagggagatcgagaacaggcgggtggaagggaatagggtgaccacgtcgtacgccaagctcatcgacaacttctgacgtgggtgcatccggagccgttggattttgagatcggacggtgagatcgaggccgttagggatgggtgacgtgttcaccaatttttggtctctcgtgcattgcattgctatgcaatgcaagcgtgccaccggggatgttgcgtggtagcgtatggccgaaatttctttattacaatgatgagaaaagtagctgtgaataatttaggtatttgctttcgtaaaatacttagaatttttttgaagagtctatgttttccaaccgtaacattgcaaatatgtcatgtttgctatgttaatcctttaaatatgatgatactagtgcataacaacaaaattcattttaaaaatggattgtcataaatcattgacacatggagccttaggttagtttcttcgtttctcatgctcactcggtcacttccttagttccttacatgtccaagcaaaaattcacgcttagcttgcccttttgtatataccactcacatccttacatgggctcttttttattgatcaaatatacattgtaatgtgtgtttttttagaaaaaaaagaacaccttacttacatgggccttcttttggttctagataaaagaaacaccttcctttccagaggagttatgtgcacatgatttcgtcgaaatgcaaatcttacactattacaaaataattttcgtggctcttggtattatttttcactgacagaccaaaaggaataatatctatgaaaacgtttgaggccgtcttggggtaacaaaccacgaaaacctattttccgggtgggtccttaaggaaaatcgcatgtgaaaatatatctaatttcgtatgcggttttcctaaagagccatatgtgcaaatcatgaatttatgaggtggtttgttaagaaaatgaccacatgtaaaaatggggtaatttttaccggcgattctcttagaaaaaatacatgtaaaaaatacaatttcatgggcgattctcttaatgaaccacccttagaaatatgagcactactatttcaaaaaaaataaaacgcacccttccatataaaatcagatgacaacgaactctatatgaaacttagagcatcctcattgtctaaacccctccaacggtactaaccaagtctacatagaaataaaggctgagagatactctccccgtccaaaaaaatataagggattttggatgaatgagataattttaacccttatattttagacagatggagtttacgtgcagtgtgtaaagagtacttcaacactatagtgggaccacaaccatgtagaatttatgtttctctctcccgtattggctcttggccaactgttgctgccatttttgtaaaatgtgatatttattttatttggagtgttcgctcccatgggaagagtcgatttgctatatgcttggaagagacatgttgcctgcaatgtgtagtgccgcgaaaatattcctttaggccatgttcggttatacaaggatttaatccggaccgggaatgataagtatagtaagaaatttatgatagatacaacgagagaccgggattcattctgggccgggaaccaatttactcatgatagggacaataagagactggaaatcaatccactagtcaagaggtgtggaactaatctggatgttttgttgtacctaatatgagtaaactggttcccgacccgaaataaatcccggtctcttattgtatctattataaatttcttgttatacctatcattcccggcctggaacgaatccttgtgtaaccgaacaaggccttagtgtctcccttataaccctcgacgggatctacaactaatctggacctatgcttttacatgccataagaagcccaagagaagaaataccactcctacatactccctctgtcacgtaaaaattcaattaatactgaatgtgacatatn

SEQ ID NO: 4017 - DNA, 3713 bp, Oryza sativa
  unsure (1)..(3713): unsure at all n locations
ccgcctttgaatgacaacntcatgctnnnnnnnnnnnnnnnnnnnnnnnnnnnnnnnnnnnnnnnnnnnnnnnnnnnnntgttgacttcatattgtcattgcacacaaattttgacaatttgaccttttgaaaaaactaattttacaaataaaccgacgccaaaacttatttcaaaattgacccttttgttcagcgccaaatcatctggcgctaaacttagacacttcagcgtcacgtcaactgacgctgaatgccgtgccaccgtggatggatggaaggctaagtcagcgtaccaacgcacattcagcgccacgctatttggcgctgaggtatctaagttcagcgctacacgatttggcgctgaacaaaatggtcatttttgaaatactccctccatctacttttgatagtcatatttcatttttcatacaaaccaaggataattaattctacttatcatccatttaaacatgttactagtcattcctcataaacaagcgatttattaatatttacatttctcgatgcccatgcagccaatcttgtgtggaagaatatagagttacacattaaatccgagaaagtcattaagaggataagttgttggattgaaatatgcctatcaaaaataattttttcagatttgaaaatatgactatcaaaaatatatggagggagtaagttttagcaacggtttatttttaaaaatagttttttttaaagagttaaattgttaaaatttgtggtcattgcagggaagagatttttcatttgtgagaattccaaacatgtgtgtaattaattccagccggtttactcgttcagtcttccactctccattctaccaccatacgttagcatcaaacttactggtagtactgatatatagcatatactactatccttctattgtatacttcgtttgttaaaaagaaaatctcattacgaatatagatatagactatatttatatcaaagttggatttttctttaataaaacggaggatgtatcagtgtatgtcgttgtctgcaacaagctcgattcagagttaaggaagagaaaaacataccttcatcctgaaatataatgatgttaaaaagaaacgtgcaattaagaccagtaaattgactagagcaaccaacacagttgtcatcagtacagataattgacgtgacatcagcgatgacgccgccaaactgcgcttctctcaaatgccacgaaattttcaggcagacaaaactcaaaagtacgtagcgtgtagagtactttcgtcttttctgttcctgttactagtaccaggcgctgtttatttcagcgcaaagtttagattttggttgaaattagagatgatatgactgaaaagttgtgtgtgtatgataggttgatgtgatggaaaaggactgaagtttggatccaaattttagatataaacacagccttagttaattaagaaccgaattaattgcttgaggcctaagctaatcatccctaatctttgactcaaccccttgcacggacagacacagtcagaccgttgcgtttgttaaaaacgaaaaggtagctagccatcgactatgacagcaaacgctaggcttaatagccagctatttagctcttcgactgtcgccctctcatgcgactatatactggagcatcgtcagcgtttacatctacgattctcgctcgacaactcgccattgtgcatggcatatccaactaaacatactctctccatttcaaaataaattaacctaattaatatataatatgacacattataaaactgaacaaactgtttcttggacggagggagtaaatgcatatagcaagagtacatataaaaggtacgatatatctaatgaaaattattaaataagtgaaaacccatacgttctctaaatttctccattcactctgcaccaatcgaaacacacacttcctccattcaacatatattagttgtcaggtgtttcaatcttctccaaaaacaaaagttctctaagtttaaccaattttttttaaaaagtaattaacatctataatatctaatcaactctaaaattaagctttaattcaaattttcgctgtgactgataaactaaaaaccaaatgtgatgaagccataaaatttataatatataacttatctatataagctattatctataatctattacagtactattatattaatcatccaagaacatgctcaaagtccattgtcaacctctatatacctcctctctacgcaccattctttctgaattcgctgcgaaggatccttcttgtagtactctccgttgaatcttcggctgtcgtcgtttcagatgactccggctaatcatcagacatcctgtacggtagactcttctttgctcaatcttttgtggagtataggctgtgttaagttcacactgaagtttgaaagtttggttgaaattggtatgatgtgatagcaaagttatgtgtgtatgaaaaatttgatgtgatggaaattgaaaagttggaagtttgaaaaaaaactttggtactaaacagggccatactataggagtacgtacttatggactagatctgtatgcggtgttctagcacaccacataggacgacgacgtagaaatttgtgtcaatgaggatgcgatggaataataattaggaccattttgcaaattgacttttactcgtacaatttatttgtcactttacaaggttaatggttaataaaatatatttttacaagtaagaaaatatttaagcacgtagtgtagagtttgcctagacccctaaaaatgtagagaaggtggtgcagtaataaaaacaatcaaagcatcggcagattaaaacaacggaaatatttagtgtttaaatagaagaaaaatgattttaaaccattcatatgaactaatcaaagttttcgaaaatccagctaaagctagtacaaattagtgacttaaaaaccgtgcgtgtatagagttacaaccttggtgtccattttaactttcaagtgatgcttaatacctctaatttaaaatatagcaatttctaactatggtcccgttcttttctccaacaaggttggatgaaaattaagattttcgtggcacgtttttcaaactgctaaatggtacgttgcgtgcggaaactttctatatgaaagttgctctaaaatatcatattaatctattttttaagtttgtaataattaaaactcaatcaattaaacgttaataccacctcgttttgcgtaaaaaaatcaatcttcatcttcaagagaaaagaacaccacctatatactagtattatttatgctttggtccaaatacttgcatattccctccatcccaaaaagctcaacctaccccttctaggacaacgaatctaaactaccttttgttcagattcattgtcctgagaggtctcccatccctttttaggttgattttttttgacagagggaatacaagtaagcttgcgttgaaaggcatagggcctgttcactttaataaaaaaaaaaaaaaccttaccaatgccaaaaatttgatatagttatcaaaatttggcagcaaactaaatatagccactttttttacaactttaaaaaaaacttggtaatgttaaaaatgacatcaaaagtgaacaggcccataggggtactgaattcctctagtctantnnagggttttcaagggcctaccatntcaattcacatcg

SEQ ID NO: 4018 - DNA, 1803 bp, Oryza sativa
  unsure (1)..(1803): unsure at all n locations
agattgaatatatatccgtaggccncttanaacatcttnnntagactnaggaattcgtacccccatcttgtaatgacaggaaatagatatgcttaagcagctctttttttttttatcgggcaatatnaaggaagtgaactggtaggttcaatatgattattgactaattgttcaataagcatgtcatgcagccacataattttattctttctcatcttaacatatttgtattgtgcgttgctcattacaagatggatctgtgagggaaaattataacattttttttggtgggaactaatctgatgatgcatagactcactctctggtgcacagagcataaatttatgcatcaattttggttctaatgcttaatcgtgcatgctttgtccttttcctcttttctaaaatcagagggtatacgccctggttccagtttccaccaagaaaggagacaccatcagttttactaattttgggtgattgttcacttattttctgaaagttctcattaagctttggcttgcctaaatttaaacaattttgagcaggctgatgaagctctgtccatctatctggaatatgtttctggaggttcaattcataaattacttagagagtacggtccatttaaggaacctgtgattcgtaattatactcggcagattctttcagggcttgcctacttgcatggtaggaatactgtacacaggtaatgtaaattatcctacactgttagtgattttcatggtaggcactgaatacaatgatcactttgtaaattttatttttgtggacagagacattaaaggagcaaacatacttgtgggccctaatggtgaagtcaaacttgcggactttggcatggctaaacatgtatgcagttatattttcgttcttcccggggttttgcttgtttggttgtgtagaagcatcattaaaacctcactgagaccacagaaagcatttagtagtcatctaactgaatactctctccatactcgtaaaggaagtcgtttaggacaatgtttaagtcaaaccttggaaatataaatcatgaataactctcaagttgttgagtttgaaaatataaaaattatatgtatagatttgtcttgaaaaatactttcataaaagtatacatatatcacttttcaataaatatttttatagaaacaagaagtcaaaattgtattttggagaccgtgtcgctgtcctaaacgacttcctttacaagtacggagggagtattaagttcctcctctgacagaatgctagatgcaactcagtaaaatgtctttaacattgagcataaacactggcttcctctaagtttgagacttgggagtgataaagatctgtactatgtctataaacttccctttatgttgtgggctggtgatgtcatttctacatgatttaaaaaagatgtctctgatggctatggaagggcttcttcaattcaacaacaaaatgaattccttttgagctttggttgtctcttttatctcatttcaatgcttatgttgaaacaggtgacatctttcgccgaaatacgctctttcagaggaagcccatactggatggctcctgaggtatacggtttcctgtttacaacacttggagcactgtgtcatatgttatgtaatttacttcaccaagaacggtttgtccaactaaatgtaaaacgtgcaggttgtaatgaataacaaaggatataatcttgcggttnnnnnnnnnnnnnnnnnnnnnnnnnnnnnnnnnnnnnnnnnnnnnnnnnnnnnaggctagacaatcaatnnacag

SEQ ID NO: 4019 - DNA, 4699 bp, Oryza sativa
  unsure (1)..(4699): unsure at all n locations
ttgagatggcnaccgcgaagcatccctggtatccgtatgaagatgtatgctacttcgtttaatatttaccaaaatgctttgttccacttggagatgctattctgcctcttttagtgaaaataactggaggactcttgatacttcttttatagttggtgagcctcatgtcagattcttggtcttgcaggtggcagcaatatttaaaattgcaaacagtaaagatataccagaaattccagattgtttttccaaagaagggaaagatttcctaagtttgtgcttaaagcgtgatccagtacagaggccttctgcagcttcgttgctgggtcacccttttgtccatgaccatcaggctgtaagagcaccaacatgcaatggtactcagttgagaaatggaatttcttcccctgcagcaagtcatagaaaggtgagatttctgctcatttgtttttttcagagtcaatgtcgagctcttttactcttttgaagtaccaacaggacatagtagattatatatttctagatgtttacaagatnnnnnnnnnnnnnnnnnnnnnnnnnnnnnttgtatcatcgcatcagatgatggggggcagtagggctgattcatgtgttgcacataattctttttaggaagcttgctttacatatctgttgttgataaattaattacgtgaaaccaggtttaacgactggattacacgacgtaattcccatgtccggacatccttgtcatgtcttcaattttttccccttttgcagccaaacagagaatcctcgtcaaggagaaacattgctcctctgcatggtatcgcaggactaagcgcaagggaattcgctggattttccacagcctatccttctcctcacaatacctccaggtataccattctacctcctgcccatcctttgtttccaagttcatcttgtaacctacttctcaacatggccgtgcacgtgcagcagcccaactgcagtgagagcaaacatgtctttaccggtgtcgccatgctcaagcccgctgcggcagttcaagcaatcaaactggagctgcctcccttcaccaacgcatccggcgctctcccctggattatcagcagcagcctacccaaacaatcccttgcagaaccagtcgaggcgaagcgccgcagttccagatccctggctggagttgagccagccgagacctccaagcccatatggctctccaaagagattctaggccttctgacctgcagagtttcttgtagcatggctcctcaaaagagattctaggccgtctgatctgatctgcagagttgttgtagatgatatgtgttgatatctgacacaagatagagagggagtcgcatatgttttttgttgacagatcatttgtaactatatatggcttactctgatctgattcatcattcattgtataccataggaaaaaggagggcattaggatgatctctgatgttctgtaaatctgtaggactagaaatgtggagtggaggcttggaccagttgcagaacttgtaaatttttagaaaatggaataaaatatcccggccgctacacacccgaaggaagtttttctaaattgttataagcatattatatggatacttgcgatgttggctgatcgaaaagctaggtttaccctgaatttctaagggagatagagaggtaggagaatgccactgaacagcaagcggaagcagcgggccagtctgtttcgttagagtttcgaatggagagagatcgacaggaggttttcaaatttaaacagcatataagttaaacaaaaagatgtaaagggggccatagtttgaaagatgtattttattttcttaaaagatgagggatgaggctttcaaaccaattttaaacggcgcacaagtttaaaaaacaaaaatgtaccaaaaacattgcggtgagcgtggatcgaacacgcgaccttcagatcttcagtctgacgctctcccaactgagctatccccgctatgcgtgacaagggtctctgttccacctatagtgacgcataacttcataagttagctttggtttatgccaattgaactcagaatctttggattgaaaccacacgtccattgccattgcactatcaaatacatctcgatccatatattagtatccaactaccgaactacgcaagcatgaaggcaattcaacaagttcaaggccacaagggacgtacaccgccggtacacgcatacaggctatccatgtactacactagtacacacatacaacaaagttatccatccatgtacacaccgggtacacactacacgcatatggccagatgcgtgcagaactgcagatgcattagttagggccaaggggaaaaaaaacttatggctcgttaactcgtttagctcagctcagctcgacttttaactcgttaagataatgagtcaagtcaactggctcgacatcaattggtcgacgtcacaagttggtgtctcgatgtgagcaataattaattcattcggtttcctaagttgtacttaaatacaacattagttttggtattataagtgcacagaaagtattagtattgtgcgcgtttattggcttgtaagaggtaccacgctatgctttattgagttactttcttgatttattttgtattatttggtatgttcatattaaattcatttatgattttggatccaaacaatgctttcgttctattttagacaccagcctaggggtggtaatgggtcaagacccgtggatcctttcacaacacatctcaacccttagatatttttagcacaaaaaaatactaaatttcaactcaacctttttacccaacccttacattttgtaggtcaaaatgttaggccaattaccaccctacggcagcattgtcttatttcttttttatgttgcaccccttaaagttagtcctatatttgtcactaagcaagttatataacaaagataaataatgatagcaattccgttagttatatatataacaacgataataatatcgattcggctaactgtataataatgattgattaaattttgacattgtgtaatataactttatcaaaataaatgttatgaccttcaaattgttactaatatactactcaacaagactattagtcccgctctttcttaaaaaaattaatgattggtcaatctttatagcgttctaggctactgatgccctcatatagcttttggcaactatggcgaattttcttgaccgcaatactttacatagaactattacgcagccctcctgttacacgaagcagtacaaaagagtcccgtaattctatcgaaagtggagacacaaagtttacgggtgagactctctttactaatcaatgctctaatcaactgtacaatgagtaggcccctccactctttatacagtgcaatccaatatatgcaaggttcggtgatgggcccaataaatacatttgggctaggtcttcatgggccaaacccaaaatttcttaacaagaacaatgctatcatggaaaaaataagtgcgggtatgcgtcacttaggttgagcctattttgacctagtgaaaattagctgaatttaaacatcttccaaatgaagaaccctagctttaatgactacatggatcatggatggaaaattaacgtggaatagaatcgaatcgaatccctgtggccatgtgaatatgtgatgcaaatgatggagccctgcaggacatggaggggacatgcatcatcccaggcagtgtaaagccatctcccatcacatgtgcacaacctttatagcttagcccttttggtccctgccttgcctctctcccaacaaactttgcccagtgctgcagcattgtgtgttgtgtgtgttgtgcttgaggggtttttatgtctgcatatttccaggggttggctggtccagggggttgctgcagtgtacactagttaatcaacatcaaggaagattcccacttagctctccagcagaaattaaaaaaaaaaactaaggtgaagtatattcaattgcattcattgggcatgttgcacttcatttttactaaagtaactaaaacatgcaacattgttaggatacgatacctttttttcctgccatggttaaattaaggatatgatacaactgatgaaataggaagctaatgtgattcatggtggctagctttgctgaacttgggtcggttttatttttaatatgaaaaacacaagaagcaaaaggatgttgtaaaatattggtacttattttttctaaaatatttaaaataataattaagtttttttttggatttgcccccaagacttttttttataacaggcattcataatacccggcttttaaacaaagccgaagataacggcacagaagtcttacacaacacaaagaaaaacaagtgacttaagggaacagactaacgctggagcataggtatcactggagaggcccaacaatcagaaaaaacacacccccggacaccctaaaacaaggcacctaacatgctaaaccaaaacccaaccccttagcctgttccaagacttccagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4020 - DNA, 1911 bp, Oryza sativa
  unsure (1)..(1911): unsure at all n locations
tcccggtggcgtgttataaaggcngctgttaaaaatanatagtcgttaatacgnatgcgctcttttnttctcccgcataatangagtggggntttattcntcnnncncccncnnnnagccggtttgttgtctactncgtagcaaccaacccgccgggagcnntnncggaccaagcanacccgacncgaacccaacnccgnnanagcgggcgcnacagggcaanactgtttttttgggaagagatcatggtgttgcaaagatttggccacgccactcgcaatgatgtggagcatggcagcacacgattgccatgccaacttgtgtggtgtaggaagaaggttcatttagaaaaggatacccccgtaactttattttagaaaaatgatttcaaaaggtatagaaataatttcttacaataaaagaagggcaagaacacattggcatgaaaataaaaaggtttacatgtgaaagagaactcaccgccatagggtaaattttgatagcagttcagcttcagttgccctcttcaaaggataaatgaaaccaatcaaatttatatcaataacgattacttatagggtcagaaaaccaagcaacactatggaactatgaccttgccctcataacatggaaaaacttaccttgccctcataataaccttgcaacaagtagttcacaaaaccaaagtccgctgctgacacatacacaaatctcttaatacctgcaggtagagcatgatgtggaagcagttaagtcccaaccaaaaataatgtgcatcagcatagacttaattttactttgccatatcatatgaaataattgatcaaaaatgaaagatttggagtgattcctgccttcggcctaagcaagcaccgggcagtatatgcaactctagtgactagatgtcatgcatcgtcactgtccaagcagtccaagctacagtacatggctgaatggtacctctccactttttgtgtacgacagacaagcccaatatgcaaggaagtaaagtgcatgtttctagataattattcttccagagataactttgtgaagtactagtaagaaattgtatttatttatttttttggaaattatgacacaagagttagtattctgacatttacccttttgctttaattgatctgatcataagaactacacactatactgactaaaggagattacaaactagtggggagaatcatatcaatacatgtgaaaaagagcatattgatgaattgacagaaactgcaaacataacatagaaaatgaatatggtgctgcaacaatatgttctcaaacataaatacctttctcagctgcaacactgatggcattgatgtttgcagttccattaattttgtacatgtaagaatttgagccaaagcctccaacacatgatacctatagcaatttctctcatatgagtaatgtttcaagattcataaattcatgttagcataaagcagttactacttatatgttataccttattagagtatcggtgcataataaatttaaaaggtatcaacggtgttccagggatgatgataaaaggtttaacacgaagtggaaatatttccatcatactaattaatccagtgctcatagaacctagatagtatgacccaataatccaaaattatctgcaggcaagggaagtggcagggatggatttgaaaacctaagtgataacaatttaaaaagatggcctgtaaaaaaccatttccacctagatcaaccaagagttatgagcacatttgtagccacaggggaggttggcccaaaaccccgggggggggaaaaattttggctagcttggaaactaaatgatattaattgagaaggatggattttagaaactaaaagattttaacctacaagactgtacagatccaccagatactg

SEQ ID NO: 4021 - DNA, 1326 bp, Oryza sativa
  unsure (1)..(1326): unsure at all n locations
cgccttgtgnnagggtaggcgatgcggaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactgttatgctttgcaattctaaagtatccatgtacctttttcctactatatgcgcttcattcaagaagcatcatagattgcttctcatttgtacgtttcacttaattagattggaaataatacttcattttaccttttgtttcaggcactcttggattatatgagcttgttgagaagatatatgctagcctgcaggaagctgtatttgaaggattagaattatatgctaaacaggatggtttagaggctgcttgcaggattttgaagattttagggtctgatggcaccaagatgtatgaagttggttggcttcttagggacaagactatcatcagtacgtcagtgatcaaaggtgaagacttgattcaccggaggccacctgttagtaggaatacgctgaagatttttattagagatgcaacttttcaaaatgccccatgggttatacatgaaaatcttgccaaaagatatggcatacccattgagccccccgatgacatgatggtgagtgggatatgtgcccctttcatctgtcctttatttccttgggtatgttacaatactaacacttgctttctttgtctagtttggtgaaggtttgcaaaagaaagggaggaaaagacgtgaggatggacctatgggagatcccaaaaaaaagatgaagaacggtgattcatctgaatctggcacctttgttgcaattgttctgttagcagccttttggctatggcattcttccaagatacttatcgatttttttttggtatgatttgcagatgaggaacacataaatgttccaattaagtacccaatagatgatcttttagtacaaccttctgcagatgatcatgctttattgaagagacctcctctggctacagattttagagtaccaaaatattctgtgggcgatctccttatggtatgggacttctgcttgtccttcgggagggttctgaatctatccccattttcactggtagatttggagaatgcaatttgccacaaagaaagcaatgcacttcttgtggaaatacatacagctatattccacttgcttattaaggatgaaggtgactatttcactattctgcggaccaagaaacggaagctaaaggttttcttatgcccatttctcgatctccctctttctccattgatgaaaccgtttcttaatcccttttttatttccttattaagtg

SEQ ID NO: 4022 - DNA, 2375 bp, Oryza sativa
  unsure (1)..(2375): unsure at all n locations
nnnnnnnnnnnnnnnnnnnnnnnnnnnnnnnnnnnnnnnnnnnnnnnnnnnnnnnnnnnnnnnnnnnnnnnnnnnnnnnaaaaataatatttttgtttgtagcttcacatactatttttctgcaaaatgaatactgtgtatactggttttgctgtcctcttactcaataattactgcatctcatcgatgatacttgaagagttctcttataaattacctgctagttgattctggaagaagactaccatcgaaacttttatttgtttctgctatcatgtataattctatgatgtttaccattgctatattttattattcgtatcataagtagttagaaatatattggttgattcctactacaccaatcaattttcaactaatcatttcctgttctgtaacacagtaatgctctggagaaacgatcaaaagaaatcacacacaaattgttgcttgaagaggctgtattgcgccgttccacacgtgtccgggctcaaccaagggataacccatccatgtcattcctgaagtatgtcaacaaatggaaggattactaagtagccaagaggacagcttgtccgcaggtgggggaactgagctagctactcgatgacagggttttgttttcagaggaacatatatgaaggtctgatgaggtggtatgttatttgttagccaatcctcatggctgttctttgagcaatcatcactaggtagcaaaaccaattaacctgttggtttacagccttacactggactgatagagcgctaccagagctagtttttggagctatatacccagtgtaacttatcttacatgtaaacatggtattagcctcaggaaccatgagttgctaaactgatatgctgctgatgttatgccggttttggatttatcagtcgcaggggatacatttctctatcattatattgttttcacttgagatgtgccttgttagatgtagaactgctgaatggtgtttgaggccatgcactgatgcatgtggttgtaagtttgttgcagcacatagcaccattaccattagccccagttacgtgaactatggaaattgccaaattggcaatgtgacatgttacgttgaggtttacattttactttcagaaaaagtggcaaggacaaatccaatttggtactagttggtagctgcacaacgcaagacgagtaaaatgttgtatatgtgtgccattctggttagcaattgttatgtaatccatggtcaacagtagacactggtgaaacaagcgtgccgtacaatgttggtacataccccatatatcctaaaataactcttaactttaaccttgggtgtacaaaataacgtggagagagagggaataaagtgcatcttgtttacagaaaaagaccaaagtatatgggtgggtagttaaggagtattgaagtaatgaaattcattgatttatggaccaaagatagaaattaacttgtttttgaacaaatgacaagaggataaaaataaacccacttattttagaatggagttagaatggagaaagcatatcattcaactggcgatggcatgaggacatttttcattagcttacatgcatttcacgagaagaagaaaggcgagggaagttgaggtaagatagtgtgattgatagatggccgagtgaaatgagagaggtgataatggtcgctcaaagtggaaagctaagcttagctggagagagtgagaggggagaagagttttgagatggaaagaggtaggtggattagaagggaagtgtgagatatgttatagaatcccaagtcatgtgcttacgagaagaatcaagcaacttaaaagagtaaattgcatatagggccacttctttttacccatgtggcaagttggaataggagcagcacaacatttttagtttgacccgggaaagattacatatagtttcactttgggacactttgcttcttctccatctttccctctcttcccttgcgctctctctctccttgagctcgctaggctgatgtgaaagctcaaacatgcaataactaacagagcactttgaagtgccaccctccgtcgcattgttcgcatctcgtcaaattgctcctgcaccacatagcccctaagcttgagcggatctgcgcttgcgtcgatttgaggcggccatctcgacggtttatggttgacgatgagcaagcctagctccatccttccttcgtgcaaccatgtttcagtttgaggacatggagaagagctcatcaagtggctcatgcatcaatcaggtccaaattgcaacaatttgtaagtccatctggtttaaagtgaaaannnnnnnnnnnnnnnnnnnnnnnnnnnnnnnnnnnnngcgaaacgtaatcaagggcgcgt

SEQ ID NO: 4023 - DNA, 1062 bp, Oryza sativa
  unsure (1)..(1062): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatcttcatgtgaattcgtgatgtttcatgtacgattataagaaaaatgaggtaaacctacctaaacgtacaatgccgatgagtaatcttccgctaggattatatggtgagagacgctgaactttttgtctgaaaatttttctgacgctgtaacgaacaattttgtcgatgtcatgtggtcgtgtatccttcagcttaagagagcccggaggctttggatcagccgatttttagagcataaattagtgcaggtgctgctgtactatgatgtaccatttctgagatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4024 - DNA, 10312 bp, Oryza sativa
  unsure (1)..(10312): unsure at all n locations
cgcgtcnnatagattgactactctnnnnnnnnnnnnnnnnnnnnnnnnnnnnnnnnnnnnnnnnnnnnnnnnnnnnnattctttgtaaactttctattgcagaacatatacacctgaataccaaaatctatgaactgagcatacttgctcggccagccacctggagtgaggcgattgtactgaagaagacaatataattagtacttcacacgaacctcgggtgttttactaacaagtgataaatgccgaaatgtcactatagttagtacacataatctgcataagctatatgataccaagtcaaaaactaggcaagaacagcgtttaagaactaactgtcataagagaattgcagctcacacagaatcaagcagatcacaacaggatggaagaatctaagcaaaaaataatagctaacttcaatcaatcacctgctcaaagttgctccaaatattgcaatctggaccacgaccgtcccgcacaacccttatatcaatatctgcaccctgaaaggcctttatcagtaagacatactcacaagcagaatgaaaattattcgttatccgtgcaataagcacaaaccattgtcatggctccaaaatgcgcggctgcaaccaaaatactcccagtcccaacaaaagggtcatatacgagcttcccggggcgcgccagcccttgattcgccataagaaatgccatttcagcatccattgcggtcgggccaatatacttcctgctcttcagctgatatgtcggcaggagatgcctatccgccgctccaacctcgcggccaaagaataccgtcctctgagcaaccggcgggaggccattgttgcagccatagtcatcagtctccatgacaaagaacttatgatcgggcttcttcaaattaacacggccctggaaatgaggaacagcaccaattacacacaagagaaaataaatgcatctgacatccacaaattcgtgatccgaactactccatgaactcccttcgtcccaaaataagttcatttttcaccaatccaataccaatacaacataaaaaagactataatacctactttatcaaatcccaacgcaattattcctcactttatctactcctaacatatttatcttctattttcataaactccgatgcagtggttactcaaaaatgaacttattttgggacaaactggggaggctaaaattgaacttattatggctcaaaaatgaatttaccttgaaggggatgtaggtgaggctcttcatgatgtcgttctgctcctggaagctgatgaccttgccgaagctgtcgacgacgatcttgaaggtgctctccggcgtcaggtacggcagcttcctctcctcggggtacgccatgaccaccctctccagctcctcgtaggtggtgccttgcccccacagctcgtagatccccttcaccagcaagcctacaaacacacacatggcgtcgcggcgccccccaagattaacccgcaagaagaagcttagccagcgaatggtggtgaatcaatcgatcaggcgaggcgcttttactgcggttggcgatctgcgcggcgaggcgctcgtcgcccgggaggcggacgaggtggaagggggagtcgacgtggtggttctccggcatgcgccactcgacggcgtccccggcgccaggcccgccgaagagctcggcgagggactgcacctcgggccgccggtagtcgaggagcctgtggtagaagacgcagaggtaccacatcctgtcggctcggcgtgtggccctaccgggctcagctccggcgagtcaacgcgggcggcggcggcggcgagcgggcggagaggaggggagaggagggaatcgaagctgcgaagaaaatgaaaacctacttaaaccgcccgagggacagtggccgacatgtggggcccatcgaatgtatgggcttgattgtgaatgggctgggccttgattgtgaaaatgctccctgcctctcctcttcaaaaaggaatgcagtgatctccttgaatttaaaagtactgtttgtgaaagaaccaaaaatacttcaagtggaatttaaaatactgtttgtgaaagaaccaaaactaattcacaaattatatatgtggagatgcgggggatcgaaccccgtgcctctcgcatgcaaagcgagcgctctaccatttgagctacatcccctttagttgttttgttttcatgaagagttccataaagaggtgcggtgaaatagatgtggtttaaaacgttctagcagtatttcccacgcaaattgcaggccatgtaggattgcatttgctataagcctatagctagtacggagtagccctttctaagggcatgtttggttgaaagcactaccaaaatatttgtagtgtcaaaccttgagcaagtttgagtactatcatttttcctttttataggaaagagtagtatcaactctattgactttgataaaaattggtatcaatccaaatagctagtgtatactattgaagttaccaaataagtaattggtaaggtaaaatttgacttcaaaccattcagaccaaacagaccctaaaaatacaggtgaatttctcgtacagttatagtagcactagcgtacccctttttttcttagccggttaacttctctaatgatctaaaattcaaaagaagctgctttgattttttttcttttttagaataaattcattattctccagcagcttcttttcactatttactaaaactacaatgaagcaattaagaccgaaaacagacagattgactaggaatacatgaatgatccatgagtgaaaattcaccaataggcagaagcagaggacgagatttcaaaacaaagaaagggcagagtgccattaactccagagatggactggttcttgcaaatggtttatcatttcaagtaaacatatactcgagcgcaaccaagacattgcaattgaatgtatcaatgaattagaatgaaccacaaggttaaagggcaactcgatttcatttacacaaatcttattgtttttctcttctcatttcacattcagaatgtctaccagctcaaagcttccgagtttatggaaacagagatgtttaaggccatgtgtgaatgtaagttttcagattacagggaaggagctgctgccaaatttcccagcagttaggcgttcaccttgtggagagtatactgcgaaacttcaagaatcaaagtatctgtgattgcgcatggatcatggtctacatctccgctccgaggtgaatccctttccttccaagaggggcacaaagtctcatctctgagttcactgctcagatgcaggtgcaacttgaatgctttgatgcctaggaacacctggatctatcgcaggactgcacttctttatgtagtaagaatgcatccccttggtctccgctgaatgcacgtcgctcgaagctgcatactgtgagctgcctcagtagtttctcgagacatgagtaaaggcaactctcagggtccttcatgttcgggttcgttgacaggacagctgcattcactgcatccgctacaaattcccgctgtggagagtctagcagatatccaatgcacgattcggcaggcttttcatatgcaagcagggccacgctctcctgcaagtagatttgttcactttttagctcagaaattgcaaagcttatatagatgtgaagccttaaaacactttgctattgcaagtaaaattggacgcattacaaatgacccatcaacatctaaaaagccattgcattacctttagcaacccatcaaaagctttatgtgtcaagaagttggccaggttagagcgagcatattttacagcatcctccagttgtccagcctaatgcaagagaaactgagattatatcattatgaaacaggatatagtgtaataatgcaacatgtccaagtgcccatcaccaccagtgagcatgcaaacgaaagccctaggtgggcaacatcaaacagaaccacatgccaatttgaccagatgtcaaaataagttgatctcacatatgctccctccagtcaaaaacaaatgtgtgttttggggtgcatcagccaaactccatttactactgttttttttagattggacaatttatcataatcttacatgtgtgttgtattttattttattaaagtacgtagtgtattatttttcatgtgtgtataagtagtttgtcagttgatgatatgcttatttgcatgcaattttgtagcttcgatctctagagtataatatacatatttaaccaaatagctgaatgttaggagttcagataattaccccgataaattcaatgaatctttgggaatggagtaagaagcaaataattgatgtttcatcctgcaaaaaagaaatgatttcttagtggtgaactaactctttgcggaaagtacatcatggcaactgaaaatgctaggataaacatagtatttgactaatcgtaatgcaagcaggttattaaacttgcaaagcgtacaactttcctcccaaaacttgtgttacaaagtaaaatgcaagttcagggatgaaagtggagccacctcataaacttgtattacaaagtaaaatgcaagttcagggacgaaattggagtctgcacctatcaattcacattagaagtttgtggaaactgcaatgagtaaatgaataattaattatcagatagaagactgtacctttatcacctgtggataccattctccaagttttttgaatgcagaatcaatatctccactcatgataagcttcacgaaatcaaacaaactgttttcagaaggcagaaaccacaccaaaaggggggaaaatcgaaaggggccaattctatgaattatgtagtatctgcacagtatagcagacaaatggaatagctgcacacaacggtgtgcaaccaaaaatatggaagagattaagtgcagtgcagtccaaatacagccgagctgtgataaaaccttgttttacttcagggaaaaagatatctgcctatgaagcttgcattaataaatcgtaacatctcaaaaggttaatgaaatctaaaaaaaaacataaacactaaaaaatagtggacgtgagctggagcctttaagactgaaaacaaatgtcaggttagtccactcacaacactacagtctacaggtggtgaccacaacaaaaatcaatatggatacttggcacaaagatgctctaatcatcagtgggtagtaactggtatttaactgattaactactgtaaagccctggtttcaagagaatatgtatgatcttgtaaaaatcttataaatactaacaattgactccccagtgttgcttattagtagattagaaaaatggttcaacagcaataacaattcagtttcaaataagttttccttagctcacctgacgcagcaattttctgtggctaagaccatacatttcaggaggttccccataaccattttgatgattggatggaggatcagtttcacttgccatatcaaaagaatttaatgtatcttggtagccgtaatgtaggagatatgaacgaacaatcctgttacaagtgcacagtacatgtacataaggcggcaaagtataaaagatttaatgtcaatataggtacaattaaagattgagacaaggtaggaatgaagggcggagtgaatatggtatcaaatgtagattacgtaatatggtaaatttcacataaacataacaggagcagacaaataattgacagcacaagtcagtgattatcaaacataactcgctaacctatctcacaagatacagaatgatctcaagatgaaacagtgatggattcttaacatgagaaagcataccaatgactgatgtctggttgcaaatccaatttgtcgctgacagattgttgcttcattttctcttcaaaaatatagccctgccaataagaatcatacttagtgttatatcatgtgtgcatgaactaaacaccaaataggtaaatatacatgaaaagaatgagctgagtgataattgtaggctataattccataatgaaaaccaattggttcttatggcaccatacaccatattttggtggcctgattactacctaaaaggatgcatgcaaccaaaagttctttcaattatatgaaaggagctgcgcttaagatgcaatgcatctgaatttggaaaactaagatggataatctataagacattatgatatatgtttaattgatgcagcaaactgtggaatggaaaacatggaatttgaaataatactccataaggaaatcatgacaatattacatttttgtgtgaggtccttaataggtgaataggaatatctagatctattggctcacctcaatgtcaaaacagaatggttcttttccaaagtttactgtcaccctgatttgcaaaaatgaacaatcagatccattgaaaagctgaaaattaatataataatttatgagttatggcacataacgcatgcaattccaagcctaaataatatattaacacaagcaaataatttcacttaacaccatttttcagcaacttaggtttaactgtcttggttaaaatgcaattttccatatttggaatgtctattttcattgaaataatcacttaggcagcattcttgctgttaggttggagagagtttttcagcgcacgcaaaacgagaaagctcattagcatggattaattaagtattaattattgtaaacttgaaaaatgaattcatttgaattttttaaacagcttctatatagaattttttttttgtaaaagatacatcatttgacagtttgaaaagcgtgcaaatggaaaaccaggaagttgaagtttggagttgaagaaaagaactaagtcttaggaacgggtatcttactcttcatcttgactatggactgcaatggtaggatatagtgggcctttaatttctttttgaaaggatccaactagagatccatttttcctgcaaaatggtacatgtaattagattaaagtgcagaatgatatcctgagatgaataagcatggtcaaggcttctgaaggagaaaaagaaacaagcacatggaaagttaagccagtaccagaggcgtagtggcagatgcaaatgcaactgatttccaaattcaatatttaacagccaacagctgtagtgaagacaactcttgcgaatttcaaaatattaatgaaagcagcaacaaagcacagcattcatctcaagtcaagaaaaaaactcacaagacaaaggatgaaagctatgaactttaagaaagtctaaaatatgacgactaaaaggctaatatagaatagctaatcggagaagcagacgctgccatgccaatttagaaagaatgacagaacttacgtgaagaaaaattcttgtgagaaatagttgatgccagcaccaattgtgtcaccagaagtgaatttgggaccaaatgactcacttttcccaggaccacggtaaagatagccatcatcgccatgatatccacagctgttagactcccagctggaatgaatatagaacaaacatgataaatttaaaaatgtcatcaaaaggaaaaaaaataatatactttagtggtaaaatttgaagtccactcaaagaaagaaatggtgggccatactatttgctaactatttctctgaatgtctgtctattaaattattaaaattaggtgaaaaggagtctccatgtttgccaaaaacctagaaagtgccacgttggtcccagacaaagaaaaagatctgcaccattgattctatatgggtttggtttataaaggcatggtctaaaataatgagcctacaccaaaacaccatttagaaacaactgaaatttggattgaaaaatataagataaagagtccatatgaaatacaatctagaaaaactgaatctccattgaaacataaaatcaaactgatagtttgattccatacaaattccaatgttaaatgtcaaatccctatataactacaactcggaataaaactaaagttgcctgaagcaaatgtacctgtgcaagtgtcagggtatttgagacaaagaaaaatatttacactgttgattatattgtgggtttgggttttaaaggcatggactaaaagaaaagagtctacagaaaaacaccattttgaaacaactgaaatttggagtgacagatataagataaagagtccacgtgtaatacaatatataaaaacctaaatctcaattaaaacataaaatcaaactggcgatttgattccatacaagtttcaatgtaaatccctacaaaactacgattcagaataaaaactaaggtagactgaagtaaatttacccgtggaaatgtcagggtatccggctaatttatagaaattaagataacttcagccaacattaccacaagttagccaggaaatcttcctcaatagggccaatattagaaacttcgatgcattgaaacaaactgaaatggcatcctacctctttagcatgataaacctagcctatgcaacaaatagtccaattcaaccagtgcactacatgtacttaggtttcctcgtagtaattttaaatgaatttgtgatccccacacattatcttaggttcttaggcaggaaactcaaccagctaaaactcggttgctaccataaaactgtggcattttctcaaaacgaggatatacacatttctgattgccaacaacatcgtagacgaactaacagcggaaccaagcgacagcaagggcagaggggatgctaacccgggctggcggcgcatcttgaaattctcggtggtgaagccgatggaggtctgccccttctggccggcgttcttgacgcccatctcgaagtagtaaaccgcgcggcgcgtgggggcggggcggttggcctgcacgacgccgacgtcgtggccgtgctggttgacgccgaggtacctgacggacatccggtcggtagagacgacggcgaagaggcccgagctgttggtggtgttgagctcggacggcgccggctccgcctccatctcggccgccgcggccccccactccgcgggcgaccgccaccgcgacgccagcctcatcgggtcaaccgcccccgccgacgcgggcgccggttcttccaccaccgccgccgccgcaaccacctcgttcgccaccattcgccaattccaaaaccccccctggtagcagcagaaacggcaccaagttagggattcgattcgtccgaccaaaaccgaaacggcgatccatccgggaagccctagcacgagtggcggggaaggatcggcggggagcttaccgagtgcgggggatcgagctgccggcggtggcggtggcggtggcggcggatcgggcggcgctgcggttgcgggaggtcggagtcggaggagaggatggatgggggaagggaagggaagggaagcgtgaggagttgggcgtcgcgtcgtcgcgtgtcgtgtcgtgtggcgtcgcggcgagagaaagggggaggggggtaacgtactcgtgtactttccggcgttttcgcgacggctgtgcttgcgttgcagtgtggatgaatgaactgtagagacggccccgtgttgttcagcgggtgaacagtttgggctttcgcagggagaggcgacgcaggttcgaattttttttcatttttaatttttttttcttttaatatttacagaaataatccatcggcacaaaaaaaattacaaaaatagaccatgccgccctccactagggcggcaagctgacgtggcaaacgggggagggacgggcggtgacggcagacgggagagggagcacggaaaccctagggcggcaaggggcccccatgcaaaaaagccagcccgggcctagtacttttttgctggtactttttnnnnnnnnnnnnntttnnnnntntnntntttttttttttttttttttttnttttnttttttttttttnntntttttaatataatannnttttttntttnttttttttttttttntttatgaaaagtgatctattttttattccattaattatatattgtgtttcatttcatagtaaatttttaagcccccttccccttttgatggtacaccttaactcaaacgttatctgcggaagacctccccctcaatttttcgcacttttataggcgatagatccgttattgtttatttgtgtggagcatatctcgtgaccgtgttttcctttttgtacgcggtacatcttacttgcatactcttccttgggtttattgtattccccgtgctctctggttaagggctaaagcccatacgccttcaacccttggaaacttcgttt

SEQ ID NO: 4025 - DNA, 3625 bp, Oryza sativa
  unsure (1)..(3625): unsure at all n locations
ggtaaggagtaagatttccaagataaggggtncttgagaaggagtaaggagcgaacgggaaaggaataggggggcggagtatagacaggggagggcaganggnggggggggngggntgggaaaaagtaccagccaaatgctctttagggctgcgaaaattgcatttagcccagagggcagcaaagggctaaatgcaattttcacagacggcggcggacggcgccgtcgagccgccgtctaccacgtcagcttgccgccctccattaggccggtatggtctatttttgtaatttttttcgccaatagattatttctgtaaatattaaaagaaaaaaattaaaaaatgaaaaaaattcacgcaggttcactggttcagtgaaaaggaaaaaaaaatttcaacatggcctgttctaataacttcgtaaacatacaaaactttcctcgttttcaaactaataaatggttatcttatacgaaaattttctacataaaaattgttttgaaatatcagataaatttatttttctaagtttttaataattaaaacttaattaatcgcgtggctttctcattttgtgtgcccgcttttaatcttcatccttagaagattcgaatggggccttacacaacactttgcgtagttgcgtcggagtatataatatgcatttatttttatataaaagccaaataagattttctatgggggtttttaaggcagaaaatatggttgtaaatgcaagtgtatcccctgacccatcgtcacgaatgaacggttttctcacttttacaatgagatttcctctttttacaaggaggagtgttgcagttttcaacttgaagtagagaaacggatgcttgaatcatgggtttttctaactctgtaaattcttgaagttggagttgttgaggtgagacattaaaaattataatttaacctagaaattctatgattttacaattcaggaattagaagcataccaaaacaataccagggcaattgatcagccctatccctcaatttagcacgcaatttttgttgcacgcaaaacaagaaacctcattagcacataattaattaagtattaactattataaatttaaaaaatatttgtatttactttttaaaacaacttctatatagaaactattttaaaaagcaccaattaacagtttgaaaagtgtgctagcagaaaacgatgaagttgaagtctggagttgaagaatagaatatggccttagttgtaaacgcttaatccataaaaccatgcccctttattttgaaattgaagcatcagactagaatattagaaaatatttctgtctaacattatacttttataaggatatacaaatagggacaagcgtgattttatccatatactgatgtattatgggttgacacctttcaacatcaatatcctacttttttcagttgctacaaatgctctaataagtttatttacaaataatatgtgaagcatcgtacagttctgtttggtgcaaaatacctgtaattattgttggcacatcgcatcaaagaattggtcacttctaaaatactactccatcaaatcaaaccataatgcagtgttttttcaacgaccacttagccatcaaatcaaaccagtaaattcttgttgatgtagtactaaacggtagctccatagtgcagtgttttctacttgatgcacaacaactattctagcctttttaacttttaatgtgagtattagtgcatcgtctaaaagccttaggtatatgaatcatgacccttataaaaaccagaacataacctataaatctacacattttccaggtacacatatatttaaaaaacataaaaaaaaatagaaagaagtatgcatagctcaattggttttgtctcttgtggtgaaaccagcctgtctgagtttaaaccctaaacttgtggtgaaaccagcctgtctgagtttaaaccctaaacttaagtacttaacatgagtttcgtatttatggctaattattcatttagttgtaagcgatatacctatcaatagcgagacatttgtggccggtccaattttccggatgtgctcatagggataggatgtgtgtagagatggcaatggggacccataacccgagacccgacgggtttttactctattaggagctaatcgtgttcttactgttatacccatgggtctactaacgggcgaaaactcttacccattgggtacgtgggtatgggtctgttctttacccacccgtacccaccaacccgtgggtaaaaaaaacccgttgattgaacctaaaactatgagcaatataagtttcaacgactactaaatcatagcataaaacttctttcacatcttaagcattgttctatactagttatgtgaaattattattagatttattgattatgtattgtggttgtataatttttttactcgcctttgaacactaatattaatagcattgttgctagagaaaatattgatagtttagaactctaatatggctaattagagtacaaaactataaatgctacaagtcaattatatgggtatgggtacccgttagatacccgttacccgcatgggtatgggtatggggacgattttgtacccgcgacgggtgtgggtatttaagtaggaatattttaacatcatgggtgtagggctgtgaacgagccaagctcgagcgagtttgactatgtaggcttgagcttgacatgaactcgagccgagctcaagccgagcctgccagcctggatactgatcgagcttgggaatgagctcgagtttaagctcgagcgagcttcgagcctactcgagcttggtagcttaacttggtgaaactccaaagaacttactcttatataagagatattaatgtaaattatcggtagtcaaaattaatgggtgctatttgtcttgaatgaagcctctgcagcttttctcatgaatacatggctttgaaacgttgcaattaacaaaagctagctactacatctaataggaatagtagtactattactagcagccgaataattactttattgataagcattgatggggtcttgagacttgagcaggtcaagcacaatgacaagtatatattggcccatcaaaaatatcttcctacatgcaatgcatattatactaatcaagccttgtcgagctattcgagctcgagcttgctaggcttgcgagcctcagcctacgcttgagcttggcttgtctagtattcgagccgagctcgaatcaagcctgtaacgaatcaaactcgagcagcttgcgagctccaaacttttttgacagccctacgtgggtgtgggtatggggcaagggaacccgatgggtatgcacccgttgccatctctagatgtgtgtccgtattcatatgggtgagtatatatatgtcttgtgtgtgcatgtggatgagtacgcaatgcgagtgtatgcatgtgtactgtgttgctaaaaaattgagaataattaccttttaaaaaagaagaaatggcatcaattttctttttttgaaaaaaaaaaaggaatcgccaacaatacttcagaannnnnnnnnnnnnnnnnnnnnnnnnnnnnnnnnngcaactgaacgtcattcaaggagcggc

SEQ ID NO: 4026 - DNA, 3904 bp, Oryza sativa
  unsure (1)..(3904): unsure at all n locations
nggatcagaaggcggctcctcctccggcaccgcgggggagcgccggccaccgcgaaggagatcgaggccaagctccgcgatgcggacctccggaggcaggtgggtcgctgtgatctctcggcgcacccggcgcggcgctttcgagatttagttttatggttttttttttcgtgtttctgggtgatttggttgtggttttggtcggtggattaggggcatctgtgcaattcatgtcaatatacgtttcatcaggttggtagttagtgaattgggagtagcattccggagtgcagattttagtcacgtagctggattactgaatggtttgtgttagaagcaattggccatcacatgatttgctgggagttgattatcaaggtaacgctgttcttgatcaaacccgggagccacaatataacttggggtttatctcaaccatgtcaaaatgggagcccagattcattttaggatgattgatatttgaaggcttccaattttgctgtcagcctgtaaaatgggttctacaaacaacaattaaaattggtgttgttgccaagttcatttgaaggactggcagaaaaaagtacgatcactgtggcttgttaactcatgtgtattctattcctccagcaatttcatgaagcgttatcgtgcaaagcgaggtgcacagtcagatacccttcgtgtccatctcaggaggaggatcctaagaagcgccttgaagcaaagcttgtggctgccgagcagaaaaggtaacagaaagagggacctagtcacctagcagagcatatttatctgatcggatattaagatagggaacagtgagaagtgatttctgattgcaggttaagcctcctggctaaggaacaaagtcggcttgctaagttggacgagctgcgtcaggctgctaagaatgatgcggagttgaggttcaagaaggagagggaggaacttggcatgaaagttgaatctagagttcggcaagcggaggagaaacgtacacaactcatgcatgctcgttcgcagaggagggctgcactggaggaaagaacaacaaagtaccttgtgcagagagtggcgtgggaaaacaagtacagggagcgtgtacattcagcgatcctgcagaagcgcactgcagctgagaagagaaggacggggctattggaaggtgagaaaaggagagcccagggtaggttttcacaggttcaacttgctggcaggactttatcttgccagagagaagctgacaggaccaagttaaaagaacaactagaagacaaatttcagagggtattcctttttatcctgcagagttggtataattgttttagtagctctttgacttacattgcaaactatttatgcaaaacagtcaaagcgccagagagctgagtatttaaagcagccagtaagtactcacagctttacatacaccgcttcagttaaacccggtgattttctttcaagaattctggcaaggtatggtagacttatacagtcaactttctcgcaattgtttggcttgtgtgtatactttaaattttattgattattctattcgatttaatgcttcaaatgctgaaaaagattcataacatctaggaagacaacagtggtgttggctagggcctttaacatgctaagaataaatgaggaatctgttaagcctatgccatttaaaaaactagctctttgcattgaatctcccacagttcttcagaccacaagggcatttcttgatcgcttgcagagtcgttttactttatctcagtcatcaagtccatcatcaccagaaaatattgatcatctgctcaagcatctgggatcaccaaaaaggactctatcaaaaagtgggggaagaactagagtgacaccaccaaagacagctagaaattcagatgttagcaagttacctagatatttaccgaggatagttctttgtgcttacatgatactaggtcacccaagtgttgtttttaatgaacgaggtgagcgagagaaactacttgtggagtcagcagaaaactttgtgaaggaattcgaactgctgattaagacaatacttgatgggtcaagtggtgcatgcatactgaaacagccaatactagatgatctgtctcctggatcttctaattatcaggaatcttctgccgttgttgctgatcggaagaaattcagatctcagttggcttcttttgacaaagcttggtgtgcctatctttaccacttcggggtgtggaaagcaaaagatgcaaagtcactagaggaagatcttgtcagagctgcatgcaaacttgagctatcaatgatgcaaacatgtaaatttaccgctgaaggccaaccagagaaccttaatgataatttaaaggccatccagaaagaggtatggttatatacctggtgccttttcctttgtttttttcttttacctatttccctgacattagtaattgagaagtattttaagtgcataaaatcccgctattcagctattgcaggaagcagtccattcctacaactttgcacttagtttatttattttgattatagttttcttttgtctagtcaaaactttactatctgttgaaattgtttctgttcatcacccaggttatggtagaccagacacttctaagggagaaggttcggcacttgggtggtaaagctggtattgagcggatggaagttgctttatcagaagcaaggacaaagttttttgaagcaaagggaaacaggagccccttggcaacaactataaaaaatgtagcagctacatgttcttctggagaatctcctatttctgacatgaaggagaattccaacattaatgataaaaggccaagtcaggctgtccaatctatgttcagagttccctcttcaccatctgaaagtaacacagcaggcatcaccatgagtaatccaatgacagtgagcagcactctgtcagaaaaacggccaacagagaacgagcagatggtcaatgagattcttcatggttttctagctgacagctctagtaatattgggactgttgagggtggtttcaaggttagatcctatgttacatttatactaggattatattgtaagttttcatattgctggggtgcagacaataataaccaaaaatgtataacatgagaaagaatttgggaagcttttagaggggctcacatgctgtgatttagggtctagattctattaatgtggtacgtctatcagcttaaatatgaacttttttgcatccagtcactcttttttttctcaggaaaaagtaagggaaacaatggagaaagctttctgggatgtggttgtggattcacttagaggagacatgccagactacagctatctggttcagctggtaaaggaagtcagggatacattgtatgagatggttcctaaaggttggaaagaagaaataatcaacaatattgaccttgaaattttgttgcaggtaagaagagcttgagtgattttatcatgaatctacagaatatatctgataccagttttgttgttttttggttgaaaggtacttgaatcgggcacccaggacatgcaatatttgggacagattttgcagtactctctgggtatgctgcgaaaactatcctctcctgcaaaggaagacgaaatgaagagaagccatgacaaattattgggtgaattaactgaacactctgagtgtaataacagtggttcaaattcatttgtaattgctgttatcaaaggtttgcgcttcaccatggaagaactaaaggtttgtgaactccttgagttcttaaataaacttcatggaatatacatnnnnnnnnnnnnnnnnnnnnnnnnnnnnnnnnnnnnnnnnnnnnnnnnnnnnnnnnnnnnnngttngtatcatgctaatcaaaannnnccgccg

SEQ ID NO: 4027 - DNA, 904 bp, Oryza sativa
  unsure (1)..(904): unsure at all n locations
cgcgcgtggtaagaccctctccccacgccnnnnnnnnnnnnnnnnnnnnnnnnnnnnnnaatacctgcagaaggcttttgctgatcgctatggattcccgtccaatgcatcagttgctctccgttcaactgctcagtggatttccacatcaaaagataccgtggaagtagaatggaatgagcatgtcagctctttttcagctctgccagaaaccgatcatgttaagtctatgaattaattttatgcagtagtcacagcagtacacaaccgctgtttgtagcaatagtagttcaagtatctattattttcacctgctgttgattttacttacacatccctcgtaacaggctcagccatttgttgccaccctccgatcaggtcatggagttccagatcagcgacagtctacaatacctgtgtcaggtatttattcttttttccccttgtatggccattgttctgaactccttaatcatttagtgtcatgataagcagatgatacggggctaccagagtgcacggggcaaaggcttgaccagctaataaggattgggttgttacagctcatcagtggcatagagggtgtgcaaatgcagtcagtaactgagaccttcaagctcaattggttgaggctgaggtctgtacagagtcaattccagcaagtgattgtaattgcaacaaggtgaaacattactcaattttttcactttattcacttcactgctctgagtatcagcagttagctagaatggtataaccaaacccaattacgcctcttttttttcctcgcagcatgcttgtgcagcgtcaagttttggcgaccgacgacccaaannnnnnnnnnnnnnnnnnnnnnnnnnnnnnnnnnnnnnnnnnnnnnnnnnnnnnnnnnnnnnnnnnnnnn

SEQ ID NO: 4028 - DNA, 3282 bp, Oryza sativa
  unsure (1)..(3282): unsure at all n locations
agagcaggaaccaaaatactggccagggtcttcctcaaaagcctccaaaccgattgaccccgtcttcaaaaaaggtctcccgatccctctattgtgcgttccgcccaatcaccatcggtggcaccggtgccagggacggaaagctcgccgacgccgccttgaggcgcatcggcgcgacaaagctcaccgaccgggtggtgagatcggccaaaatcctcatcagggccgcgtccatttcacaacaggtccacggcccttggtacaatcacttggtgtgattcatggtgaaaaagctagtgaaaacggcgtcgtttgagcaatctgaaccgctaagcgttcgtgtgaaaaaccaaagatctcgtcttgtttacttgttagtagtggcaaggcagatggtagattggtacgtgagcaatgccctgctgctttgtgtgaataaataaaagagatggtactgtactatgcttgtatctgaaatcctgaacaatgtgtgcgtgtgtggtggtgttcatacgtgtgatcaaatctatgcttgtatatatacgaaacttaaaaatggtttcatcaatctaccatgtagtgtatacgtgcatatccttcatcagtacatttgaatctttgtgaactgtgatgatacgtatacaagcatcatgtctgaagtcacagacatttctgatcttctcttcttcttctctatctgcagcagcagcagttcaggaggagagctggtcctctgcggcggcggcggcggggaacgccggcgccggcgacgaggcgtcctctgtggcggggcgcgtcgacggcgggctgctgctggagcgcgaccgcggcgagggacggctggaacttggcgacgtagtagctgaacggcgggccggagtagacggtggcctgcggcggcggctggttcttgccgacctggatgaggatggacgacacgccggcgacgaagacgagggcgaggccgccggcgatcgccgccgtgttctccgacccgtccgccgccgcgcccgccgcccccgagctgatggcgctctccgccacgtacaccgtcggcttcgcccacaaccaattcaggtcagaagaaaaataaaaagaagatatttcttgaccacatttaatacgcaggaaaaatccgaaaaatttgaattaatccgattttttttaaaaaaatttaatccggcatttaatacgctcgcgaaattaatgggcctttcggctgcccgggctgcccggcacgaacagaccgatagtaaaatcaatcctaaattttgaacaaaacgagaagaaactgaattgaactttcaaaaacaaacctgttactagacacaccttaactagaatgaatttgaacagaggaacatgttcagattcgtgatgttacgatgtggagtactatgtatgtgagtacgtttttttatgggacataggaaaaatacaaaaaaaaagaaagaaagaaaaaggaaaatacctcgacggagtagatgttggtttggccggcggtgtccttctcgacgtagccggtccatcccttcttcttgggagggaaggtgccgaccaccttggtccgctcctccgccagccactccgcgctcaggctccccaccttcttctccggcgcgcactcctcctcgttgcagtcctccgccgccggcgccggcggcggaggtgaagaaggcgacggcgacgacgacgacgacgaggcgttgcaggacagtaggaacagcctcccccctcgcgcgaggctcgccgccgccgacgccgcggcttgtggcttggcggcggcgctgctcctcaggaacgcgcagcagctggtggtgctcgccgacagcatcgactgcgccgggcaagccatctcgctgcgcgccctcctctctactctctccggaccaagaagaagaagaagaagatcaataagatgnaggagaaaggaatggcgtggtctagatagatagatagttggtgaaatggtggagtgagcgcacacagctagcggagaaggaagacgaggcagccttttatgccgtcgtgtcgcgtcgcgtgctcggcgagaagaaggagtaggaggagaaagatctgtctggctgtgcgagggagaggatggtattacgtggctgtaccggggcagggggtgtggtgggtgaatcctccacgtcgcctcagcttggtctgtgtgtactgtatcaacggccaaccggcaaccggtgaagccgtcaatactcaagacagagaccccaacgtgtctgcctctgtgcgcgccaatgcctggaggctgcccgccactgttcgtgtgcttgcagcttccccggccgtctctcaccggggaggcgtccaaatataatccttttagccactaaaatttatcgtaagagataataatttttcgcctatattttagttttaatcaattgtaacattttacaatttaaagttttttacatgcatccttttcttaaccaataacagcattcctccatttaattctaccaacctttttattatactcgtgtccaacactccgtactagctaaagtgcacctgtatttttgtaaaacacttttattagaaaattatgatgctcgtactatcatgccatgtttagaaaatgggtttggatatgatttcccacccctcaaagggcatgtttgaatcttcatccattcttctcaccccgttttatcctatacctccattcgtttttattttccaaacacaccatcagtgttttcttgcttgatgttccttactgacttctttggttccgaccttaggaggtatatttggatagcttttagatcatgagaaattgtgggtggaaatttgaccggagagaatctgaagaataaacttcttgtttttctcgattatacaactataacttctcacaatctagataaaaaagtagaattgtctacaagagcttccctcggaatcaaaagcaccctatacaggacttgtttttttactttctttccttcgttcaccggtacaaggcaaggcgaaggtttcttatgttaatatttcgcatatgtccctttgtttctaaatataaatatttttaggttgtttagaataaaagaaactttttatccttcattgtcttattggtcaaaacttgaaatttaatgttgagttaattgcggtttgggctggatttcttaatcaaagtagcataatggaataggtttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4029 - DNA, 1866 bp, Oryza sativa
  unsure (1)..(1866): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacgatgctgtgcaagtattcgacatgatgccagcgcaggacgccatagcatggacagcactcatctctgggcatgagcagaatggggaggaggagatcgctctcgagctttttgaaaggatgacaggtgagggggtagtgccaaccccctttgccctcgtgtcatgtctgggtgcgtgcgccaaggttggtcttgtcgcccgagggaaggaagtgcatggcttcatcttgcgcaggagcatcggttcagaccctttcaacgttttcatccacaatgcccttattgacatgtattccaagtgtggcgacatggtagcggccatggcggtgtttgacaggatgcttgagagggacatcatctcttggaactccatggtgacagggttctcgcacaatggccagggaaagcagtcacttgcagtgtttgagaggatgcttaaagatgaagtacaaccaacctatgtcacttttctcgctgtcctcacagcttgcagccatgctggtctagtctctgatggccgccggattcttgaatcaatgcaggaccatggtgttgaaccaagagctgaacactacgccgctttcattgatgctcttggtcggaatcgccagctggaagaagcaagtgagttcatcaaaggcttgtcctccaagatcggtctgggtacaactgggtcatggggggccctccttggtgcatgtcatgttcatggcaatattgagatcgcggaagaagttgccgaggccctgttccagttggagcctgagaacagtggtcggtatgtcatgttgtcaaacatatactcagcagcaggacagtgggacgatgcccgccaggtcagggctctcatgaaggggaaaggattgaggaaggaccaagcttatagttggatagaggtgcagagagaaaaacacatgttcgtcgccgatgacacatctcaccatgaggcgaatgaaatatatgagatgctggacaagctttttcatcacgtgctcggggtaatgttgaggacaagcatggcaattttgttttgtgctgaaagatacatcctctggaatgaaacaattgctttagcattgcaagaacaaggccattggtctcaggcatgagggatgaagcccactgatttgccttcagcatccttggtatggcagattggtggtgtgtttcaaggatgctgcaaaggagcgtcagagtccaaaatgtggttattgtgtttctttgagattgcaatcacaaataaactcgtacgattttgattcgtttggaacttggcatcctgaaggatcaatttttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4030 - DNA, 766 bp, Oryza sativa
  unsure (1)..(766): unsure at all n locations
tcgggnnnntttgattgcatgtctnaacnnnnnnnnnnnnnnnnnnnnnnnnnnnnnnnnnnnnnnnnnnnnnnnnnnnnnnnnnnnnncaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgtttggtctcgctttggttggcaggttacggccaagttcggtaagagtgagagttttacagtcaagtaaggcgtggcaagcaacgttaagctgttgagtcgttttaagtgtaattccgggcacnaattggtaaagagagtcctgttaaaa

SEQ ID NO: 4031 - DNA, 1062 bp, Oryza sativa
  unsure (1)..(1062): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccagggccgtgttaatttgaagaagcccgatcataagttctttgtcatggagactgatgactatggctgcaacaatggcctcccgccggttgctcagaagacggtattctttggccgcgaggttggagcggcggataggcatctcctgccgacatatcagctgaagagcaggaagtatattggcccgaccgcaatggatgctgaaatggcatttcttatggcgaatcaagggctggcgcgccccgggaagctcgtatatgacccttttgttgggactgggagtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4032 - DNA, 1417 bp, Oryza sativa
  unsure (1)..(1417): unsure at all n locations
ctaggttacccctgtttagcccccccctttaaaaattttttgaaccccccccaaaaaacccggggtggagaaaaacctgttaaacatgtgccttctccccagtggcaaataatgggttgtcctaccggtgtgtggtctccaaagcaataagtttccgaattaaggccccagcgttcgggcttaaacgggtgggtttggtgacacacaaccccaagtttggaaccgaaccctcctttccccgaatttaaaattacctccaagcggtaaactattaaaaaaagcgcccccgtttccccaaaggaaaaaaaagccggccagggtttcccggtaaccgccaaggttcggaaacaaaaaaagcccccaaaggaagcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaaaagttgtgaatattaaaacatagtatattaatatacgcgtgtgaagaatccctgtatcaccattaaagtttaaatataaaagtagattttcttttaaaaaggaaggggtcgtcccataagatttcataaccctcaagcatatccaaaattagaatcacatttatttgaattttttagttacatattaatcaaatctngctttntnctctctgtgtttccggggttcctggtttgtngggggtgccgnnttcctcnngtctnnnnngcgtnngtcttaggcattgtcaacaaactcggngggggggngggngggnnagannnaataaatattatagtgaaaggntagggagagagaaagtnggaaacaccctcagatcctatcnaataaacaggtatggtgg

SEQ ID NO: 4033 - DNA, 937 bp, Oryza sativa
  unsure (1)..(937): unsure at all n locations
cgagggtcacgtgcgcgtacctcatctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttggttcacatgtttgcaaggaggctttggacaaaggatttactgttgctagtcttaataggtatttctgtaagctgtatctgttgacatgttcattctcattttgttgtcagactgtttgattttgagatatatttttttatttttttttgtaactagccaaaatcataaataaactattgctacagaggctgtatgtctattgaaacttaaacacgtttttgccctgatatctgatatggaagagcaatggatactctgaatcctctaatctaactgtagataactttatatggttctcttaagtttgtgttgatgcctttagctttagaaaaaattcatgggagactctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 4034 - DNA, 845 bp, Oryza sativa
  unsure (1)..(845): unsure at all n locations
ttctgttccatnntannacatcgtgttcgatgctgtctttcgtcgtccctcgcacgantngtntcnnccaacnncnttctgctttttanttcttttttttctncccccnnncccccccccgggttgatgacatgcacatgcgcctcgcnncnnannnnnnnnnnnnnnnnnnnnnnnnnnnnnnnaaaaagaattatgtgcaacacatgaatcagccctactgccccccatcatttgatgcgatgatacaannnnnnnnnnnnnnnnnnnnnnnnnnnnnatcttgtaaacatctagaaatatataatctactatgtcctgttggtacttcaaaagagtaaaagagctcgacattgactctgaaaaaaacaaatgagcagaaatctcacctttctatgacttgctgcaggggaagaaattccatttctcaactgagtaccattgcatgttggtgctcttacagcctgatggtcatggacaaaagggtgacccaacaacgaagctgcagaaggcctctgtactggatcacgctttaagcacaaacttaggaaatctttcccttctttggaaaaacaatctggaatttctggtatatctttactgtttgcaattttaaatattgctgccacctgcaagaccaagaatctgacatgaggctcaccaactataaaagaagtatcaagagtcctccagttattttcactaaaagaggcagaatagcatctccaagtggaacaaagcattttggtaaatattaaacgaagtagcatacatcttcatacggataccagggatgcttcgcgggtgccatctcaataattgtacatccaaggctccatatttan

SEQ ID NO: 4035 - DNA, 729 bp, Oryza sativa
  unsure (1)..(729): unsure at all n locations
gcagagtttgatgacttgncgatcgcatgcatncaacgcgaggggaggtgatctcatccgagcctatctatttcatatccaacccttgtgggatgtatgatttgatcatcccaactctctagccttgtagcctcgaggtgatgtttgtgacttcaaaaacccaacccaacctcgttctgctgattagtttcgcagatgtgaacatgatgacgatgatctattgatctagtgtgtgttaaagtaacatttggttggtgttttgcaggacgcagtagttcttctgtctgaatgagcaagattgcactgcactgttcattggtcaatatcagatttgcaattaccatcagattgatcaagtgggagtaaaaaggtggctggcacaccttggatgcttactgctggtggtgaagaatgagaaagagaagggcatacgaggccacattctgccaatggcacctgagctatgcaaaatatgccgctcgtgggcaatgttaggcacacattttgcatcccgcattcctgcctcatcgaatagggcggaacggaagggatagaaatggttggatggatggataataccttgtggcagtcagtgttgatgctgcagcagcagcagccttcctccacttccgccaccggcgccacaagaaaaaaagacgacgacagacgccgacgccgacgcgtgcggcaccagccgacgatcgacgaggtgataccgagccttgtgcg

SEQ ID NO: 4036 - DNA, 723 bp, Oryza sativa
  unsure (1)..(723): unsure at all n locations
cgcgncttgaattgcaaaacctatnnnnnnnnnnnnnnnnnnnnnnnnnnnnnnnnnnnnnnnnnnnnnnnnnnnnnnnnnctaatgtgcattgccctcaagcacattatgaagcacattatgaagggctgtaacagcgcctactaatgtgcttgagggcaatgcatcaactacctgagtgggtaaagcctatttattgcgacaatcattgctcattcacctaccgttgctactaaataccacttttaacgctgtacattaaagaatcttgcgctagatcaagatccatgaatactggcaaacacttgcactgatgggcaatactatctgctgctgatatggtgtattaccggctccatcaagaaccatgcagactgctaggagcctatctgcacctcatataatgaggcaccttacaactcaatggtcgaggatcatgcaacgtctgactcaaaaaaccctatagtgacccaacttacaattcactgagcacatttttacatcgtcaggactggtaataccctagaggtacgcaactatatcgctttgcaacagatgcgcattttgactggtgaatggacacccaataggaccgcacatatcgcgcttcccaacaggtgcgcacgctcaatggggactgtacactcgctagagcggtacattacgctcctttggcgttgttgcctcncttaatcggcacgttacacttgtttacccgctaag

SEQ ID NO: 4037 - DNA, 783 bp, Oryza sativa
  unsure (1)..(783): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgtgacaaaagcaacagaattgaatatatatatatatatatatatatatatatatatatatatatatatatatatatatatatatatattactcatgcatgaagaatatgtaattgtcatgacaaatctgctgctgatctctgaaagctgtaataattaatttcagtatatatatgcatgtacaaactacatgccttcttattcctgctttaatgaagaaaataatatcgatgagattaactaaaaccagatggtttttacgagttaaaatttcaacaaaaaactttgaacgatatatagtctgtttcctgataagcgtccagggtgttgtctacaagatctaattaattaaaatagtgatgtcaaaagcaataatgtaacaaacgtggaaagaacggcagtgtcaagaaattagcagagaagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4038 - DNA, 29680 bp, Oryza sativa
  unsure (1)..(29680): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggaatagtagaagtctagaagacgaagacacatgactatatcttatggttcttgttatgtattatgacatgatgaactagtactatatcttatggctcttttcaaacaaaggaaatttaaataaattttataaagttgagaaaaccctatatatatgtctaatcggaacgaaggaatagtcattccaaattcctatgaaattccttatggttggctcgaatcatagggatattagagaacttttaacttgaggtccaatcttttagaaaatattctttgcatctatctatcttccaataattatattatgttttttctatatatgctccatttaagcagtcatttctgttgttttcttgttttttttcttttatctctctgtgtgtgtgattaatggtttcatgtttatacatgtagactagtagtagtgctagccaagtttaataatagagatgtctaccgcctttaattttatccctcatatctcctcatcgattcgatcaggaggtgtatatatatatataaaacatgtgtactaccttcatcttaagagattttgcccatatatatatctacataagcaaaatcttttgtatttagagacaaaggtagtacaatatatctcatccataatacacaaactctaatgttatttatttgtttactatcacactagtatttgcactttttaaattatgtagaggctgctttttatactgagagattgttcgttctctctctcctcacttaccccacactcatcaccaaatgcaacataacactgttaaaagacaacacttgagtcttataagcacgatcttgagttttattatacttgctcttatgtacgtactccttctaattccataattatcatgtttgactagaactttaacaattttaaatatttagcttaaaaaaacactggaacatagattagttttaaaaagtactttaataaaattaaatatctacttatatttttatatattataattgaaaatatatttggacaaactctgatagcggtacgtaagctcagggatccatttgattggattggtcaatctttttctagctaccaggccaattggtatgcacactctatatccatgcatgctgatagatcatgtcatgcactggcaaatagtgtaagtgatgtacatgaaaagaatagatcgactagctagttttctgtcgtcgcttgtggagaaaaaaaaaacaaacaattaacagtcgcaaacctatcactttggagaatcccatatatgtgtgctactatcagaggtcgtttcgtttgacagctctagcttaattagttaccccgaatacaaagattgaacaattaacaagtttagattggttgtatttttgcttgattttgccatgtgttaattaacactgtaaacattctggtatatatatgtggggtatcagttaacaacactcttgacattagatatatatatgcacttctttccatgtgattagttcataacacaaaacgatcaacacagtacgtaccctcatgttacgacatataattaggactaaatttgtttgcatatatgtatacacaatggttagaaccatcagtaacccaagttcagttgacaaattaattagactgtataccgatatataccatatccattaaaaataatttgaattaaatagttgttagttttcattgagttgcctagctatgtttgaccaacaatatttttaagaaatctagttagtatttagcatcaaagttataccattagatttgtaataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatatatatatatatatatatatatatatatatatatatatatatatattactcatgcatgaagaatatgtaattgtcatgacaaatctgctgctgatctctgaaagctgtaataattaatttcagtatatatatgcatgtacaaactacatgccttcttattcctgctttaatgaagaaaataatatcgatgagattaactaaaaccagatggtttttacgagttaaaatttcaacaaaaaactttgaacgatatatagtctgtttcctgataagcgtccagggtgttgtctacaagatctaattaattaaaatagtgatgtcaaaagcaataatgtaacaaacgtggaaagaacggcagtgtcaagaaattagcagagaagatacttggaagtccactgagcttgtagaaaaagatggagaaagatgcagttttatgagaagatccaaccagaagcaataatgtagatatggttatctatatgtataacaactacacatcaaatcatgcgagaacagggtaagttttccacgagtgctttcacacatgcatgcaaaacctgtcctactttagtttttttttcccaagaaaatctgctatttatctctggtcatccagtccaaaagagagaaaacacccctctctgccgagtctcttccatacggtcttaaattaactgaataagattgctgacttcaagagtgaaaaaaaaaactatatatgcttatatatatatagccgtgtgcctatcggtgtaaattaaccattttcattataaaaaatgggtcgagtgaaagatagaagagaacacgacataagtgctaaacaatatttcaaattaagcgcactatggagctataattaataacatcatatacagagagctctatttaagaagctgggacatttttttcctgggaattaaagaacattccctagaagaacatattacattactcatctagaagaaaatgaatcaaagcgccgaacaatcaaaagcattttgtagaatcagagaaagcaaaagacaaagacaaaactgttgtaggattgaaagaattttacacagtacacacactagcgaattctatataaaccaaagacaaaactgttttaagattgaaagagccgatgatgagaaaaaatatacacatctatcactgttgtgtatatggagtatatccaagaaaaaagagctgaccgaaaatccgaaattggaaagccatgacctcaatctcaactcctcaactgaacaactcaattagaagcacgataaactagaattttatgtttattatgataaattttatactaattaaacacgccaaaatgaagaacgtaacttaccggcaaatcaattagggaaatttcagaagaaaaaagaaaccctgatcgatcgacaaagagccctaacaatagtacgatattccaagaaccgacagagagatcatcacccagatcgagatttaattgcaagcaaattaaacagaaataactgcgagcgagcgaaggagacgccggcgaggaagagagaagcatatatgtgttggtgtgtgtataactgtatatacatgcatacctggtgctggcgaattggaagagcttgccggtggcggagaagacgacgagcccgacctcggcgtcgcagaggatggagagctcctcggccttcttgaacagccccctcctccgcttcgagaaggtcacctgcctcgccgccaggttgtcgatcctccgtattgctatcctctccctcttccccgtcgccgccctcccctccccctccccccttcccccgccaccgccgccgccagccatatcagatcacacaccaattcaccaccgccgccgcaaaatcggggaggatcgatcagacgaaacaaccaaaaccctagccgctaaccgcaccagccaaaccagccgcgagatacgcggcgccgcagatctatggctgcggcggcggccactcccgctactactactacttatggaagaaaaaggcagggaggaagggagcaatggagaccaccaccaatggaagcgaagcgaaggaggcgagagagaaagagaggaaacaggagcagggaggtagggctagcctatagcactgcagcaggggtaggggtaggggtaggagtaggacgactcctactttttatggcaaaggctttcaagtggtggagccacagggacggaggcaggtgtccgccacgaggtggttaggactcaggccccgtctagatctcaacttaaaaattttcaccatatcatatcgaacgtttgaacatctctataaagttttaaatataggtttagaaaaaaatttaattgtacatattacgactaatttgtgaaacgaaaattttaagcctaattgctctatgatttgataatgtgatactacagtaaacatttgctaatgatggattaattaggtttaataaattcatctcgcggtttattgacggattatgtaattagtttctttattagagcccgaacaacccatacaacaccataatacaatatccgatgtgacacgctaaaactttacaactgtatatctaaacatcccctggggacgcagggactagtgtaccctccctccacgccattgcccctgcaacttttgacattttgaaaagtcacatagttctgggttcaagagccttcggaactatttcgaagagcttaaaattttaagaattaaggggtgtttaggtgaggctaaaactttttagtccatgtcatatcggatgtttgacgctaatttagagtattaaatatagactaataaaaaaaactaatttcataaataagagctaatatgcgagacgaattttttaagcctaattaatccataattatgaaaagtttactgtagcatcacattgtcaaatcatggcgtaattagactcaaaagattcgtctcgcgaattagtccaaggttatggaatgggttttataattacagtatgtttaatactctaaattagtatccaaacattcgatgtgacagagacttggaataagtctctgtttcccaaacaccctcctcacttcgttaaaaaaaatcaatcacatcaaataggtttaactaagttagtggtttttttttttacagatggagtaattatactctttctattaaaagaaaatctatatgttcagattcatccgtagagttgaattcttttttgacatatggagtactccctgattcgtccaaaaaaaaagacaatttaggaggagatgtggatctaggagggttgttcagattcgttgtactactagaaggagatgtggctctaggttgctttttttttttgacggagggagcatttgatagtcatcttctgataatctaaaaaactaggtttcacaccttatacttctagtttgttttttagactctgacttcaacttcttagaatctggacgaaaagcttaattgtttgggaaacttgttactccatccacctcaaaatataagcatttttggaccctgacacggttttcgagatgctactttgccaacaatatctataaaagtaagatgatttaaataaaaagagttacatactatgatagtctgtttgatgataaatccagtaacatcattttttttcatgattgatcttttttctattaatggttaaagtttaaaatgtttgggttatcactgtactaaaaatacttatattttagaaaaggggagtattttagaagaaactgcagttgtcccactccataggatgtgtttagtttctaaaaaaagttggaagtttgggaaaagttgaaaatttatgtgtgtagaaaagttttgaatgtgatgtgatgtgatggaaacttgaaagtttggggtagttggggatgaactaaacacagcctatggcatgtttgtagattctgaaaaacaaaagatgagatgagctgaaaataaatagcttctggcttctggattttagttgtacttttgtatattcctcgactacaacattttagttgacagttgttaaagggcctagagatatattacagaattctccaaattctaaaaagtaacgagtgagaacctagaagaaatcgtagctgtcagaggctcctcaaattaaacagatcctttgacagctacagtcactactacgtaactcattttgccatacggggatatccatttttccgtgcggtcatttgacccgcctgcacaccgctgtctgtgaaaatcagtattttcgcgtgcggacggaaggaccgcttgggataatcgattatcccgtgcggtcatactataccacccacacggaataaaaaaaaccaaaaaaaaagaaaaatcgtcgcccgcccgccggcctgcaagcgaaccggccgccgcaactcgtcgtcgacatcgtcgcgcccgccgccgaccctcaccgccgtgagggacggccgccgccgccggatccgggcgtgtgggggccggttgccgtcggccctcgccgccgccgcctcgccgcacccgcccggtcgtcgcctcgcgaaagtagggagaggagagccctccctcctcgtcgtcgtcatcgtcgtcattgtggtcgccggcgccgctcccgcctcgtcgtcgtcgccctcgagcggggaagggcaggagaggaacgctgccgtcggatccgggcagggacagccgcgggccgcccgtcgttgcccgccctcccgcccaccggatccaccgcccgcgcgctcccgtcgccactggggaggggaggagccgcggccgccggtcatcgccctcccgtccgcgggatccaccgcccgcgcgctcccgtcgccgccggggaggggaggagccgcggctcctcgcccgtcatcgcccgcccgcgcgccggagttgctgctggggaggggaggggaggagctgcgggccgcccatcccgtctacgccagccgccgcctccccacgtccgcccgccgccgccgagctcaccgccgtcccgcctgtgggttgtggagaaggaggcaactgaagaagaaggtgagagaaagagggaggaaaatgagtggaggagaaggaaggtgagaagataagggagagagaggagagaaggggccgcggggagagagaggaaaattttgaataggatgggagggacgactatttttctgtgcgggtggattaggaggcccgcacgcgaaaatagggttattttcacgtgtgggcctgttaagtcacctgcacacaaaaattgattttcgtgtgcgggcgacgctcccaccatttttccgtgcagtctgacttacggaccgcatggaaataaaatggggtggtgtccaggataatcaatcctgtagtagtgagtttcttctgaaatgttcggtcctaaaaaatataagctaccgaaaactccgtaatctacaaaatgagctactgaagaataaaagtaactcccttcgtcctataataaaatttaggagtaagtttcattcatttatcttaaaataagtttatttttaataatcattacatcaaaattcatgaaaattaaaaaatatatcggaagcagataaagtactggaaaatgactgtattaggatttaataaatatggtattctgttttaagctttatactccctccgtcccaaaatataacaatttttagccatcaggatttgtctcaaaatataacaacttctgcaccaacattctctttccaaccaatcacaaccctcaaccacttacttctacctactttcttaataaccgtgtccagccctaaaatttcttaggacctgtttggttggtgaaataaaaatttttaggtgtcacattggatgtttgaccggatgttggaagtggttttcggacacgaataaaaatactaatttcgtaactcgtctggagaccgcgagacgaatcttttgagcctaattaagccgtcattagtacacgtgggttactgtagcacttttatgcctaatcatggactaattagtcttaaaagattcgtctcgagatttacatgcaaactgtgcaattagtttttctttttatctatatttaatgctacatacatgtgtctaaagatttgatgtgatgtttttaggaactcaatagccccttatattctaggacggagggagtattgatatatgtagaaaattaaatttattttaggatggagggattaaaagaatcaactcttaggctgtgtttagttcacactgaagtttggaagtttggttgaaattggtacgatgtgatagaacagtagttgtgtgtgtatgaaaggtttgatgtgatggaaagttagaagtttggaaaaagaaaactttggaactattaggcccgtttagtttcccaaattttttttctaaaaacatcacatcgaatctttggacacatgcataaagtattaaatatagataaatgaaaaaactaattgcacagttagggaggaattcgtgagatgaatcttttgagtttaattagtccataattagccataagtgctacagtaacccacaagtggtaatgacagattaattaggcttaaaagattcgtctcgcggtttccaggcgagttataaaattagtttttttattcgtgtccgaaaactccttctgacatccggtcaaatgccctaaacatagccatgagagaggagagaggacttctgacatccggtcaaatgccctaaacatagccatgagagaggagagaggacttctgacatccggtcaaatgccctaaacatagccatgagagaggagagaggaggggaagggggggtggaagaggggtacgttggcatcagtcggtccatcgtccgtccatttctttctatgacggcaaagcctcctgctatcgttcagaaattgatgagcttttgtagagtagctaggggtaggagtatcctattttgagctctcgccgaagaaactgttttgggtggtttttctcgggaggatggaggaaggaatcgaggaacagggaggtcaggagggacaacgtactgaccgatggattgatgcgtggacgatgcagtagctaggcggtgtgatgaggtgttgccgtgttggagcctggaagacgggttggtggagtgttgcaaacaaatttaggagtaggtggttcgttcaggtcaccgtttatcaataaatattatcgtcacgtttatttaagttgaaatgattaaattcttaatcacatgttagcaaggctaacatgatcttgatacacgttttatgttactaataacgcgtgagatccaatttattgaaagatactctcgctactaactgcgaccacaaccaaacaactgctaataaaattaaactcacctaattttaggggtggtaaattgtgacctggtaaccaagcacccacctgttatatagcaggccaaatgggtggcttaacctaacacgccacatcacctatatcggaccgtgccatgtcggcccacatgtcaagaccacagtctaaggtggtgccgtatcgtgctagggcgacgcggttactgttacagtcaatggaccggtgaaaaataaaagaaaaatgtggagatgcaaccacactatataaggaaggaaggatatatatgattcaattttgctatatatttgtcgacaaattttcttccaaaaatttaacagatgtaattacagtacaatcgcagtgtaattatactgtaacttgtatgtaattacactgtaactataatataacttgtatgtaactttcaaaaatctctccgtaacatgttatttcggtaaaatcgaggtcgtgggaacaaatcctttcatatacgtgtgtactgtgatctttttgttcgtcactagaacaaatcttgtaatagatctaatgattcaaaattacgtgaaagttatatacaagttatactgtagttacatgcaagttacagtgtaattacattgcgattgtactataattatatctatcaaatttttaaaagaaaatttgtcgataaatatataggtggttcctgtatgattaacatggatcaacactaaaattagtatagttataagattgcatagcttacggtgggttgcgacttacgaatgatactcagcatataccagagagaatcacactagagagctgataaaattaatctcgcgctttcgttaacgatcgccccttcgatctgagattgtctccggaggaattgatgctcctatcgtgtccttacaagatgaaggtaaatcgatcgaatattgatcggtcgtacgtgtgccgccgtggttttatggtgtttaatcgacggcgccgtacttagcttactagctagctctaattacgtacctacgctgtctccctcaccgggcactacgactcacttcccacttccccctcagccttgatctcgatatttgattgtgccgtcaactccaacatcaccttgatcgaacgatttcccacaactcaacttcttcgagatcaccatgattgaacgatctccgagctgcttcacaactccactcgatctagactatgctcgtgagatcagattgagctaaatccctgataaacatgtcataaacacacatctagtgatgattggacgacactttcttaataatgaaaacattcgctgaaattctctaccgatcaagcatcatttttcgtataaataatatatatgttcttgatttttttagtcaaatagaaattttgttttttctattcacttttaaacaccatatttctatcgtaatactccctccgtttcgaaatgtttgacaccgttgactttttagcacatgtttaaccgttcgtcttattcaaaaacttctgtgagatatgtaaaattatatgcctacataaaaatatatttaacaatgaatcaaatgataggaaaagaattaataattacttaaattttttgaataagacgaacggtcaaacatatgataaaaagtcaatggcgtcaaatattttgtaacagaggaagtaataaattgctaatatgatcaattgttcgactgaccgaaaatcgtttcgaacaaatgctaccgttctcgacgttttggaccacttctccctacacattctcctatccggggcccagtgatgcaaacacaaacaaaacccaagtcgcagaggttacacggcccaacagaaagcccacctatcctctccccacggcccagtccgcgtccgactccgcgtcgcctctcgcctcctctctctcttcttcttctcccccaaatcccaattgcttattctccttcgacaagccggccaccgtccatcgctgcttcgcttgctcccacccgaagcaacgcgaacgcgacgcgctcccctccccgccacctcggggcggtgagaccaggcctccgcgaccctcgccggccgtccctgagcgccgcccgcaccggcaactcggtttcgaggctgatctcggcaggtttgtgtctgccctcgatccaaaaccggtgctgtggtttgtttcacgatcccgttaaagttgtcgaatccgttcggcgattgtgattcaggtagaggaattagttttgcaagacaggttttacaaggaattttttgggggggagtgggggacacgtttttatgctgttgttctgatgacttcttgaaagtcacacccaagttagttagttatcagcagctcatggtaatcttcagtgatggattaaccgctctacggtatctaggcaatttgagagtagaagcaagccgtagcctacagaacattttgccatccaaatgcttggcattttgatttgattacgcaggcagtaattttggagtagaaaacgcgtcctaccgaacatgagacttatcacaagtatatcgttttttgacaatagtcaataggaactctgcgttgaggggtttgatttcaatttgttctagatttgatccattcttcttccttttatttttctgatgcaaccaacaattagtctggcattggcgttagcgattaccatctactagttattttccgttagaatctatatgcatgtacagcttattgattaccaccaactgttggaacatatgtaacctgctatttctttttatgcagattgctctagtacaatgagctggagatttcctctttttgggtatgttatttttactgaaagcaatacttttttcgtttgttcttcttatgtctgttcctaacctttcctcgcatagcatttgtattctataaactgagcttcctcttttatttggtagaaagtattgtatttgttgatcagtgccagccagcaggcttgatgtgattcgtaatccttagtttctttctatactaaaaagccttcagatattgatgctcaaaaaattgctttgcttttgttccaaaagtttattttatcatccgaacagtgtccaccactcagctactctgttatttcttatggttgggtcttcagttacgctgaatttaatttttagcataagtaaattaacgtggctatttaatatgattcacttattgccttaagctttcctgaaaaacgagctcctctggcttactgtctttgtttctgctgaatgcttgccagcagcaactcgcagcagcagcaacctgatccaaatttccaggacaaccctacgcaaccttggtaccctcagtctgtagttggttcatcttcacatccatccacaccaagctcttccaatgttggtccacatcaaagagcttctgataattcccagtcttcatcgcgtgctcaaccatctccagctgaggctgcagggataattgctcggttaaaggacaaaaggtcagcagctaacctttttttgataagttgcttgtagcttcctgtatacgaagtttcattgtattatgccttatcttatctatactgtgggttaaaattgcaacagccttgttactttttaccatggtattttacatattctagtgtttatattagtactaaaagagagtcactagaatctaactaataatattagagtaatgaatttttaattgcaataatgatatcatggctgatattctatattctatcaattggtaatgaatgaagaatccctagcttttcagagggcacgacaatttgtgcaattcagaagggatgtatataaatgctaaaagaagtgattatgtatggttgggttgctttttataatcgccacctttactacatgtgtttttcacactattccttgtgagcatgcttgtttggaatgcaaaactgctgtatataatactgtccttttttctgcagtgttgatgagttgcagaggctgttgaaagacaaagaggcatataatgctttcttcaattcactcgatcaagttaaaacccagaacaacgtaagttttgttgctgagtacacaggtgtttgaaatttgtattggtggctgtacttagatgtttctgtatttcctccagtagttaaagatacacaggaaactccaaactatatgctccaattatttttctttttctttttctggcctcatatttgaggctttgggctgtggcacatctcctgtgatttgggcattaatgtgggtgattattctttaatttatattcggtgctgcttttaaccttagatagttgacttgtctgaatgctagacctcttgtcaatttgctcacttcttgttctttcttaatgttcagttacgcgatgagcttagaaaggagacagtgcaacttgcaagtgagttattcgtgtttctgttatcggcatgcaatgcttttttattggattgtcttaactatgaaaaagatataaacaacttgttagttactactgtttctaaatcaaatatggttggatcttctgaacttacaggagaaaatttggaaaaagagcaacggatcttggagctcaggaatcaggtttagtactgtgacctccatctcagaaactataagctactgtagccatgatgttcattgttaaacgaactttaaatacagttaatgctataataatggattttgtctgcgtttcaattttttttcctgagattcaaatcgcatttattattgtgcagtgcaccattataagaactacagaactagctgctgctcaagataggttggctgagttggaaaggcaaaaggatgagattatgaggtcatattctcctgctgcactgctcgacaagctccaaagtaagggttctgaacagctgcatctgcatcatttttgctgtgtattttaataagagtctgtgctttattatttgtagttgaatacattatgtgaattagtgcaccgaatcatgggcatgttttgtatgtatctattgtttgctatgaatgcactacccttctgtaaccggccaatgatcaggctaggactggtactagcgtcatagtggcgtctatgttagttccatttcgtgaaaccttgatttatgcttctgtcattgtttgaagtccaaccatgtaatttaatttttcaaacacccaaccgcaaccgctgacattttcatgaattgcttcggtgcttgctcagaatcgatggcaaagttggacgaggagtcggaggagctgcaccagaagttcctggagaaggacattgacctcccaacctttgttcagaagtacaaaaagctccgcgccgcctaccacaagcaggcgttgctccatctcgccggcaagacctcacttcgctgaaatccatcggccgtctgtaggacgaacaccctgttgtatgagtttcccatttctccatcattctattctgtcgtggtgtctgtccacttggctgtttatcagtgccgcttaatattgtagggcttgtgaaaacgtcagggtttgattgcatttgtagatatacgattgtattcgcatcatggaattttatgtatgatcatttggctggtgccaacgccagtgaagcattttgacctgtcagagacacggaaacaaatataaatcttgtgttcaaatctgagcacgaaccaggattgtgccttgtgcaaatcttgtacgtacaaaactgctccatgctccatatagtcatatcaggcattcctttttgcttatttcaaaaaaaaaaaaagctaggattgattgaatttgagagttcctgaatgaaaaaaaaaagaagaaaacgattggcttttccaacccatttgccgcaagctcaaagcatcataacctatgggttcagaacccatttgcactgcagatgaagtggcaggaaattcagatgagctgtactacatctggataaaactgcatcctcccatgagcttttgcacgggattggatctgatccctgcgaccgcatggacgcatgcaagcgaggctcgcacgtagaacaaaactgcattattagccgtggattagaacgatccaaggcgagctttgtctgcaactctgcgtgcatcgctaattcgccgcaacccgcaaggaacaaggtgcccgtgaacctgctccctttggaagcatagggaaccaactgtactccctctgtttcgtattacaagtcatttaaatttgttctaaatcaaacgtctttcaaattaactaaaattttaaaaattgtataagcattttcagcaagaaacaaacttacttaaaaaatgttattcaattataggtttataattgatgagataatttggtactatagatattctacttttttttctacaaatatagttgatatttaacataggacaaacctgaaataacttgtaatataaaatggagtagcaaactgacgtacagttggcctcccgaagattagcagatatgtgttagattaatatatggagtatagatttgttctgtttgtgttaggaggaaacaggggagggttttgggcttactctcaccgacaattcgatcacgagatagatgcattaatagatgtaggaagatctgtctatgttccttatccttgcttctcctgctaattaatttgctgataagtggctaaaccttgtacatagccatggccgggaacgatgcttgccacggatggacgacgatcttcgtgctgaatttcagtagcgtcctgcaccgttgactgctggtttgttcgtttggctggctggcttgttgatgttgcctgcttgcaaggcacttttgaaggtacaatttgcgtttgtcagctgtgctctcttctgccaggacgataggagagttttcggacaactgcttgttctagaattttaatttctcctaagcagttctcacataaatgctagttaccactgattcgccaaaaaaaattatgggtagttttatatatatatatatatatatatatatatatatatatatatatatatatatagggcaccatggtatctaatgtacaaaatcactcaaatttttcaaaattttcaaattgtgagtatatacctagttataataattcgattcatatctatacctatcaacaaaacaactcaaatttaactttatttcacaatccatgattacatacctaactaattatatgtatggatgctatatacctagaatcaaaatctaacaaaaacaagttcaaattcagtacaaacatgctttgaactagttagtaaagtagttaatgttaatacctaagtaattgaaaaagtttcatactcatttgaattgggtatatactcaatttcaacaatggtgcccgggcaccatggagcaccaaacaaatttaatatatatatatatatatatatatatatatatatatatatattcttaataaatttaaagtcaactttgaaaaataaactacaactacaatgaaaaagaaaatcaaaatgaactctaagattaatttttaggtggcagcggctaataagttataggacaaacgatggaagcctctaagatacttgagttgtaaaatctaaaaaaaaaagtaaagaaaaaaaagctaagtgtatttttagattctcatcaattagcaagtcaatacttcctttgttacaatataaatatacctagtgcgagatgtgttatatcttacgactataaatctgatcaagcaactatttagatttagatttatagttctacaaatacaaatctggacaaataactatatgcagattcgtaatcgtaggatatctcaagttctatcgcagatgcatttatattgagaagaaggttacttagccatctgcgcgctgagtacagcaatgcacgggccatccgctcgcggctgcgtagtacactttttacgtgcgcacgcaatgcatgccgagctggatggaagggatgggacgtgatgccgctggctgctcgtgaagaaggaacagacgagcagtagaatccaacccccaaagaaaggaggccgcggaatcacgcgtggaggaacggggatttgtacacatttggatctgtaggcgtcacagcacaatagattcaccgagaaaatatccatagtccacatcaatatttccctagctagttaatagtgaggaagcaaatacatgtactgaaagaaaataaaaggagattaattgtgaggaagcaaatacatgtactgaaagagagaaaaaaaaaagagatttggagggatgtgaaattgtgagagggctagggattgaacataaaacctcagagttgaaaccacacgccgactactattacactatcaagtgcatctcaattacatatactacaggatgagagtcagagagtcggacatggcagacatgcatatgttactttgtaggaggaataggcatgtaggttacgttttatatcttgagaagcagcggacgagaatatgaagaaattggaaaaccaacttctaatttcttataaattttctgaattatacaaagttatccttttaattatgtaactaatacagctataaaaaatatggataaaaaagctaaaagctcctcctaaaaaaagccttaaatatctttctaagatacccctctataggaagtgtggttatcaacacgtacaagcatgcgttactcaccaatggatcgtggtccttgaacaaatcattcggatcacatgtttctgcagactgcagaaaataccaggatgcgagcatctacgttgatgttatttgtacacatccaagttaataattaaacaagttaacctgatcgccggtcacagccaatgacccagagaataatgcaaattaacagtaattattaacagacactcaacggttgttgattggttgataactaagctaagacacacctggtgattcgtcgacagggtgtgatgatccttgtccttgttgacccgtgaagaagctgtctcaggacgtgtcaggaatcaaggatttcgtcaggttttacctgcagtggccggacaaaaactttgacaggatgtggtacaatattcttgcccatctttgtgacttttggtcgcactcctaggcgtgtttaacttccttaatctgtcttcctcgctgtctcagcttaactaagtaattaaaagggtcaatttggttctgtgcatctcactccactacaattttgcatgtgataagccagtattttgcttctccataattaatcattgttcttgtgacaatttttgtctagtgagagattcttatcccaaataatctttctactccaagggagaagcagaacattgttcaaaaatcaagaccttatcataatttatttactaccaccatgagatgatgattgaggtaaatagtaaagcatcgaactgtacggcggtggagttgtgagggcataataccaacgaccaaagttcacattctttgagcatgtgttaggttagtcaaaagatgccaagatggtgtccgtatgtgcttggtcaaacggttaattaaactataaccttcgaaaaacaattaaacttaagaaacaactatatgtctataagagtataagcaagttaatcctaaagacttatttctttttcaaattaacgtgttctgtaaaaatcatcggcgatactattaactcaaattaatatataaatggtcctaaaagcttaaggcccctttaaatcgcatgattgagaaaatgtaataatagaaaaaacacaaaaatttgatatgaatgtaagagtaaaatagatgattgcaaaacataagaaaaacacagtaatgaccgtttgattggaccgcagaaaaaacgcaggaattagaggagagataaaaactcaaaggacgatttccatgaggtagaacctcgtgttagatttcctccaaaatttacgtggcattagacattctataggaattttataggattccaaaagatttcactcatttgattcaaatggctatataggaaaaatttctacagggatgaaatcctctaaaatttttatgaattttttttgaatcaaaggagaccttaataatgatgaacttattagcttatggtatctctctttttcgtgagcacgttttttcaagccaataaataatctgtttttacagaaactatttacgaaagttcattgtcaaaaaataaatatatttcaaaatttttaaaatacccattcgtctctaaaaacaaaaacaagtccaattctaactacgaacctagatactacttatgttagagattttatttttcttttggacagagtactagagtagtacttaatgatttgaatgtgcgctattagcccgtcatgttgtccgtgccgccgtaattaagctcaaaccattcaatcgatcggcgccaaagactacaggatcaacagccagaaaccctatataaacccagctcgctcagtcacaatcctcactcccctcagtgacactctcttagcaagcaagctagcttagccaggagagctccattgccatggcggccaccaccaccatccctctcctcctcctcctcctggccgccaccgtcgccgccgccgccgccgagctctccgtgtaccacaacgtgcacccctcgtcgccgtccccgctcgagtccatcatcgcgctcgcccgcgacgacgacgcccgccttctcttcctctcctccaaggcagccaccgccggcgtctcctccgcccccgtcgccttcggccaggcccccccgtcctacgtcgtccgggccggcctcggctcgccgtcgcagcagctgctgctggcgctcgacaccagcgccgacgcgacgtgggcgcactgctcgccgtgcggcacgtgcccgagcagcagcctcttcgccccggccaactcctcctcctacgcctccctcccgtgctcctcgtcgtggtgcccgctgttccagggccaggcgtgcccggcgccgcagggcggcggcgacgcggcgccgccgccggcgacgctgccgacgtgcgccttctccaagccgttcgccgacgcgtcgttccaggcggcgctcgccagcgacacgctgaggctgggcaaggacgccatcccgaactacacgttcgggtgcgtgagctcggtgacggggccgacgacgaacatgccaaggcaagggctgctcggcctcgggcgtggccccatggcgctgctctcccaggccgggagcttgtacaatggcgtcttctcctactgcctcccgagctacaggtcatactacttctccggctcgctccggctgggcgccggcggcgggcagccgaggagcgtccggtacacgccgatgctgaggaacccgcacaggtcgtctctctactacgtgaacgtgacggggctcagcgtggggcacgcgtgggtgaaggtccccgcgggatcgttcgcgttcgacgccgccaccggcgccggcacggtggtggactccggcacggtgatcacgcggtggacggcgccggtgtacgcggcgctgcgggaggagttccggcggcaggtagcggcgccgagcgggtacacgtcgctgggcgcgttcgacacgtgcttcaacaccgacgaggtggccgccggcggagcccccgcggtgacggtgcacatggacggcggcgtggacctggcgctgccgatggagaacacgctcatccacagcagcgccacgccgctggcctgcctcgccatggccgaggcgccgcagaacgtcaactccgtcgtcaacgtcatcgccaacctgcagcagcagaacatccgggtcgtcttcgacgtcgccaactcccgcgtcggcttcgccaaggagtcctgcaactaattaagaattaagattaattaagatgatctaccgctatctcatctagagccaagctgctgctagcaaatgcacgagaacggcttgtgcagtctatgtattctcttcttttccctttctgaaatcacggtgtcctcttgtgggcttgtagctttccgatctgtgcaataaggtatacgtgacatcaaaacttggtcacgggcgcctgtctcatctgtatgtgccaatagggctatatctaggtgattacgtacgtactcagggttttaccagtgtgaattggtatgtttacatcgatcttaaagatcttcatcatttgcatcgctagaaaaacttcatatgagaataccaaatcaagggcagcaattcacaagtatgagtactgaatcgattttttatgtgagcagaattatagacccaagttactcatcagaactcacaagatggcaaccacacatatattccttgcagcaaatgtcactgtgatacataggccaaacagagaacatccgatcagttacttcatgttgttggatatttttgagctgcgggtctgcagcgcgcgtatacaacagggtgaatgccagatcagtttgccttggtgctgttcttgatccactccaggtacttggtgttaccaccagttatgggaagagcgataacttcaggaacactgcatgaacaagttaccagtaaatctgacaggaacatttttctcccgggccggccgaaagaataggccaaccaaattacattaagatttcagggagaaaagttacaagtaaactatagtaaacagacagattgtacagcaagatcaataaactgaatgaagcttactcgtattcatggttagctttgacatgttcagtcaaggcatctagaagagattctctagtcttgattatgagtaactcttcagcatcagtttgcacctgcaagaaggcagattattgatcactaaatcctaggtctgctaaggagcaggaaatacatcatccgaaggaatgataaaccactgaattacaaagatgagaactattaataatctattcagtctataggtaaatttccacaacgcacctttccctcccaccaataaacagattcaatgcctgaaaaatgtacagaacttcagtataattcagtataaacgataatatgaaacaagctaattgcgaatcttggcacagcacctgttgcctaacagcataaggaagggcagcgcaacaatcattggacaaccaaagcaccattatatttcgtgattcaacagagttcttgtttcagtccaaagtaaggtaagcaaagctttaaaagggtttgttcccacatatgatggattttcttgatctaattcgtttacactgccacctctactaaaccttttcagtgtttccattaaattttttgaaggtaataaagatgttttctatggaatacagagggccaataacactgacatatgatctgggttcataggcatatagtgtcagagaaacggaagtgatgagcaaagtgacaaaccaggcactatattgacacaagcagctagtttctcactgatgatgctctgtgacagcttcttccctgcagtagatgtgaaacatgatgcttttaaagactgcttaaacaaaaggcagaaatagatgctaaaattaattaacaaaaaaataaacgctaaacaacaatattgaaaggagaaacatgatgctcacaagacaaatagtgcaagatcaatctcaactctaactgctttatcttggaggaaatgaaatatattgcctagcaagttccacaaatgaaatgcgcacacaatataacaagaacaaaaacacagtaaagtactacctgcttccctgtttggaacagtcacatacacaacaatggatggcacggtggtggaagcggactccatccgagcagagctgagacctcttaccctgagaaattttgcattcagatatcactacaagaagatagaattcaaactagataaaagcgtagcaatgttaacctccaaagttcacacatccatcaatgtcataacatggataaactacactcttgtaccatacttcagcgattcaattttttagcagccgcatgttcggacgtgcctagcaatttcgcgggttccacacaaaatctaagagcaaagaggaaagagaaggttacccgaggaaggggaagcggcggcgggagaaggcgcaccccgtcctgcaggcgacggcggcggcgctggcggcgccgatgcttaggaacagaacgccccggtgagcgacgagcggcccccctctccggcggtggcgcggcgcggtgcggcggaggccgcggcggcggcgggagcgagaggtcggaacggcgcggggaggagtggcatttttcccgacgagcggtttatgtacacgtcagcattttgcttccttccttcctccctcgcgaagacgcgaacccgatgctttgctcttgggccgggccttcctctggtgggcccacatgggctaggctcgcatcgagttcgcttttgttctctcgcgtgatacttaaccctctcgcttcgcttggaacacctccaaaaccctacttccgcctccgcctccgtctccgcggattcttcgagctcccggccatggctgaacccgaggtggtggttgccgcaggtggggaggcgatggaagccgaggcggcggagccggctgcggcgaatccgagtcagaagagggagagggaggagggggatgactccgccgccggcgctgctggcgaggaggcggcggagggagctgcggccaagaagcagaaggtggagggggagggggaggcgaagggagcggaggatgaggcgaagggggaggaagaggagggcgcgaaggaagaggaggcgaagccggtgaagctgggacccaaggagttcgccacgggcgtcgagatgttcgactacttcttcgccctgctccactcgtgggcgccgcagctcgagatcaacaaggtgagggttgcgattcggttgtcaatcgtggccggcctctcgctgtttttggccgcgaaaaaaagtttcttgctttattgatgactcgcgaagtcacgatgtgtgttgttgtagctaaactttggtatgataaaagttttatccttgtagctgtagtgataagctggtaggttatttaattagctttagtggtgtataatggtgcccgtattaggtagtactttgcctttgaaaccggtgatccaatcggctaaataattcgacatgataatctgagtgttcgccttgtatttagccaagtttgcatgaaactccatagagcccccagattcgttgagttgatctgtcactgtcaaggatgtttttaagcttggagaggctgctttatgcatttcgtatgtatggtaggtacttctaaaccaatgatctttgttgggttgagttcgttagcaccagtgattggcacttaaacattatccttctttcacctagcatttctttaggttctcatgggcaagtttcatttacagaatagcatatggcgttgaatactccgtagagcccccagtttcattgggttgatctgtcatggtcaaggatgttattaagcttggagaggttgctttaggcatttcgtatgtatattaggtacttctagaccaatgattttacttctaaaccaatgatctttgtgaatggacatgttgggttgagttcagtagtaccagtgatttagtgcttaaacagtataattctttcacttagcttttcttttaggttctcatggtaagtttcatttacggaatagcatatgacgtttaatactctttcagctgcactgccttcatatgttgggactccatatgagttcttccatgtagtgtttgacgaactgggactgggttctttacttaaggatggttgtaccacaaggagaacagactctatttggggcttcaggcatgtttgtttaacttgaagtgttatgttatgacttgcaatttaaatctggttagcttgcgacctccaaatggtcctttggtgtttcgcaacattttctgttaaaattgagttagaccataagtagcaatttttttctctatcaaagaaaattgttggtttattcctacctgtttttagcaagtatgcaacagtagaggtaaaagagatcactttgttttctgtcatacatgaacaaggtctctaggtggtttgctaatcactcttataagaaaattgtattggattaaggctgcaattatgatatgttgcacataaattgaactgtctgacacatatatgagttacaaagaaatacactatgattcttcatctacatgtgatcaaaataatcgcatacttgagccttgcatcttttacttcatcgttgtttggaattggaagataaaactatttgtcagtgggatgtttatgttaccacaataagctcatctctagttgcccttgagaaaaataagctcattgctggaagtgactatagtttcacagtaatcaattgtggtgacttccagatgcctatgtgcttgtgtactgtactttgtctggttcaaactatccagatgtcactttactttttgcattgtcattgctactgtcacacttgagtttgctgaatcgcttaacttttgcagtatgagcatatggtgttggaagacctgctgaagaaaggccatgctgagtccgataggaaaattggagcaggaattgaagcatttgagatccgcaaccacccggtgtttcagagccgctgtttcttcgttcgacgagttgatggatcctctgatgatttcagcttccgtaagtgcgttgacagcatacttcctctcccggaggacatgaagattggcaataagtccaatggcaagaagggtggtggccacttcaagggcggtggaggtaggggaggaggacgaggtggtggccgaggtggcgggcgtggtttccgcggtcggggtaggagaggcaactaaaggactcaataaaaccccgaaattttttgcatgcctaataccaatccttaagattgaggcattcatggcaacatgtgcttgtttgtctgccttctcctagagggactgatgctccactcacttgtgtactgtgaaagtgcaactatgataagatctcgccgatctgtcttcccatatcttcaccgcattctgtttgagcgatttgtctacttgtcttcacatggcatattttgttttgtttggttttgacatctcattttctgtgtgatgatcatattgatccggcttttgtgataaaaccagaacatagtctgtgaccgctgaccggtcaccggtcagttacagtattttctgggaagatcgggaattcagttgtggtctgaaaccacgggaaccgcatgcccagaccaccggtgtaaaaacgatgtcagtgtgctcgaacaaactagtgagttgtgatggtcatttggtcaacttgcaaatcgcgagataagtgcacaccaatgttgtttttgggcactgctgctgggcacagacgaggaccacggcgaattggttgtgtgagttcatgcgatctggcacgctccaatacggccaggaagtatacatgatacattgatactagtagtagcaatgtaagtgcagctcagctcgctcctgtaggctgtagtcctatgtgagttgtgactgaactgaactccacggcaggaagcatattcccgccatcatctccggtggttgacggccttttttgtcgatgattactctataataaagccatctcccggttgggcgagcatcaatggcgaagtagtgagggtccagtgaccactttctcctgtgggatagagctgaaacaaaggaaacatcactttctcctctgggagtaatacatatccggtccaatgcactagcagtctagcagcagcagcactaccgctgtccggttgttgcttgcttgctcgtcagctactactactagcttagctagttgcagtgctggattcttgacggtagctttactactactttacggtatcagcaatggcccatttgaatcaaaaatcctacgaaggaatttcgtaggatttaaatcctatatgaattttcctaataatcatttgattcaaaagattgaggttttccaaatcctatgaaactcctatggaatggttcattgtacatagattttagagaaaacttactggttcatcgtatatagattttagaggaaacttaccaagagctacaatctcttgaaaaatttccttttgagtttacctttctcatctaattcctgtatttttcttgcggtccgatcaaacggtcatttatatatttttcctacgttttgtaattttctgtatacttgtacttctgtttttcatgtctcttgtttttcttaatcatgctattcaaacgagcctaagtgagtagtaaggggaggaggagcttttcatccgggaggctggagctgcttttctgggatgcagcacgttgcacggggcgcgcggaggcgagaatatgcgtgtgcgggatgatgtctcccggacatgtgtgcgggtgcgtggtgcgtggataaggaaattcaccatctgcctgcctacctgcacgctgtgttggtcgcgtgttccgccggccgagagcaccatcggacgatgccggctcgctatcgccgattcgctgggaagcggtgccgctgctctgctctgggggcgcacggcgggtgctgttctgtcgatcgtgtgtttttgtggctctaccgtgtgtgtctcttgggtcttttttgggcccagcggccttatttagagagacatcaactaatgagacatggagaaaggtccaaaaataaataaattggcatgtgaggtagtatcagatttaagatatatcacgtcttatacgtgatttgttcattttagaaccaagagaaataaattgagtagagttttactattggtcaaatttggagtatgattttggactatataaaaatgtaaggctttataaatgtagcttgtcttgcttatattaggacagttttttctcctctttctcaatctttacttacttacttgtttttcgcatacacgattttaaaattgttaaatggtgtgtttttttaaaaaaatatattaaaatattactttaaataatcatattaatcaaaatttaagtaactaatacttaatagcataagaaaaactaataataaaaaaattcaaataaaatagacggtcaaacgctaaaaataaaaattcacaacaacacttaacatgtaacggatgaactatgttcttattcatcactctgttttacgtgtaatgtaacggggaaaaggttcatagcccttgatgtccaatacagccctaaaaacttttccaaacaaagttacgttttagtcatccaactgatcatccattaagaatggataaaacatatactacctccatcctaaaatatttgacgctgttgacttttttaaaaatgtttgaccgttcgtcttattcaaaaaaattaagtaattgttaattctttttctatcatttgatttattgttaaatatatttttatgtatacatatagttttacacatattacaaaagtttttgaataagacgaacggtcaaacatatttaaaaaagtcaacgtcgtcaaacatctagggaaggagggagtatatgtgtcgtatggtttgtgttcaaggggtgaagagtgtcgtgcaaccgtgatttctctatggtaatttaacttactgcgagtgatttcccttttggtcctgtcaaagtttacaattggtaatactagttggtactattgtgcttgaacttataaacggaaaaggggatccaacccaaacaacaaaacacaaatagaaaataaaaaatactccaaaatccaaactaaaaacgggaaaaatagaaaaggaaaacttatacgatttctgcgccctcctcttcggcgtcttcgctactctccgccttcgagccccaaaggaccccccccctccccgccggcggcgccgcttgccgcgggggacgatgtacaagctcggcggccgtggcggttggacgcggcggacggggccgagccgctaagcgacctgcagcccctcaaggccggggacgtggggctggcccctctatccgtggaatgccccttccccacagaagcctccgcgctcccgttttcagctgtcgggcgaccctgttcactttcctgcgtctgcttgattgtccgtcacccccttttgggaattcctcctaatatgcctcctagcccccagtccacgcaacatttcttccccctataaccgggtccntcttcccgcgttttttctcaagaataccgccccctaagtggctttcaaaaaattttactctcccattccacgggggcggaaaccccgcgggtgatttttagatttccaggggtgttcccaacgaaaactcccttgggggctttctttgtcgcacactgcggcttctgcaaaaccgtatgcttttttt

SEQ ID NO: 4039 - DNA, 1768 bp, Oryza sativa
  unsure (1)..(1768): unsure at all n locations
aaagaaaacatgaaggaggtcccccccgttcgtgcgcctgtgcaaccacttcttcttaggcgtcatcgcagacgtcggcgcagccgcccggccggaagaattcgttcagcctgaagtccagtggcccgccggccttcgcggcaatcataaggctgacccctgacctcgtcgacaagatccggcgtgccgaggaatcgggcagcggcgctcgcatcaagttcaaccctaacatgtacaactcctcggagaacgtgagcttccctcccctccctccctccatctcactccgtcgtcaagttctgtccccgcgagtttcttctgaagttaaaacctaactgatttctaaattttgcttgttatggcatatgtgtcttaagttcataactcgagattattttcatctggaataccagtttttggttttcctgtaacatcgttcctgagtttaggttagttcactgtgtaatttgcatttatatttgctcaattttactgcctggtgcttgagatgctctgaatcgttttggcatgatgctgtgttatcccaaatgttgttaggatcgttaaatacttaaatttcacttgtgatgttctatggtactctcttgagtgtgagctcgtccattgcttattctggtcctgtcgatatgccattcattttaccttcaagttttgtataggattgttcaaatccagcccctgcctgttcattattgagtgattttataaattggcagttcatgttttagtttggttttacttgggcacatgtctccttggcttgatgggaataaaccgtatgatttcttttggtatatgcaccaatggcaaggagttttgtttgtgtattttgcatttctttggtcagatcactgtgagcaaatcattatttgaggcttccactatttggctaggatgaatttggatattttatgctgtttatggttgctcaaagttctttgggaatgatgatccatgcggaagtattaattttgtggaattgcattgttgggccctacttttgtaaccgttagctgctaggaatggcatataaagctcatgtacatcttttatctatggtctttgattgttttttgggtatatcaaattattattttttgtttaatttctaatgagcagttatatatatttcttttcttcaaaaccatttacttggttttgtactaaagaagcgtagaatcacccaactatgtatttggctccagtagggttcactaatctcaaataggaactccaaaactccaaatctcctttcctgtcaagaccctttgtgttcctaactttcttgttcacatgacatgttactccagtgaaactgtagctttacgtctcatcactgacatttatggatcctagttcaactgttttgctttgttttctaaaaaaaaaatccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccg

SEQ ID NO: 4040 - DNA, 760 bp, Oryza sativa
  unsure (1)..(760): unsure at all n locations
gcgtgnaagtagagccctgtnnnnnnnnnnnnnnnnnnnnnnnnnnnnnnnnnnnnnnnctctatcggcggcatgcccgcgcccccccgcggtcgcggcgccgcttgtgttttcgccgacgaagtggttaaggttgcaaaagtaaaaacttgggatccggaagagtccaacagggttggaaacttatttgcgtgtttccatagagctcctaaagcggttggggaatacatgggctttactttgttctggggtaaataggtatccgattaaaaattcaaacaagtttccggtgtgaaagaataatggggaaatctgggggtgcaaaatgcgtacctaaatcaaattaagttaattcggcttaatttcctgttttcaatgatgaaaactaatggggcaggttactttaagaaatggccaaaccgcaagcttgaggagcattgtttattgaaggtttttacatttctcacataatgatttttttgccttggcggtctatttaagtggacccctaaataactttattaaatgggggtatacggtttctcataaacttttagggtatacccaggttggacattttgatccataagctgaatgaaggtcacttcctttaaaaaagagcttttacatggttatttaaaatattttcaccccattatggaggcttgaaaaataattacttttaacaataaggttgaaacccccaaaggccaatataatgtccctggattctcgttaaaaaacgattgggcttatattt

SEQ ID NO: 4041 - DNA, 750 bp, Oryza sativa
  unsure (1)..(750): unsure at all n locations
nnnnnnnnnnnnnnnnnnnnnnnnnnnnnnnnnnnnnnnnnnnnnnnnnnnnnnnnnnnnntctgtgaaaatcagtatttttgcgtgggcgacgaaggaccgcttgggataatcgcattatccggggggtcatactataccaccccacacggaataaaaaaaacccaaaaaaaagaaaaatngtnngcccgcccgccggccttgaagggaaccgggcggccgaaattgtcgttgacattgttgggcccgccgccgaccttaacgccgtgagggacggcccgcgccgccggaatcgggggtgtgggggccgcctgcccgccgccctccccgccgccgcctcgnggccccgcccccccccccccctccgaaccctcggcgcgcccagcccccccccccccccccccctccgcccccctccccccccccccccccccccccccccccccccccccccccccccccccccccccctcccccccccccccccctcccccccccctccccccccccccccccccccccctccccccccccccccccccccccccccccccccctccccccccccccccccccccccccccccccctccccccccccccccccccccccccccccccccccccccccccccccccccccccccccccccccccccccccccccccccnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4042 - DNA, 732 bp, Oryza sativa
  unsure (1)..(732): unsure at all n locations
nagcggtnnnattangatctgctcctcacctcnnnnnnnnnnnnnnnnnnnnnnnnnnnnnnnnnnatatatatataaaacatgtgtactaccttcatcttaagagattttgcccatatatatatctacataagcaaaatcttttgtatttagagacaaaggtagtacaatatatctcatccataatacacaaacagattgtacagcaagatcaataaactgaatgaagcttactcgtattcatggttagctttgacatgttcagtcaaggcatctagaagagattctctagtcttgattatgagtaactcttcagcatcagtttgcacctgcaagaaggcagattattgatcactaaatcctaggtctgctaaggagcaggaaatacatcatccgaaggaatgataaaccactgaattacaaagatgagaactattaataatctattcagtctataggtaaatttccacaacgcacctttccctcccaccaataaacagattcaatgcctgaaaaatgtacagaacttcagtataattcagtataaacgataatatgaaacaagctaattgcgaatcttggcacagcacctgttgcctaacagcataaggaagggcagcgcaacaatcattggacaaccaaagcaccattatatttcgtgattcaacagagttcttggttcagtccaaagtaagggtaagcaaaagcttaaaagggtttgtttccacatat

SEQ ID NO: 4043 - DNA, 827 bp, Oryza sativa
  unsure (1)..(827): unsure at all n locations
ggcgttgtaatcatacaacnnnnnnnnnnnnnnnnnnnnnnnnnnnnnnnnnnnnnnnnnnnnnnnnnnnnnnnnnnnnnncattttgtagaatcagagaaagcaaaagacaaagacaaaactgttgtaggattgaaagaattttacacagtacacacactagcgaattctatataaaccaaagacaaaactgttttaagattgaaagagccgatgatgagaaaaaatatacacatctatcactgttgtgtatatggagtatatccaagaaaaaagagctgaccgaaaatccgaaattggaaagccatgacctcaatctcaactcctcaactgaacaactcaattagaagcacgataaactagaattttatgtttattatgataaattttatactaattaaacacgccaaaatgaagaacgtaacttaccggcaaatcaattagggaaatttcagaagaaaaaagaaaccctgatcgatcgacaaagagccctaacaatagtacgatattccaagaaccgacagagagatcatcacccagatcgagatttaattgcaagcaaattaaacagaaataactgcgagcgagcgaaggagacgccggcgaggaagagagaagcatatatgtgttggtgtgtgtataactgtatatacatgcatacttggtgctggcgaatttgaagagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnag

SEQ ID NO: 4044 - DNA, 780 bp, Oryza sativa
  unsure (1)..(780): unsure at all n locations
nggccggggaaaggggaaaggggnaggaaagccgcccacggnaaagagnnaagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctgaaatttccctaattgatttgccggtaagttacgttcttcattttggcgtgtttaattagtataaaatttatcataataaacataaaattctagtttatcgtgcttctaattgagttgttcagttgaggagttgagattgaggtcatggctttccaatttcggattttcggtcagctcttttttcttggatatactccatatacacaacagtgatagatgtgtatattttttctcatcatcggctctttcaatcttaaaacagtttgtctttggttatatagattcgctagtggtgtctgtgtaaaatctttcatcctacacagtnnntgcttgctttggtttcttgat

SEQ ID NO: 4045 - DNA, 980 bp, Oryza sativa
  unsure (1)..(980): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtctgcgtttcaattttttttcctgagattcaaatcgcatttattattgtgcagtgcaccattataagaactacagaactagctgctgctcaagataggttggctgagttggaaaggcaaaaagatgagattatgaggtcatattctcctgctgcactgctcgacaagctccaaagtaagggttttgaacagctgcatctgcatcatttttgctgtgtattttaataagagtctgtgctttattatttgtagttgaatacattatgtgaattagtgcaccgaatcatgggcatgttttgtatgtatctattgtttgctatgaatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttt

SEQ ID NO: 4046 - DNA, 717 bp, Oryza sativa
  unsure (1)..(717): unsure at all n locations
cggtgcattgaaattcctatgtctnnnnnnnnnnnnnnnnnnnnnnnnnnnnnnnnnnnnnnnnnnnnnnnnnnnnnactgttgggcaactgccataattaaatgtatttgaattctcaagtaggcatgcattcttaactatgcataacaccataaacagagtccatttaacatcatttaaattctagtaaaagaatagtaatataatattagttgagaaacataccgaggttgaagtcttcagcaactccctaatagccattgtagcataggaggatgctggtagagtaaatgctaattttatggccaatttccttgctaacatatctgagctaccgacagacttttcctctactaagccagtttcactacctggcatagagctatccaatggtcctgccaccttggaatcatgtgattgagcatttgaaatcgcgctagatatagtctcatttacttccttggcttttgtaggtttgtttctggacagaacatccaaatcagtttctgctaaagatgctgtgtcatctgtataagtcatgagttccctacagtcacaccaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnan

SEQ ID NO: 4047 - DNA, 714 bp, Oryza sativa
  unsure (1)..(714): unsure at all n locations
ccgtgcaatgaanatcaaatgtctnnnnnnnnnnnnnnnnnnnnnnnnnnnnnnnnnnnnnnnnnnnnnnnnnnnnnacttgataatttgttatagatccctggtccttagttctaacgttgtgcactcttacttagaggacctcttaagaaaacaatattctatatgaagaagcgaaaaaacggaaaattgaaccgcgctctgaaaactagaagtttaggggttgattttgcaaccctcacccctttccccaaaccctagccgccaccattcctctgcctcctctcctctcgctccgctctctttcctgcccaagcgacggccgccgccgggtgccgtcccctcatgctcttcttcccgcagttggcgaccttccccgcgcactccctactgagagctgttgctgtcgccgcgccgtcgtcctgccatagccatcctctcgctcccgcgccgcatccgccaacgaggaggccgggactgtcggatccggtgactccggcctcctcgccggcagatccggccgccctgaagtgaggggaagccaggagccgccttctactcttctacctctatgcccggcactgcccctatgtccctctccctatacctctccatactgttcatttccggatcagcggatgcctgcgattaggcggccacggacgtgcgtgtgggacgtctaggagacggggaatcactggatcccagtaggcg

SEQ ID NO: 4048 - DNA, 1523 bp, Oryza sativa
  unsure (1)..(1523): unsure at all n locations
ggcgccttgaattcgtaaccnnnnnnnnnnnnnnnnnnnnnnnnnnnnnnnnnnnnnnnnnnnnnnnnnnnnnagatctttaggatttatgaacaagttattgttcacgttatcagatgaactttgtgtattctgagaactgagtgttctttcttgtttcaggcaaataatggcaacttctctgtcatggagggagggagtaggaaacaacctttctccaaagttccttctttgggtggtttgttggaactgttggatcagtgagcctataattcgagccaactatcttcgagtgagtacagttgacatgagcatcgaatgcgatctcgccttatctttcttttagtacctcgttgctgaccatcccctttgacagatacactgatgtatggacaatgctaggctcagtcagtagtcagtggttgggttgctgctttcttcaagtttcctgccgccctgatgctcgtcttgcacggagatattcagatttactgtgtattttggtgaatggtaaatcataatttgccctgtaatgttgttgctgtacatgtcagactagcctggattatttcactcaatttgtgctagtgagaaccacttgctacgtatggtagattgataataaagagattgtgctgagtccatgcatctaaaactcggatactttttttttttactgaaaacagttggagagacttctgctgcgctatattaatagatatataataaaactcagatacttctcccttgaattattagttcgtttctgcatatatttaagcttaaaccaaacatctaaactattaaaatatcttccatcagattgagttgtatgaattctcttaccaatgcaatcccaaatgtgattaatgaggaaaagtttttttttcctctttctgaataaacccgagttcatactgtacaaagttcagctgtattgggcgttcagtccagcaaccggattcaaaagtcctgcttaagatatcatctgatcttccgcaaccagtctcaccaagattatgtaactaattcatagtctttaatctcttcgttccaaaataaataaatttaatacttaattctttatttcaaaataaataaatctaatacgagatatgacaatcctatccttttgagtagctgaatgtgttgtaagatttggaggctgtgttcagacctttggttcttttttcttttgtttggattgccgctgaggctgaacctatgatcatttctagtaaaagaaatgggggttttgagtcttgctcaaaagaaaaaagatatgacacattctattatcatgaatctacagtaaccactaagaaaaacatcatgttaaacattaaggttccgttcttttctccaacaagagttggataaagattaagattttcgtggcacgcttttttaaactgttaaaaggtgtgtttcgtgcgaaaaactttttatataaaaattactctaaaatatcatattaatctatttttcaagttggataattaaaactcaataggcatacgcta

SEQ ID NO: 4049 - DNA, 1242 bp, Oryza sativa
ttataacaagatgtatgccggttgccacaatgcaaaaagtgaattctaagaatgcatactatctgcagaaatgctatgatagattgtccagaatagagctagcctaatactattgtgacaaataggacttgagtattttttcaagcttgcaaagcctcgggcagttgcttaatcatgggatcatagtgacatgtcgaacttttgtttacgaagtttgcaattggacaactctagattcctagagtttcttcggttcaagaacagaacccacacatcattgctatgatgctatctttttttaattgaaaactctgctatgtgaatttcatgacagtgttttggtttatctagcgatgaagtgcagaaatattattttcttgatgaactgtagtttctagaactcaaactcagatgtcatggtctaatgaaactttggtgtccatgtctaatagagtatcaaaagcagcgacgggaagagccccatagtggttggcccttggggtggcacaggaggatacccttgggatgatggtgtatactcaacggtacgccaggtcatcatcacccatggtgcagctattgactccataaggattgaatatgatctgaaaggaagttcagtctggtcagagacacatgggagcaccgatggaggttctgaaacagataaggtctagtttactatccctgctgcagcttttttaatttttttagcaagattgcaacactccgaaatttgcacaaatttaattggtactgtgcatgtctttagatctatataataaatataagagatttattacgttccttgaggagctaccacattttttagtgtaaattttggtagctcttggtggctcctatgtgttgagataccaggaaacagttgtacctcctcaagtaccataaaatcactacaagtataaacacctatatacaattctggtaaagttggaagatagttttaggccttagctttatgtatgaatctcatgtttattttggcgcataaaatcgatgacatgctgacttgtttttaatgaagttggtaaaagtttatatatcaaaggcctactttgatatccattctactttgaagaagcataatttagttttcatccctaaaacaaaattattgattttatatgtataatctgcaggtgaagctagatttccctgacgaaatccttgtgtctgtaagtggctattacgggtcagtctgtggaactccagttaggggta

SEQ ID NO: 4050 - DNA, 710 bp, Oryza sativa
  unsure (1)..(710): unsure at all n locations
cggtccttgtgatcgtnnnnnnnnnnnnnnnnnnnnnnnnnnnnnnnnnnnnnnnnnnnnnnnnnnnnnnnnnnagctttcttagtcggagacctggttttgaggaaaattcaaactacacgagatcggcataagctatctcccttatgggaaggaccattcataatttctgaagttactcggccagattcttatcgactcatgtgtgaagacggtactcatgttgacaactcttggaatattgagcatcttcgtcgtttttatgcttaggcattacttttgtatcttcctctttgactactaacatcaagttgttccttgagttaccagtcgggggctactataataataatggagtgtgatttttatcaattcaatttgcttacttgatttatcattggcttgtttgattttttagcttagccaatgaggactgaaagtttttaacaacttttgcgggttctaggctcaataaggtttgataaaaacttttaagaaatctagagctgagtttaaatcatcaagcacagcataaattcatcagtattgtacaaattgtgcctccatcatcatcatcattatcatcagaatacacaatcaatcagattcagttttttaatcattagagttatcagacccagtcggcttaagatcgttgtcctgtaacctctcaactacatcagcggctatctttgtcgcagctttntgcg

SEQ ID NO: 4051 - DNA, 1630 bp, Oryza sativa
  unsure (1)..(1630): unsure at all n locations
cgattgtctctatcgggggtctgttaaacattgctcaggctcggcaanntgtttccagtcgggggctcgtgctggcctctacatatcgggtgctggttgattatcactcgggcgaccttcggcggtcggcctggtttctgttgaaggactagtctccgcgccattcggctcagggtcttttccgaaaggatctatatcagatggcttcctgcaagtttgagatatgctatcagtactacttcaatagtgagtgactggcgatacaaaggaaattgctaaacgacttgtacctagatgatttcctgatttttggtatgggacgactggatgtcttcttctttggattggcttgccttggctgtttttcggtcacccctttgttgccggcatcatcaccttcatcatcgctcaggaccaatttcctcttacgggagtctgactggttagtcgatttcgaggtgtttggttgagtatcggaccgaattttttgtactccactcgcctgactagtctgccgacggggcgagcgatgttgagcaattggaggatccgacttcatcaaggcaaattcctgggcatgatattccaagctttcaattaactttgcagaagataaaagcatgcttttgagaagggctgagatgtttgatacatacccgcggaggagggttgaaggcgttgtatggcaccactggcaacaagtgcgaataactgaccacgatagcattcgagaagattttgtacattctctccttcatgactttaaactcaagagaatctagatcttcacggttagggtcatgcttgccgtcaaactcaaaggttgtgcgggatctctctttaattggcgctagtcggcttttaataaaatgccgggtgatctgctctccttgcagaccttgctctttgagcttcagcatgcgatcgatcagggcaagtgcttgggccacctcatctcccatgggaagcgagttccaggtgtcttgatatactggaggtagacaagaatactcgggaagcgctggctcgggattttgcacatagaaccaatttgcatgccaacccttattcgaagttttgaagggcatggaaaagtatttttggctcaaggttccccttagttggaaaccggctcccccgacaacacatggtttgctcttgtttggctgaggcttgaggaagaagatgcgacggaacagggaaaaatgcggtcttatacccaggaaagcctcgcaagcatggataaaattggcaatgtggactatggaattggggtttaggtgatgcaaactaatcccataaaattccaaaatcccccggaagaatcttgaggttggaagagaaaatcttccatagaagaaatgagaaaataccacgacctcatgtgtgtcaggggttggaaatgtttcgccgcacgccggacgccacccaatgatctcctttgccggaagaacgccgtgcgccaccatctccttcaagttttcctctgtcacatcagagggcacccactgactttcaaagctttctctctcctctgccatggatnnnnnnnnnnnnnnnnnnnnnnnnnnnnnnnnnnnnnnnnnnnnnnnnnnnnnagctgtattcgattcaatnnnnnncacactct

SEQ ID NO: 4052 - DNA, 713 bp, Oryza sativa
  unsure (1)..(713): unsure at all n locations
ccgtgncctgatanatcgtnnnnnnnnnnnnnnnnnnnnnnnnnnnnnnnnnnnnnnnnnnnnnnnnnnnnnnnnnnaataggaaagcgtgctcatcacctttcttcaaaataataaagatatctttgcgtggaaaccatctgatatgcctggtattcctagagaggtgattgagcactctttacatgttaaggaagatgctaaacctatcgagcaacgacttcgccatttcgcacaggataggaaggatgcgatcaaggaggaattgaccaagctgttagcagcaggcttcatcaaggaagtcctacatcctgactggctggccaatccagtcctggttcggaagaaaacggggcaatggcgcatgtgtgttgattacaccgacctcaataaatcttgtcccaaagatccctttgggttacctcgcattgaccaggtagttgattcaacggctggctgcgagttactcagttttttggattgctactcaggatatcatcagatccgactaaaggagtccgactgcttgaagacttcgttcatcacgcccttcggggcctactgctacatcgccatgccttttggattaaagaatgcaggagcacttatcaacgcatgatacagagatgcttttcaactcagaatggtcgcaacgtttgagcttatgttgatgatgtagntgtcaagaccaagcngaaggatgattttgttac

SEQ ID NO: 4053 - DNA, 742 bp, Oryza sativa
  unsure (1)..(742): unsure at all n locations
tggccgttgccccgcccgcccgcaccgcngtggttggccggccgtcaggtaggttcccaaagctatcaccagtgctatagtatacttcctgtgtccctaaatatttgacgtagttgattttttagcacatgtttaactatttatcttatccaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagctgccattgcccattgcgtgcaggggtggctcagctgagagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatggggta

SEQ ID NO: 4054 - DNA, 866 bp, Oryza sativa
  unsure (1)..(866): unsure at all n locations
cggtgcattatagattctcagctatgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgggttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttaggcagcctcttatagcctaaagtctttgagtgactagatgacatatcatgtaagttgctgataggtttcagtttttcgcgtctaggtctcgatattgtacttttcctcttactcgacttaaccagtacccacccagcttctcaaccggattataccatgcacctttaaaccaacatcacttgcaattgaacggtgggtgttactccgtagattgctcgcaagggccgnttgaaaatggtcattaagctttttttgacacatgctttgaagacggg

SEQ ID NO: 4055 - DNA, 754 bp, Oryza sativa
  unsure (1)..(754): unsure at all n locations
gtgtggtgtacttcggtagaatgctcgcaaggtcggctagaaattggtcatgagcttctttgaccattgctctgaaagcggaaacgctttctcataaagagtaccagaacgaccgtgtagtgcgactgaagctcgcaataccataagtcgtttttgctcacgaatatcagaccagtcaacaagtacaatgggcatcgtattgcccgaacagataaagctagcatgccaccggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcgggacagaattggtaaagagagtcgtgtaaaatatcgagttcgcacattttgttgtctgattattgatttttggcgaacccatttgatcatatgacaagatgtgtatccaccttaacttaatgattttgataaaaatcattaggggattcatcagnnnnnnnnnnnnnnnnnnnnnnnnnnnnnnnnnnnnnnnnnnnnnnnnnnnnnnnnnnatcgcataacaactaaatctaagtggataaccacatttcaaattaaattaaggggtattctctataaaaaaaggcgggtaatatatacttttcatgaaaatatgttactctttatttaggggta

SEQ ID NO: 4056 - DNA, 716 bp, Oryza sativa
  unsure (1)..(716): unsure at all n locations
cggcgccttgatagattgtannnnnnnnnnnnnnnnnnnnnnnnnnnnnnnnnnnnnnnnnnnnnnnnnnnnnnnnnnnacgaggtactttaattttatggtcctaaagtactatattttctagtgcaaacctaacctcataggttaattggaaattttggtaccttcaaattttgcacgaggcactttaatttttcattacaggcttgggactcaagcacatctaagttttacatggaccatgttgaaagttcttgtaattgcaaatcctgaagcagcgtagagaacaacttgctcgttggactcgagcaagatcactggatatatgttccctgtggtgatggttctaccggatacaatccgattgattgacaaaccgatcatcttattacaaggggcactgctttgctctctagcccaaattaaattaaatgaactgcatcccgcttgttcgtcatagccctcttctaattaaacaaatacaaacagcttaacacgagtcccttcggaagtaaattgaggctagagataaatagcattgtcctggcatcaatgtgaccagccgtatgaaatgctagcttttgtgaggtctgcgccaagttaggatcatcgcacaaaccaatcgaacccgctcttcactgaggcagatgagtggaacaagcaccatcgctacattgtcgtgcacccagaatgatcttgagccggacttgatgtgt

SEQ ID NO: 4057 - DNA, 1632 bp, Oryza sativa
  unsure (1)..(1632): unsure at all n locations
nggtatgtttgggaagttttgattcgattagctacagctanttctagatttaaaagtaccataaccatttaagcttttttgatggattaaaacgaagctaagctttccctaagaagactctctagttagctcctaaccagcgtgtcaacttcatttccacttcaataaaaaagaaaacattttcatttccacttgtttgatgttgcctcattttcagttttgcacagcacttgatttcaaagcatttcatgtgcattactgcattatactttcctgctgaattcaacattggatgcccgtcctgaagtggccgggaggtctcaaatcatgaacatgagatctgcagagatgcagacatgcagtgcagctaatctggtgaccacaacaaattcggagaaagtggaccacacaaatgacacaagtcttgaaaacaggtctccaattctccacggcaagcaaaagaatcagaaaatgtgaatttcatttgaatttactcataaatcgtcatgcattaagtatatgcctgcctgcctgagtacaaggaacggactcatccgcaggcttaaactgttccatatcccaaaatgttacagcctccaaagctcaaatcgaaaccagcccatctgttatctatatgactattggctaaactacatgtaattcaagtattcactttttgttcaaaaggaattcaagttttcatccatagctcaatcagaagaggtactttgatagcacgtacttgggagcaggcctcctgtctcccatccagtgctgcatatgcaccccaatggcgtccaggtgttgcccgctccggccatggaagcccacaaccttcccttccgtcttcgccgacgagaagtatgccccgaactcctctccgaatggcccgtacttccctcggttgctgatgaaggtgatcgacctcagaaccctgggcccttcctccctgttggtgttgtagtagccgtatacgcatgtcaggacctcgtgtgggtagtccagtttaatctgcaagtgcatttggagagaggttattgtttgacatgccaccgaagaatgatgaacagatcctatattgttgttgtatgtttcatgaattttattccttgacaacggaacttgattgataatagcactcagtactcaccctatgggttatgtggccactggttccatgccttgcagaccagacggattggtcacccctgtcgtactcgatctgtatcgagccgataaaggtgcctctcatcacatagacttgcttcacaccagtgtagacaccatcatcccatggccggcctccttcgccaccccatggccctggccccattggaactggttctttcaccatgctataaggaacctggaaaacggttacaagttagctctgcagccacatacttatgttatgattcagacaagaattgtagctacctcattgtatgtttcactccttgattgtgcaagcatgtcgtagcgcaaagaggggttcatctcaatcggtgatctactactaactcgcggggcaagcaagttacctttcttgacatggaccccgatgccatcaatgtaccatccttncctaccatggaatcctactatccttccatcagaaaaactggtggagaa

SEQ ID NO: 4058 - DNA, 1372 bp, Oryza sativa
  unsure (1)..(1372): unsure at all n locations
aggtgccgagaacaacgacgcccggaaaccagccactatcgcaagctggcagccgcataaacggttcaagagacctgaaagcacccagggaactcgattcgctgacctactggatccaattcacaattcacgcacatgaaaagaaaagaagtcttttcccaaccactgatattctccttttccggacctcccatgcctgactgactttgcatgattccctgcattaacgatgtagaattaaagaagcaatcgatatagaataaaacaagaaacatattttacaatatcaattctacatcagaaatgttattttcctcgttttttttcacgcgtgtctcattgtatgtctgtggatggaattggtccggcgtgaagagagattaaggggcaaggccgtggacaagaaatgcagaatctttagcagaaatacaataacttgcaggattcttgattcctcttatgagatgtgggcggtgatcgattgtcacttcactcggttcttgattttactaagtggccgcactaagaacataaaataaataaaagaaaaatggaaccaaagaatagatttgtttcccgaatccatagcatcgcaccatggcaaattggcaatgccatcaaatttactcttcctcccccattagcaaatcgcaaccacacctctatgccttctagcccgcaaacgctaaccatgcgaaaacgaatctggtgagtttttttttttttgttcctcacctttatgaactggaggacatttggacatcggcgcgggcgtcgccgcagcggaatcgcgcgctcgaaagcaaagcggcggtcgacggtgtgaaccgatcggagaggccgccacgccaccggtggcgtaaatccggcgccatagcccataggtttccccctcttgcggctgagcggcggcgccgacgactccatccgcggcgacgattttggggaggatggaaggggaagaagacgagccagtctactttacaggagggtcatttttgtaaaaaaagttactagtaggatctaagcagaaggggggctactttgtaaaatgtagggcaccagccattgtccgttgcgaattgtgatcgggtcagtatgggctatgctgtaatatttaggatcatacaggggggctactatgtaaatatatgggctattgtgcaaaagttagagttggtaggatccaagtaggggctattttgtaaaagttagggtccccgtcccgtcgccgccggtgagctccgccgactgaactcggcggagacgagcacctccannnnnnnnnnnnnnnnnnnnnnnnnnnnnnnnnnnnnnnnnnnnnnnnnnnnnnnnnnnnnnngttntacaaaatcagaaaacaaaagctcgg

SEQ ID NO: 4059 - DNA, 709 bp, Oryza sativa
  unsure (1)..(709): unsure at all n locations
gcgcgcatgnaattctcnttccnnnnnnnnnnnnnnnnnnnnnnnnnnnnnnnnnnnnnnnnnnnnnnnnnnnnntaaacggctaaactaatttcggtgctttctctcagggaccattttgaatattacgcgttattatttggacctacctgcaaatatctccttgtctttccgccatcagctttcccctcctaaacctctccccattccctcgcaaaaccctcgtctcctccacactctgctcttctcgcaaaccctaatcccacgcgcggccaccttccatggggcgctcgacctccctcaccgaggcggaggcggggatcacctgcttcgcctccttcctcccgggctttcgcggcgttctcaagcaccgctacttcgactttatcgttcacgaagtcgcccgcgacgganttcgtcgccgcctcaccttctttgatcttcccgacgaggtaagcttagccctctcgaccccgatttcgcgggttccttccgggatcccccgatttttttcattgcgctagctcagcttcgccgtgtatcgcaatgcgtggatgtgagtgaggaagacaaagggngcccgtccgcgaccggaccactcggaggcccttaagtcgtcctgcgctcttggcgatgcgaatgcgacccgttgaagggcttcctcagaagcgtccccgggcctgagctattatttcccgtattcttcgcg

SEQ ID NO: 4060 - DNA, 750 bp, Oryza sativa
  unsure (1)..(750): unsure at all n locations
ntcctttttaatgaagggacggtcaaagttaccaagtttacttcggaaccatgctgccagtgcaaagttgaaaaatatggtcagtgcacttcatccttctacagctatcagtttaagttgaatcatgatgcagtttgataattttttgatacgggctacccttgacctttttcttcaggcgtgttacctttggtagtttaatatggtgaacttctcttttcccattcctccttatgctaactggtgtacttgacaggcatttcgcaggctgtagaaggtgacttagtttatagcaaagagccccctcctggagaagcaacttcagttgatacttcagaaccttgcgatgaccaaataaattcatctgatattgatctatgttgtgagacacttccagaagaaacaatccagtctgtgaaggtctgtaatttgcagcaaacaatgcggtgtacatgctcatgcacaaaaagttcctaatcatgcactgtcatttctcgtgtagatagttgattctgaagatttattgaagggtgtctacacatttgaagatgttgtccttcctttgcctgggtatttaccattccacatccataacttcaattttcatactgaatcacattgagaaatatatatggtgtgcttatttctgtaaacatgcagttcgcaagcattatttcctggaaacggaannnnnnnnnnnnnnnnnnnnnnngntgtgtgcacangtgcnagtgactttcagttgagcag

SEQ ID NO: 4061 - DNA, 1393 bp, Oryza sativa
  unsure (1)..(1393): unsure at all n locations
cccatcaaaagaagaattgggctgcgattcacattgggctgtggggccaatcactccctccggggtgctcaacatgggaaaatagtcntaggcctcaagctctcccaccaatgtgaaaatagtctggtcacctacaagtttcttgtaaccctttcaaatctctgtttcgtgtatttagtggagagtcagaagctagacctcattttgagttttgatgtcagagaaccagagttcatctacttaaatacagggattgaattgtaactggttataaacatgtttttcaagatataagagaccatattggatcgaaactataagcattttctccacttgaacttctccggttaggcacttaagtaattaccaatgtacttttcaaaggaacatggcaggccaaacatagggctataggagtaaataaagaacccatagtttagcctaagcacatgcctatcatctaaatctaattgctttgacttcaaatgtgctgtttctgctaaaatatccattttgagctctgaagttgatccagtgaaaggtttgatcagataggaagaaaataaccagtcaatagaataaataattcaactcaaccaataagcacttcaaggagacagatccaacacaacattaaatgaggagagattctgtccatatatgatactcctacaaaaatatttgtacaaaaagaactccaaacaagagatcatacgagttgattaatagtacatccaagtcaagtaagaaaaacttgtgctgcagtaaagcaagaagatgctgcaagctaaagcaactaatacttggcataaaaaaaaggcagagattaggcaatgactgtgcattaaatattttgaactaccaagcatgtagctcaaggatgattaattacctagtggcctctaataccatgttcctgagctttcttttaggagcaccttctacagtcaaaacctgtgaaaatcaccactgtatcaatacgtaaaatatcagtggaggagagtttcataaggaagcaatagaggacaaagccataaggcaaaaggtcctaactcctttacctgggaaattatataggttgcatagttccaatggaatgagaagtagccaagtatacatttgtcgagttcctcgatgaactttacaatcagagtctcgggatcctggctgttttggaagaacgcgaatatgttttcttcgtaacccttgttcttcctcagataatcataggccagcgtacataggtgggggcattcatccacatggtcaaacccaatttgcctagctgaaaattgccacatatttgtgagnnnnnnnnnnnnnnnnnnnnnnnnnnnnnnnnnnnnnnnnnnnnnnnnnnnnnnnnnnnnnngttntacaaatcaaaacacct

SEQ ID NO: 4062 - DNA, 711 bp, Oryza sativa
  unsure (1)..(711): unsure at all n locations
ccgtgcatgagttctcacttgaacccgnccnnnnnnnnnnnnnnnnnnnnnnnnnnnnnnnnnnnnnnnnnnnnnnnnatagcagaggaaataatttgtcagacagtaagaaccgcatgacaccaaataggtaggtgaactctagtttctaaggcttgcattgtgatgctagtaaaattggcatctgctctaactggaactatctgcagagggaaaaatcagcgtaacaagggcataagcattatcagcttttctgaggaaggtgagggtattccctcgagttctactggtggttcggctcgttgtagttctagttgcggcacatctgcaaagttggaccaagataccgttctactcaccttgaaggataaactccgtaagctggggcaacgtctacatgaggtgatacatcttcttgaaaagttaactgcctttgttttgttgtgatatgtgaagtccagctgctctgttttggtcatatgcacgaccttccacggattatattatgagcattgtttttaaatgggatgagtgtcacatatgttgattgtatggaatatttgttttcgacccattacccttgtgcaattcatatttaaaatttattacaaaaggtaaacaatataagtatgtcttccatatttcatgcctatggctaatgactggagtctatgaatttaatctcaatttttcgtcagacaaacagctctt

SEQ ID NO: 4063 - DNA, 742 bp, Oryza sativa
  unsure (1)..(742): unsure at all n locations
cgatgaccactacattgtgtaagatcgtaaagagattttcccacctnaaaagctagcaatgagggtaaacacatgggtgtccttcagctgttcacagtccactaccatttccttaggtatacggatctcgcaggcaccccgggtccatcgggccttcacatactgtgtcccttggaccagagatattgaactagccagtctctgataccaattgaaggatcgtaaaaggtttttctcatcctaaaaactagccaatgagatgagaggtccccccacttatatattagagcaattttatgtaggatcgaatcacaataactaagccaaccagaggggggtgaatggttggtatacccaaaaaccgaaaacttttagcggaaataaaagttactctcgaattcgacggaagtcggtctgaccgagattgatatgccggtctgaccgctcggatgccgccggtctgaccgctcggatgccgccagtctgaccggtatagatcaaccggtctgaccgccgaagtcgcctgccgcacttgctacctccgccagtctgaccgccttgctcccgccggtctgaccgccgtcttgccgtcggtatatcgccggttggaccgccgaaactcagtgaaacacaaatcgaagaactcttaaagtgcatgacgactttattgattctatctgtgtttacaaagtgcaccaacagcactccttacaaaaatttcaactaaaggggtaccgaattc

SEQ ID NO: 4064 - DNA, 714 bp, Oryza sativa
  unsure (1)..(714): unsure at all n locations
agtgtgntttggnatgtananctgatatacnnnnnnnnnnnnnnnnnnnnnnnnnnnnnnnnnnnnnnnnnnnnnnnnnnnnnntgcatatgtcgacaatggctgtgaaagggcagtaccttggcccagagaggttgactgatatgcagtagttcctgaggttgtaccccgcccatgcttaccgatgatagcgttacggtaggtttgtggaatgtaagctggtgcagaaggggaaggatcatttcctgatcttcgagttgcttcactcattgagcgcgaaagcaatgtggaaacttgtacttgtgtagctggtacagttgatcttggggcagggaacacaggggcactcgaaggtcttgatgctgtgacagtaacttcagaaactgagggagatgcaacccttatggcagcagtctcttcttgagcttcagaattagaagtggtagaagtttgtggcaattctgaagaaagtgaagcagctttatcaacttggggtaatcttggagggactgggacaggtttatcaatttgaagtgatctcactgaaggaagggatgtatctttagcacttggtggtgatttggggggaactggacaagcttttcaattggggagattttggaggaacttggagtgcattacccactttgtgagattttgggaggaactggagcangtttataattngttggcgatcttgaaggagaagaacat

SEQ ID NO: 4065 - DNA, 1030 bp, Oryza sativa
  unsure (1)..(1030): unsure at all n locations
gggcggtnnntnnnnattgaatactactccnnnnnnnnnnnnnnnnnnnnnnnnnnnnnnnnnnnnnnnnnnnnnnnnnnnnnnnnnataaaactaaggtctataaagaatatgacctgtttcttctttgcacgcttatctttttcattagcaccacccccacgcttccccttcatctcatttccaagaagccatgcctcttcctcctcctctcgaattaactcttcttgtctcttcaaagcaacagcttcttggtacgcaacttcaattccactgacaaataaagagcacagtaggactattaggtagctaacaatttgtctaaaaatctattctgttttaagttagaaaaatgtatatgcattagcttaatgcaaaattcgtacacgcagctttctaaaatttcggtagtttgtctgttagagaagtcttcgaattttagaggtcaaataatttcattcaaatgcccaaggctcaacataaaccacccacaaagcctagggatcgactattggtactggccaacactacatcggtaaccaaaagaaaatcagcctaaataattctttttacctgaatatatgagatagcacaaatgtttcaagtatcttccgaccaagctcagttaggcgtctttcctcgcgctccatggaaattttgttaacctcaccagaagcaccatcctatgacagtgagaatagtaagacagactgcaaatccagtagaaaaacctctactctgcaataaaccgatcaccaaacaactatgcacagatacaatacaagaaactcacaacaaaaaatattcccaatataatatatctaggagcataaagatttatactgagattattaaacagggaaaaaaatcatgcttcaatcatcaaagccccccctaccttcatgcgactatgggaacatttgtcatcctttggagacacaggttgacaaggcagtggttctaaggctggggtaccgaattcctcaagtggnnggtggcanntgctcgtacntttcatnttcagtgcaca

SEQ ID NO: 4066 - DNA, 706 bp, Oryza sativa
  unsure (1)..(706): unsure at all n locations
acgtgaacccattaagagccctgacaaaacaccnnnnnnnnnnnnnnnnnnnnnnnnnnnnnntctagacatccgatgcctagtacttgggtcaattgctgaccagaaagcacaaaaactgaaaatccaataaagatctcatttcaataggcagtaattaaagaaaaaatactttgctttttattgcagcatattatattggaatagctgctagtcaaacctggaccatctcattttgtcctcaatcagcttgctaagtttatttcttcgttcctcaacaaaacggcggtatattgactcgatgtttgtcgtataaacacggagcaattctcttcgataagggcgatcgaggcaacgaaatggtttgtccaccttctcccttacatattaaatacagcagtatgatgttacatgatagtttgtagtcaattcatatcaacaagaaacagaagtaggcaaactatctaatgtatacaagtgatcttgctggtctgtatgagctacaaaacgctaggaaattagagcaaaaaaatgagaaactggaatagattaaataaattcccaccatgggaacatcacagtagaatcaaaaggaatgcaattgaataaagaaacaatgctttgagataaattggcagactacctgtagaaaattcaaaaatattggttccgcgattaggacatgaagcaataaagacagacatgc

SEQ ID NO: 4067 - DNA, 1597 bp, Oryza sativa
  unsure (1)..(1597): unsure at all n locations
ttgtgaagtagcgtgaaaagagatggtaaatgaatctggattccttgttgatagagcaaatattaattcaaaatttgagtttgtagaggaaagtcaagatgacacttgaaggcagcatggaaagagaagaaataatggattaacacatattaagcatggtattaggcgtacatgtcaatacttttccggtggacattccgttttgcctattggaatgaaacattttgcactggacccatggaccataccagtgtagattgattgattttaattaaaaatgtaccggcaggcatacagctatcttttttgtacatattggagtatacacaacatttatctagccatgactgtgtttgcaaacatattttggtgcgagttaaaaatagagaaacaagtacgaagctatgataaaggagcattacaagaaatcatgattgtctgcatatcacaattctctatattgcaggttgcctcctagctgtgtagtagttgttcacaagattaatacaagaactgcggttctgtgcaattagtaatgttggtttgcagcatgcgattctcctgctattcaggttgaagcacaggtacctaaatgcctagaagcgcaaattccagccagaatttaaatgcgaacatgaacagcataacagatgaaataggattattgactgtattatgttttttttcgaagaaacagaatgttccgggaattctggatgaaacaagattgtatatttaagtattgccctcgttaattatgttccgggaatggaggtagcaacgtatggggtaagtattgccctcattaattatttcttaaattgtctgcttctccggtcaacgcacacttgagtacagagtagctggattaaaattgtgaaatggagggtgctaaccagaagcaacttcagttgacaattcacggatttccataaatgacctgactggacgctatgcattaaggctacaaaaccgtctcatttatgagagcacacgtgtatactgtcttctggactctgaagctactctgcaacgaggaccatttccagtttctgatcgagatcttttgtgaagtctgggctggcagctgtaaggtagatgaccctaacacttgcaactgaacaagacgcatcatgcatacaggtgctacgtcaactaactactcgagaatttgtgctattttctccaagtccgaaccaatcatgttaagctcaaatggcgttgcaacgacacggaccaaataatttagtcattattaacacgcgtaacgcgaagcaagtgcatttactcaccaggatcatcgtcatcaccgtcagtgtcccaaaagggcggggacgtcgaagggctctcgctctccacctgctcgcaggaccgccactcggacaacgactcgccagacaggctacgatcctcgtccctcatcccagccgtgctcgcagcagaatcatcagttgctgcagcacaagccatccaggaaatcttccactgcttcaagcaaccttatccgcagctgcannnnnnnnnnnnnnnnnnnnnnnnnnnnnnnnnnnnnnnnnnnnnnnnnnnnnggccagagaatactcatttncaaagacag

SEQ ID NO: 4068 - DNA, 1587 bp, Oryza sativa
  unsure (1)..(1587): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagggaaaaaaccggaaatgagagtcggtcggtcggtagcgcggctatggacgatgacgggggtgacgaggaacgtgaggtttgcgttctttgctttgtggactttcttcccgctttccccttttcgttttacccgctgcactgcggctgtgcctgtgttgcatcgtgggatacatacatgggatcaatttggaaagctttaagattatgccgagtagttagtagtcaacttacgagaattcgtataggcggctgtgcctgtgtcgcgccgtgggatacgtacttgggacctgtttgggaagctttaagattctgccgagtagttagtggtcaacttacgagaattcgtataggatgggctttcgagcttctgacttctagttttatttttagcttctatagctatagattctcagaatctgaacgagaatatgtatcattggaggagttggagattctaggagaaactatagttgctagaagctctcctaaatagggcttgaaccagatgacggcggaggtgacgtgagattgtgagagggtatgtgagctgcttatcatgaaaaattctttgttttgtccttccatttttgtattgtgtttggcatgattttcaggtggaagcagatgcatctctcgtacacaagtcaagcggctacttgggctctgctgcatctatactaccaactgccattgatgtttgaaagaaagtgaaaagtcactagaaactaatactagtcgctcacaatcaatggcaccgctagcggcatcattgttttttgtatgtcaaggtagaggtgggttgtttttcattggcaactatgtgtacgtgattgtcataacaacctagtcctatattttattctatctattttctgtgtttatcaaaataatcacaatgttaggtttacatgaacactactccataatttcactattaagatgtgtatttttttagatgttgaacttagtccatgctaacactgataacagtttaatccatacatatgcagagagctagagatgttgcgtttctacatttcttcaatcacttgtaaataggtatgtgtcatgatagataattgaagtacaagcgccaaaaggattggtagcactgtgtgtctatcattacctatgtacttaaaaagattgtccattaatcctgtattatcaatgatatgttgaaacaaatgcttaggcaataattggtgtacaactagaaagtggtcatattccccaatagttatatgaaatatttattgggtatgaagtttgagcactggattggctttgtttgcgtctttgcctaattagtataatttataagtctcgntatccgataaactttagtttttcttctatttcaaaaaaataaataaactttgctttaagccaccaatatttctagatgaaaattgagaaccttcacttatatctacaatgacn

SEQ ID NO: 4069 - DNA, 1253 bp, Oryza sativa
  unsure (1)..(1253): unsure at all n locations
nctgaaagcgggacgcttttctcataaagagtaccagaccgacggtgtagtgcaactaacgctcccaataccataattcgtttttgctcacgaatatcagaccagtcaccaagtccaatgggcatggtattgcccgaacagataaagctagcatgccaccggtatacagcgagtcgctctttgtgaaggtgacgattacctaccaatcggtcgattcgttagatgtaatgttttgttctcgctttggtggccaggttccgcccaagttcggtaagagtgagagtttaccagtcaagtaatgcgtgccaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagnnnnnnnnnnnnnnnnnnnnnnnnnnnnnnnnnnnnnnnnnnnnnnnnnnnnnnnnnnatcgcataacaactaaatctaagtggataaccacattgaaattaaattaaggggtattctctataaaaaaaggcgggtaatatatacttttcatgaaaatatgttactctttattaggccaatattatgaaatttgccatttttatctatacgtagcaaagcacatacatttagctagtcttngaaaaaaaagagtaaattgcgcccgcggtacacaaacttgttaggtgggtgcattatagtgtaaaaacttcaaaactcttgttttggtgcacaaacttgtataggtgcgtgcggactatgactaaatagaatagcaaatctaattttgctgagttggatgatgagtagacccccaactaagcattcacgtaagaaggacaggtttgcctgctcgtaagcaatggccctattttatcagaaaaccccttctattgtttggtatttcgatcatgtataagttttctgtgaaacgaatctgagaggtgttcatagcggcggggagctggggaggtcgaatccgcggtggctgtagtgatgggggtcgagcccaacagctacgccgtgggggaagtcgagttcgacggttgctacaacgggtaggtnnnnnnnnnnnnnnnnnnnnnnnnnnnnnnnnnnnnnnnnnnnnnnnnnnnnnnnnnngtagtctattcaaannnnnnncngcacact

SEQ ID NO: 4070 - DNA, 1344 bp, Oryza sativa
  unsure (1)..(1344): unsure at all n locations
gcgcccttganatgagaacttgnnnnnnnnnnnnnnnnnnnnnnnnnnnnnnnnnnnnnnnnnnnnnnnnnnnnnnnnnnntcgggaagagaccaggtttccgccccgttcgtaccccaaacttggccgagatctaccccaagatcatctcaaccgagttggccccaaaccactcggacgagatccaatctactccaacacgacccgatgaagacaatagagcctatccgccaatcctgatgaaactcctcaacgatttggctgtcgttttcaccacaagagcgtcatctccccgtaggtctaggcgggatccgccctggccccgatccagtctagctctagggaagtcggtgtcatactccagcctctcggcacggtttcgacgaaacagttggacggctacctcagctcccccggtgtcgactcacgaccaacggagatcgtagagtacgacgacttcggctaccggtacgactaccgcaacctcgacgacttcgacgaaggctatgaagataactacacgccccctctacttcggcattttcatgggcgacaacgagacggaaaaacagcgtcaagcccgagaagaagaagaaccacgcgtgcgacaggaagccaaacgtcgcgactggaggaggagcgcaagcacaagagcgagaacggttggagcgtgagcaacaagagcgcgagcgagctgcaaatgatgcttgggaggccgggcgacgagcacgagaactcatcgggcaacaagatgtcgaggggacggcggtttttcgcaccccccaacagaacgtggttgcagcgatcaccctcctcgacaccctcctcaaggaagacgcactcaatcaggccaatcacgtcgtcaacatcttgaaccagaccaagaccatgatcgcagcttcggtcccggttaactccgcgagtgtccgcacgccaactggcagccgagttccgcctcttcaatctcaagactatcaccaaccgagcctcagcgtcgtcggcgccggaaccagtcgtaggagcagggatcacgacgagcaatccgttcactcgcctcctgaccgacacagggagcgtcgagctgaatgtccccgctccccacatcgcaggcgtcccatcgatcttcgcgaaactatcaatcagcgccgtgcggcaagaggctacatcccccaccattcaccagatcgttacgacgacgacgtggatggagttgctgncttcacaagcgacctgcgtcgagtggatttggccagccgcttcaagccgactggaatcgagaagtatgacggcaccactaaccctgagacttggctcaccgtctacagtctcgcaattcgcgcagcg

SEQ ID NO: 4071 - DNA, 1070 bp, Oryza sativa
  unsure (1)..(1070): unsure at all n locations
caagcgtaagcccgaggnacttgtggcaaccantacaccatcctcccgacaatgttcgcgcgtcaacactttggacaagatcatgaactctcaatgtccgcatcatccaatttccaaccatgcggccaaagactgcttcgtttacaaacagttcgcagagcaatacgccaagaacgcacgcaagtcgacttacagagatcaaagcacatcaaagaagaaggatgatgaagatgatgccccgactggtttccaagacccccgcaaggagctcaaccatatctttggcggacccctggcttatgaatccaagccaaagcaaaagctgactgaacgggagatcaatgctgttcagcccgacacgccccaatatcttcggtggtcagaaacaactatcaagtttgaccgctcggatcaccctgaccgagtggtccacccagggcggtaccccctggtactagacccagtggtttgcaacatcaagctccgaagatccctgatcgatggtggcactgcactcaatatccttttcgccaagactctggacgacatgcaaatccctcgcacggaattgaagccaagtaatgcgcccttccacggagtcatccccgggctgtcttctactccactcggctagattactctgtcggttactttcggcactcgagagaactttcgcacagagaatatttgcttcgaagttgctgattttgagacagcgtaccatgccatactcggacgcccggcgttagccaagttcatggctgtcccgcactacacctacatgatgatgaaaatgccaggtccccgaggagtcatatccctgcggagtgacatcaagcaagctgtcacttgcgacaaggaaagctgcgagatagcccagacccgcgagattgcgctcgctcgagaagaaatccgactggctgcgtccactgcaaccgaaggagaagtgtctgcaaccaagatgtcaaaaggcggagaaggcgacgccaagaccgagaagattcctctagatccctctgaccctactaagactgctgtaataggcgctaagttagattataaatggggta

SEQ ID NO: 4072 - DNA, 737 bp, Oryza sativa
gaaaccctgacaccacccagaggacctatggcgtgaatcaaggcagcttgctggaaatatttagcataacctaagagccggttttgcgagctccaaagcctcaaactttgagttaagtggttcatcaaaaggtaactctcatcctaatctgatttgtttcatgctgctattcatgtgcgattaaccagtggaaagcaatatagtgaaagctgccaagatatccaagctagaaaggcgaatccaggctctggagaaagacaaggtcgaactggcaaaacagagggactcggctctgaaagatgtcgaaggtacttgtagctgaaacttcaaaaaccactctcatcttcatgcccagtcattgatgtgaatttatttgtacagatcgcaaaatcaaatcccaggctcaattcgacatcttggttaacaaaatcaagaagcttgaaggagctagagatgaagtcgccaatgccgctacgccactcgtccaggccatgtttttcaataacaatggtccgagttcaattgatgctgtcgaaatcttcgacaagcttagaactgctccggatacatattttaagaacatcaaagaagctggaagtatgggggcaagtctagagttggcgatgaccaagtccttgtacccgaagattcaccttgatgttgttgacggcttcgcagacgggacaagtgaggaagccgcccttgacctcatcagtgatgcgcaaaaagctggggta

SEQ ID NO: 4073 - DNA, 1136 bp, Oryza sativa
  unsure (1)..(1136): unsure at all n locations
aggcgccttgantttcganactgaagaacctctagcnnnnnnnnnnnnnnnnnnnnnnnnnnnnnnnnnnnnnnnnnnnnnnnnnnnnnntgtccggggattgatttgccgagtgtattattgatcgtatgatctgggagcagatcgtgccctaagaggcacctggacccctccttatataggggaaggggtccgtattataaaatacagtccatatccctaacggaataagtagttacagataagattcaatcttaaccgactaagatcccgggtatttccttaacatacaagtttggaatttaacccaagtccctttaaagatattctatctatacatggcaccccatacccagtcggattataaatgccgtgttggtatggggtatccataatctccacaaaattggaataatgtgacggaaaagttgaaagtttgtgtgtaggaaagttttgatgtgatggaaaagttgaaagtttggaactaaactcggcctataatatataggacgattcattttgcttgaagattggtgatctaccggtatatttcctccgtactaaaataaacaatccagtatgaagtatgatatatcagaatcctattgttacgaaatccggacagtagatcgttataattgcccaaccaaaaaaaaaaagatcgttataattgccagtacacgaaggaattattactattgggccgattgggtcaataagcccatgagagcccactgggccggtgctgctgacgtcacgccgagctacttacctccgcgagcggccacaactccgctccccttccccctcttcgcctgagtcgagtcgcctcccccaccgccggccaaccatgctgccgccggccgcccgcctcgcggcccgccgccttctagggctcgcgacctcctccgcctcggaatcggccgcggcgcgacgcttgtcccgttctccggtcagtgcccccctccccctcctccaaatgcctctgtatctcctcgctgttcgtcggcggagctttgccgtcctgatctctcccttcgggggcaacgtctcgttgcagatctcctacgccgncgcgggctgctccttcaggctgntctccacggcgcttaactacgtacgtgaggcgcctnccc

SEQ ID NO: 4074 - DNA, 728 bp, Oryza sativa
  unsure (1)..(728): unsure at all n locations
ngactaggactattaccataacattgctactgggagtgttatagcttatgttacattttagatattttgtacatagacccaaccaccattccaccaccactgtgctcacaaaaagcatttctgacaatactattttcatgtcttggactttcagattgctaagatcgttgaagttgcaccaatcagagtatatgaagttgctacattttacacaatgtttaaccggactaaggtatctttgcatgacttagtattttgtacttgttaatccctccactagcatcttttcaccctattttgccatgtaggtgggtaaatatcaccttttggtgtgtggaaccacaccttgcatgattcgtggttcacgtgaaattgaagaagccttgttagaacatcttggagttaaacggaatggtttgtattattcacataacttatcctatcaactaagaataacacttcctgatttgttaccacaaacggtcttcgagcatgtgtttctcttgctatctctgtgatagcattaacatttttctttcatttgcagaggtgaccagtgatggtttattttctgttggagaaatggagtgcatggtcccttcgagatctataattttctgtcattttggatgcttgcaaataggtgttctagttgagttaagtgtttaactatggggggaaaattctcgatatanagaggtgtntgtacagctcttacggntcaactt

SEQ ID NO: 4075 - DNA, 674 bp, Oryza sativa
acgattaggaaaacgggacacagttgatcagaaaagcactcgacttagcattaaccagcctaaacgcggggaacgctttacagaatgcaaccctttgcccttttggaattaaaagtttggaattacaggccatgacacggctcaaacccagactgaacatctattacaggtaacaagcattatttttttttgattgcaagactgtatacaggcgtcatcacgttaccagcgaccgttggcgtaacggcgatggtatagaaaggatccattcaactcactagccaaattggtgtaatccggtatttgctgggggtatccatttgacccaactgcatggttcatcgatggatatgagagccatcaaccaagctttgatggacttatgtacacagccattagaataagcattcatgagggaaatggctttccttgtcccctggaagcacctatgtataggccctgagtatccctcgcggaaatgggtaagcaaataaaccgcccagactgttagcgaaaccatttctgtctgccaattggctttaacaaaacggtacggtggacaaatgttggggatatgaccaaggactctggatactgcattgctctgtacctctcaaacaatcgttatgatgtaagtgcgaaatattttccactgcccttgggatgtgcagaaa

SEQ ID NO: 4076 - DNA, 745 bp, Oryza sativa
  unsure (1)..(745): unsure at all n locations
gcccagatcgatagtttggtttcaaaatatggtcaaataaacaattgtccctttctttaagaaaaagtacaatagcaggctgtggagccagctataaacatattttaaagagataaagaaagagagagaagagcagcgggctacagatctgaagccagctgcagcgcggaattcaagacgtaatgtgtgtatgataagtgggaccatgtattagtagtatagtaagcaactacttattatatgaattggctattatattgattataaataatttagagtcagtagtagtgggtcttgctctagctgaagaatcaggtgagtcgcgtcgctgcgtgccgtggcgagacgccggccgcgtacagaacctctctctgcttgctccccatctgctacagccactgtgttgtgcgcacgtgtagcacgcgctggacttatctgctttgctcgtttcatccaacgagccgagctaccccatcacctgccgagctgctgagctacccatcggtcgcgacaaggtccaatcagattttcagctggtcactggcttgctgctgctgatatcatcagcacgagatctttcgtcttctccgttcttctccgatctgcaagggtccatcggtttctgctcctcaaattccactacctctctttttgattgcgagggagccaagaagaagcaagaacttgccagtccccggcaccaagtggtggggccaagtgcggcgatggcgtcggctctggctcn

SEQ ID NO: 4077 - DNA, 736 bp, Oryza sativa
  unsure (1)..(736): unsure at all n locations
gcccctgccacacgaaccattgttagcaaggcctatcggcagggttttttctggcccaccgctgtatctgatgctgacataagggtgcgaacatgtgagggttatcaatttttcacccgacagactcatctaccggctcaggagttgcaaaccatcccgttatcttggtcgttcgcggtttgggggctcgacatggttggcccattcaaaaaagctatcggtggttatactcatctctttgtagctgttgataaattctccaagtggatcgaagccaaaccagtcgtcacaatcacggcagacaaggctatagatttttttcatcaacattgtgcactggtttggggtacctaatcggatcatcactaataacggcactcaattcaccggcggagtatttaaagattcctttgaagacttcggcatcaaaatttgttatgcctccgtagcgcatcccatgagcaatggacaagtcgaacgcgccaatggtatggtactttaaggaataaaagtacgagttttcgaccaatggtatggacaagtctttgcgatttcgtaacttcaaggaggagcgctacggagaagaccgagtggatgatctcaaccgactggaagaagcccgtgaagcagccttaatccagtcggctccgtatttacagggatacgacgttatcacaatgcgacggtcttttacgagctttttagtcgagacctgttttgaggaaattcnactacn

SEQ ID NO: 4078 - DNA, 746 bp, Oryza sativa
  unsure (1)..(746): unsure at all n locations
attcggtggccccagtgctatagtatacttcctgtgtccctaaatatttgacgtagttgattttttagcacatgtttaactatttatcttattcaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagctgccattgcccattgcgtgcaggggtggctcaactgaaagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgg

SEQ ID NO: 4079 - DNA, 1001 bp, Oryza sativa
  unsure (1)..(1001): unsure at all n locations
aattcggtaccccgaaattactagagaaagacattctggcaagttatatcttagtcagaaaggttatattgaaaaagttcttcgtcggttcaatatgcatgatgcaaaaccagtgagtactcctttagctgcacatttcagattatcttcagatttatgtccacagtcagattatgatattgagtacatgtctagagttccttatttaagtgtagttggttcacttatgtatgctatggtatgttctcgtcttgacttatcacatgcattgagtgttgtcagtagatacatggctaatcctggcaaagagcattggaaagttgttcaatggattttcaaatacctacgtggtacatctagtgcttgtttgcagtttgggagatctagagatggacttgttggttatgtggattcagattttgctggagatttggataggagaagatcgctcacaggttatgttttcactattggaggatgtgctgttagttggaaggcaagtttgcaagcaactgttgccttatctactactgaagtagagtatatggctatttctgaagcttgtaaagaagctatttggcttagaggtttgtacactgagctttgtggagttacgtcttgcattaatatattttgtgatagtcaaagtgcaatatgctttacaaaggatcagatgttccatgagagaacaaagcacattgatgtgagatatcactttattcgaggtgtgattgctgaaggtgatgtcaaagtatgcaagataagtactcatgataacccagctgatatgatgacaaagccagttcctactactaagtttgagctttgctcaagcttggtgggtgttacagtatagtcctagagactatttggcgcgcggtgattttacctacatgaggtatttttggtgnnnnnnnnnnnnnnnnnnnnnnnnnnnnnnnnnnnnnnnnnnnnnnnnnnnnnnnnnnaaagtgtcttcaaatcaaaannnnnctcgccca

SEQ ID NO: 4080 - DNA, 749 bp, Oryza sativa
  unsure (1)..(749): unsure at all n locations
cgaggaattcggcaccccgtgactgcaaattgcaaaaggtatagaaatcaactaggaatgcgaaggaaggtaaaaaagaagaatcaaagcattcagtagaaacaagaacacaatgttatgagttagcaaccgaggtatacctgaagtcctaacattttcccaattactcctaacgcttcttgtgtgtccttgttctctttgcaaaggtgaaacctggtcagcacaccagaatgacaactccggttataacgctaattaacagcaaaattagacgaagcaaaaacataatatttcttatacaaatttatacacatagattagatgttttttattaagtttagccaagtaaaatacacagcaagtcagatgaacacattcgagtacaaaggccagctaaagataccaggccaatagaaactatcaattcaagctgaattccaccaccttaggaacttcccaacatgatttggccagctagttgatcctctgctatcaaatggcctgtcatctctccaatcagaaccacccatgttcttcctcttccttcccctcccaccaccacttnttccaccggcaccccgnccttccctagctcctgatcccagccgcaccctaatgcatctctgaaactcatcattgtgttcgaacgcgtcgggggaccaaaaaantgaaggtcttctttagaaaatatggcccttcttcagcccaaaaaaaccccccaaatacaccattttcaccaattttacccc

SEQ ID NO: 4081 - DNA, 978 bp, Oryza sativa
  unsure (1)..(978): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatccgagaaagagattggagaggggattgagagaataattctacactataataggagtaaaataaatcctctctaaatcctccgctcgcgcgttactcgacacgaggcggcagttaattattttgcattcttagttggtgtagagaccaattgaagttaccacttcgatgagtccgtctactgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactcaatggcaaatgaccccccttaaccgcn

SEQ ID NO: 4082 - DNA, 916 bp, Oryza sativa
  unsure (1)..(916): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcaaacaaaaaaaaaaaaaaaaaacaaaaaaaaaaaaaaaaaaaaaaaaaacaaaaaaaaaaaaaaaaaaacaaaaaaaaaaaaaaacaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4083 - DNA, 1139 bp, Oryza sativa
  unsure (1)..(1139): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaggttgtgattagtagaaatgttgtcttccatgaatcagttatgttacatgacaaaccttctactaatgttcctgttgagagtcaggagaaagcaagtgtgcaggtggagcacttgatcagttcagggcatgcaccagaaaaagaagatgttgctattaaccaagatgcatctgttattgaagattcagattcttctgctgttcagcagtctccaaaacgttctattgcaaaagataagcccaaaagaaatattaaacctcctcgaagatatattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4084 - DNA, 707 bp, Oryza sativa
  unsure (1)..(707): unsure at all n locations
aagtaaaaaacgtgaagctgcnnnnnnnnnnnnnnnnnnnnnnnnnnnnnnnnnnnnnnnnnnnnntaatagtttggttagtagtagcgttcatcgattatttcaccatcgattgaaccgatgatcgtatcaatagaacagatcgatttacagatcatttcgaggccacaacaagattactttcacatgcttggagagcacactagaaacaagaatggatcatgtcacagctgaatcaaattgaaaccactcaagttacaacatccatttttgggcagcaaaaagaaagcaaagacagggaaatttttccacctctcaactaggctgtgaagagatttgcttccattcagcaagtctcccgttaccaaatctcgggccttcaacctgcctgatcggacggtgggaaatatgcggtacctccagttacatactttccaatgagatggtaccggctgtgttgagagtggtggaagtgtaattttgtcttttcacatagataagttttctccagctgaaataaccctagtttcgattccccttgtgtgtggtaacagcggcggctgcgaggtagcgaggtcccatggccgcaacttggtgatgggcgtatgtggctgcgaggtaacgagggcccgtggcccgcatgtggtggcagctgcngcggcaggtgggtgaacgaccatggcggcgacttggtgacaagcacggtg

SEQ ID NO: 4085 - DNA, 1343 bp, Oryza sativa
agaattcggtacccctctgggaggtaacaaaaattttaatgtaaaatttagataccctgtgatactttctttctcaagaactgtaaaatttatcaccaccgtgtaccattataatagcccgtgatactttcataagttcataaactgtctatagatagcattatattatattatattatattatattgtgcacttgaataaactgtacatgggttggtgtatcgcttaggccccgtttagttcgcgaaatgaaaatttctggatgtcacatcggacgtttgactggatgtcggaaggggttttcggacacgaatgaaaaaactaatttcataacacgcatggaaaccgcgagacgaatcttttgagcctaattaatccgccattagcacatgtgggttactgtagcacttatggctaatcaaggactaattaggctcaaaagattcgtctcgcaatttcctccctaactgtgtaattagtttttgtttttatctatatttaatgcttcatgcatgtgttcaaagattcgatgtgatgttttttggaaaaactttctggaaactaaacagggccttcaagttccaagttaatacccggcattcaatttacctgcctacaccttcaccaataaccatctatatgccttactccatattaagggcagagttaacatataaaaaaaattgaagccaggcatccttcctttatttttctttcttctttcttttaggatgttttctttgtaagatgacaagagttgagtgttctattgggggtccgatgacaagatgctctgagaatgggatgctttgggaattttagtcatactgatttgtcaagttatgtacactggaagcttatttagttcgatgtgcttgagattggtttgtgcgattttcttgctcaaagtttgttgcccttgtcaatttttgttttagcactacgaggagaggcttaacgaaaacatggtgtaattaacatagtttctacaataactatatgtgtatcttcttttttttcagaataaattcataattaagtctcattcttgtaataatatgattgggtaccggatattgtctgtgtcatttacgaaggcccgactgaaatcacagaataaccaagccgacctagttggcatggcacttaaagttcaccttgttattccacatgcctctgcaccttcatactccctccatattttaacgtatgacgccgttgacttttcgaacaacgcttgtcattcattttatttaaaatttttgtgcaaatataaaaatatttgtgccatgcttaaagaatttttgatgattaatcaagccccataaaataatgccattcct

SEQ ID NO: 4086 - DNA, 1404 bp, Oryza sativa
  unsure (1)..(1404): unsure at all n locations
agtgactggaatccgacatgccactggccannnaccnnnnnnnnnnnnnnnnnnnnnnnnnnnnnnaatcctacctgaaatcgtgtcaaaagaaaagaaaattccaacctgacacgagtgatcgtgtgctgcagctacgagggcgtggacgtggtccggaagcgcgcctcgctcctctggaccgccgccatgatctcccgctgcgccggcgccctcgacggcgacgtgaccagggcctcccaagccgccgccgccgagccgtccggatagatctcgtggacgcagtcggcctcgacgttgaggtggctcaccctctccaagcagccgatttcttcagggtccactagaaggttgctctcgccgtccttccatcctatcagctgtagagagagccagcgagcgatggtgaattctcatttctcaatgtgcctgatgttataaaaccggccccgataacaacatcggtaaccgaacacggaatgcattggtaagctcaccttggcggcgcccgtggagttggtgcagtagagcctcgcattgtcgacgaggttgcagtagctgtggaacgcggtggcgaaccgcttgtgggacttcagctgggacttcaccctcactgctctcccggtgatcacagctcttctgacaatgtgattaaccgggtcaaattttgtgcttatacctctttgttagtacacggaaaatagtgcagttgagtcaatcgcaatgctgacataatgnaagcgtgagcagaaacagcaaagatcaagcagaatttgtttgagtaatatgaacnagcatagtatcagtaatgtagacatgtagtgaagtaggattaagttctgaagcatacctgattcccctgacaaccgcaagataggcatcacagaccacacctacgagctcgatgcgatatggcttcctgtttctcgtctcgccttcttcatctgtactggagtcctcaactggctcccagtactcctcagtgattgacccgtcctccgtgaccttgtagccaacacccatgcggtaccgttgccggtgcacagccctggccatggtgatcgtctgctggacaaacggctcccacgacatggtgccgtccatgatcacatccctcccttcgttgagggcagtcaccaggagcgacgaggctgcgtccatcgatgactgatgtacctgcaccggaatcgaggggtcactgacaatgagccatggtatgtctgaaatgtacatactccctccgtcccaaaaaaagacaaatcctaatttccgtgccaaacgtttgaccgtccatcttatttgnnnnnnnnnnnnnnnnnnnnnnnnnnnnnnnnnnnnnnnnnnnnnnnnnnnnnnnnnnnnnnntggtctccatnngnnntcgaattcgaggnnncccnnccc

SEQ ID NO: 4087 - DNA, 874 bp, Oryza sativa
  unsure (1)..(874): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnatgaaaggtttgatgtgatggaaagttagaagtttggaaaaagaaaactttggtcaactttgaaaaataaactacaactacaatgaaaaagaaaatcaaaatgaactctaagattaatttttaggtggcagcggctaataagttataggacaaacgatggaagcctctaagatacttgagttgtaaaatctaaaaaaaaaagtaaagaaaaaaaagctaagtgtatttttagattctcatcaattagcaagtcaatacttcctttgttacaatataaatatacctagtgcgagatgtgttatatcttacgactataaatctgatcaagcaactatttagatttagatttatagttctacaaatacaaatctggacaaataactatatgcagattcgtaatcgtaggatatctcaagttctatcgcagatgcatttatattgagaagaaggttacttagccatctgcgcgctgagtacagcaatgcacgggccatccgctcgcggctgcgtagtacactttttacgtgcgcacgcaatgcatgccgagcttgatggaagggatgggacgtgatgccgcttgcttgttcgtgaagaagaacatacgagcagtagaatccaacccccacaagaaaggaggccgccgaattacgcgtggaggaacggggattngtacaccattgggancttgaggcgtacaacacattatgattcaccgggaaatattccatagncacatcattattccctagctaagtatagtggaggagcaaatacttggcttaaagaaa

SEQ ID NO: 4088 - DNA, 1174 bp, Oryza sativa
  unsure (1)..(1174): unsure at all n locations
tgtggtgcntcnnctttgatactgatacgctnnnnnnnnnnnnnnnnnnnnnnnnnnnnnnnnnnnnnnnnnnnnnnnnnnnnnnnctccggccatggccgccgacgctcgtccagtctaagcgggtggtgacgacgtgccacaccaggatctggtcggtgagcttggggaacgcgcacgcccactccagctgcggcgtcaggccgtgcctccgcagcgtggagacgccattggtgaagtggccgtagctcgccttgagcgacacgagcaccggtcgtcggacctcctgcggcaggcgctttctccggccgcgcttatgcccctggcgccgcggctccaccaagtagagcgtagccacgacaggatgttccatggccggtggccgaaccgcttgaggagcacgtactggccgaccttgtcgtaccagtacctcgtcgtcggcggcgtgatgctctctttccacaaaaggtggccgggccgcttgtccgtccacggttggtcgtcgcgcacgcaggggtacaccgtcttgacgtacttccagttgctggagaagccggccaccgcctggcagagctcgaggccggcggtgatcacgacgatcagcaccgtgacggagcggtcgaggccgcgcacgccgatgcggaggcggtggtagcccgggccgagcgtgccgaagaacgccgtccacatggtgatcccggccacggcggcggcgatgcagacgtaggtcctggcgccgacgagcacgacgttgcgggtgtagaactcgtcgtagaggaacgcgagctccgcctcgacgacgcggaacgcggcgtcgggccccgtgacggccggccggatgaggccgccgcagacgaggtcccgcgccctcggcgagccggccttcgccgggacgaagccgtagaaccgccgcttcagcagcttgaacagcgcgaacgcgaggcagaagtccctcgccatgtccttctccacgccgctgtacccgggctcgtcgtcgatccaccggtacacgcggtcgatggtgaccaccgacttgccgtcgctctgcctcaccatgtcgtcgcgggtcgcccgcaccatggtgtcctcgccgtggaaatgtacctgtagcccttcatcgtcgtcgggttcggcggctcgccgttgccgacaccgcgagcgacttcttgcgttc

SEQ ID NO: 4089 - DNA, 1775 bp, Oryza sativa
  unsure (1)..(1775): unsure at all n locations
agggcttggcaatgaaccagagcacgagccggtttgaagaacgtgtgcaagcaccagcttctcccgctggctgaactcgcggcggctgtgcaccggcccngcgtacgcgctcgcgtgaatcacaagcagcccgccggcccccagcacgaacgtctcgccgcggacgggccggtcctggatcagccccacggggtaggacaccaccacgtaggacagcgagtaggccatccacatcacgccgcggaggagcttgtcgctgctccggcggcgggtggcgccgtacagcaccagcgccgccaggacgacggcgctggcgaggacgaccacctccagccgcagcagccgcccttccaccgtgctcagcctctccacgaacccgcgcgccggcgccattgccggccaagaagctcaagctctcccatagctttcactgatcttgattactccatttcttatcgaatttgatccatgcgagaaggtgatgagatagggattgaagcaagaacaaaaatgggatgtggagtaggatgcaagatagctgctgcttggcggtggcactccatggaagacaagaatctctcatggttgcacaaaactactagtacagtacttggtagaactaaaacctttcttctgtctgtgagtttggcagatatcaatcagatcagcttatctttacgcctggatcagtgaggagcagcttcaagactgccgaccaaatgaccagtgaaacggcacccagtgaagaaaaggatatgccccatactacataccgtatgatgcatgggatggaggtgaccaggcaaagaagcaagactgcaaatagtaaattttaaccagagaagattggtttcaaaatcaacacaaataatcaattgtgcaaattacagtcacgatcttatagggttggaccacccagtaatggagtactggtttagtggcttgagatggttgaggatgacatgagctactcttgttaccgaaacaatttaaatgagactccaaatgaattactcttttcattttttttcacaagttaacaaggtttgccacattactacaatggtgatgtgcaactttcttcactaatcatgatgaaagctaaacaactctcaaggatccaacattctgatatctcacctgaaagaaaaccatcatatgcaaaacacaggttatattattttgttggaatattcaaagcacaaacttggatcaagcaaggcattatccatgaactagacaacggtaagaacaatgcttgatactagaagcatatgaaaaccaccacagacagaggcactaatcctttcagagcctgaaggcccgttttatttaggatatcagtactaatccactataacactacatggccatatgtagctcaagcttgctcgccagttcatccttcatagcaccgacaaccctgtctttaacatctcccttcttcataaacaggaatgttggcatagcctcaacactgaattgctcagcaataggctgtttgttacataaatcttcattaggataaagccagataaggggaaaaccaacacagcaaccgtactactgtactacataaaaatataaaatttggggaacagcaataccttcagttcatcgacgtcaaccttcagaaaaacagcatttgtgtgcttctttgctagatcggcaaaaacttagcaatgatgcggcattgtcccgaccatgatgcaatgaagtcaatcacaaccctgtttgacaaanacagggttacacacctttgtgggatttgttat

SEQ ID NO: 4090 - DNA, 865 bp, Oryza sativa
  unsure (1)..(865): unsure at all n locations
ntgaaagaacaggtagatccggatccccccccggaaggggaggagaaaaacccctaatctctaaaaaaaaaccagacgcgaaaaacccacctttgattacccaaaatttcctcttcaggtaccccattcacaaaattggatatgagcataatctcaattaagtaaaccttaggccagctacgcacaccattgatcacaaaactcaaaaaacttagcaaaaaaagaaaaaaggacaggaaagaccaaagaggaggagagcgacggttgaattaccagcttcttggcgctgttggcctcctcgatctggatggtccactcgtcgaggctgtggatcgcgatcaccgttccctccgcctgcgccgccgctgaggccgccgccatctctagctctctctctctctcttctctctctcctcggcgagcagagcagagcgccgcttatctttcacgcgaggcaggacacacacttgctctgcggtgttctgactatgtgctccccttggccatggctcgccttcccaaagatattgtcgttgggagaggaatcgaaactttatcctagctggtgacgtgacgaatggtcgaatatgcccctctattctgtgcgaaattaccggcccccaattggccaaacggtatatttacaaatgaaaaataatatgtgaataaaacttttatatacgtgttcttagcaatctaaaagcaaagactgaaaaataaattttgatgaaaaaactctaaaatcaatttcaaatttaagcctgaaaatttannnnnnnnnnnnnnnnnnnnnnnnnnnnnnnnnnnnnnnnnnnnnnnnnnnnnnnnnnnnnnngtcttcgaaacaaannnnnnncggcacact

SEQ ID NO: 4091 - DNA, 1315 bp, Oryza sativa
  unsure (1)..(1315): unsure at all n locations
gggggggcctagaaaagacgcacaagacgggctctttttagggttccgggcccttttgcggccctttggccacagttttcttccggggtaaatccccgattttgggaataacgcgaataaccgccctagagagagtgaaaacccgttgcgcgataccaaagaccaagcacagagattatttacgcggaaaggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacatttaagtgcaagaattagattatgatgtttaatttgtttcacagtacgtatgtgctctctgtcgcaatgtactccgatccattttacagtagctagctagttcacgtgcatgtactatacttgttcagtgatctcttttgacacatccatgcgccgcactgatctggtcatctcaagacctggattatatataatgcagcaagtcagaagcaaattaaaggtaagcatgaacaaagatcaattcaatgatcgatgtacactgactataaatataggtcatcgcaacctgcagacaagctgtgggataagcagctcttttcgatcgagttagccagcgcctagctattagctatagttattagttagctagcaaattaagctccaatggacaggcagaagaaccgtgctgagcggccacagtcgtcggaagacaagaaggaggatgatgagaagaaaaagaagatcaagaggtctaccctgtaggccgaaaaccgtcagaataatatgaattaccgtcagaaaatacttttctgtgggtgccccgtcagagtttgccgacagaaaaaagaccacggagaaaataaatttttctgtcgttttcctgacagaaatatcatttctgtcgggaattcctgtcggttggctcacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4092 - DNA, 7470 bp, Oryza sativa
ccgccgagccaaaacccttatatgtgcatagagaaaatcatcgggaaaagaaaatctaaaaatttctttagaccaactcgccaaggttttttttagaaagaaaccccgatttttttatttataaaacgcctctctcaagaaccagagttttttttttccgcaagttaatttgttgaaaaaaagagaggttttttcagaacaaaaaccacccggtgtgtttttcccgttttaaacacataaccaaaattgtgtcagaaaatcaagaggtgtttttttttttttcaaaaaaaccttattaaagaaaacggggttccaacccaacggggtaagaaccaaagcgcctaaaaaattgcatttggccggttaaccgcctacaaaacgttctattgggcgcgcgcgggaggagcccattacaaccaattgggcaccgtttaatttacgggatagcttaaaaattaaaaaccttaagaaaaggggtacggttaggctgttattgatttaataataccccatctaccctgggggcatagaaagaaccacccaaccaaggtgttttgtgccggctcagggtacgccacggagccccagcatttaagacctcatacattttacaacagttgggtatatataagccagtagatggaaatacattgaaatccttaagttaaggagctcaaaaaccaaatcaagtagcacttgcaaaacaaatgtccctcttaggaggatgaaatggactacataaacacgagtttcttagtgcccaaatatatcaaccacaaagggtctgtaattgagcatagctgcccctgattttagatatgcagaccacagtgaatgattttcttacaaagttccaaagctaagtatcaattcatacgaggttaaaacttcaatgatgctcacacataaataacgcttggggtttgtcttctggggttaacacaattacaactgattatataattccatgaagaatccataaaacaagtgcaatactacctacatgactcagcgacacacagaaggcaacgacggacgaagttatggcagaaacactcttaattttgtaagtgtttttgtatttggaagatcaacaaatcttcttttggatagggaaggtcaacaaatcatttgctcaagcttaatgttctcgcaatatcttctcattgtaagtgataaaacgaaacctgttagaaacttccgtttgaaagaacatgttattgaccctaaggaaagaatgtggtattgaagcattccaatcaacacaataagttattaaacagttgctatgatcacaaaaatgttcgttcttttagaaatcaaggtacaaaggaaaatatctggtttcatgttggagacatggcagcatctgattcatattcatgcggataaatcagttatcacatcttctgattatgtagagcttgtttttatacactcaacaagctgcaaccaaatgtcagttcgaccaaagtgttctgctcacatttcctaattaagtatgtccctgttctgctcacatttccttagctcacaaataacagaggatttttatttcgaaaatactgctaaggcttgggatctacggctcgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcttctaggagctcctcttctgagtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaacacgattctagtactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagatgtgtacatctttacccacaagacacatcttcctcatatgtaaccacgtgccacataccaccacggtatacagacgaaagacgtgacatagtttccaacccatcctagccatagacaagagtaccgacccaatcccacctacggccggaacctccgggacaggcaggtaggactgagcccctagcagcaggacaccggccctgtgccatgacatctcgactaccgggctgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttttggggattttgagtagagggggcggtgtgaatccaattccacaatactccaacaattccataatatctaggtgatatgaatattcccaaagtctagagttgtgaaaccgcctaatgttacctaattaaagcgaagcatctacctaaaatcatactagtgataccatgagtagagtgtccactagttggggttttgtttattctagggtgaacaaggaaataataacaataacaacaataataaggtcataacaaagataaataggcatggctaaataaaacagtgattacgcgggaatttaaataaagcgataatgcaataagttaaatcaacataattttacaaactgggattcaatatgttcaaagatgatgtgacttgccttgctcgctttcccaaacgccggcttcaacctccacgaagagcggatcttccgaagctgcagcgtctacacgtccaacagaaaagaaacggcttttactctactaaactccatataacaagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaatttaaaatcggatttattgcgtcagccgggagagaggagcgcgcggaccgggtccacgggagtggggcccacgcggcagcctctcggtccacggtggaccgggagcacgcggcttacgccggccggcgccgtgggtcccacgcgtcagccgcacctgagggcgcgggcggctgacggccgggccccacatggcagccacggggcgcgcccgaaggcggcctttccggcacagccgacgggaggcggcgtgcccgcgcccctatggtcgccggcggcggccataggcacggcggagcggcggccgagagaggggaggggagggggaaacgaaatgggcggtccacggctcaccccgggtcgacggcgacgacgggaacggcgaccggagcggaagaaggcggcggcgcggcacgggtcgacggggacggcggcgttctggcggtcggcgggcgaaacggaagggtggacgaggtcggcgaggacgcggcggagccgaaggaggcgacgccgaggcgggaggaggtccgaggcgacgacggcggcggaccggagctcggcagtgacggcggagagagagagcgatggcgcgagctcgattccggcggagagagagagcggcgagtggcggaaacggtggaggaaggcacggggagcgtttatatagtgttgggagggggagagaacggccggataagggggaatcggccgcggaagatccggccgccattgatgcgccggcgaagttaggggaggagtttccaaacgaatccgagggagagagagagagggaaaagtgggggaaaagagggagggaatcacggggaatatttcccccctcttgattgcacgcggggcggacgggagcggcgggattcgcggcggcggcggcgctagggcacgggcgaggcgacgggtgcggcgggagcggcggaaggtaggggatgacgggtgggccccacccgtcagcgagggtggcgggcgggcccgcccgtcagcggcacacgcgcggggaggaggccgattgggccgcgggggagaggagagagagggagggaagtgggccgagccggcccaagaggtagagggggagggaaagggaactttttagggtttttctttttataaaaccattttaactttgtttatttcttaataattattatttgtgctctgaaaattccactaaaatttatttacgcattttaggcttttaggaaatatacaaaaatcgtccaagccttatttgacttttaactttgcacattttaattgttggaggctttcacatggattttacttattctatgcataattttgaggatgtattttagagtcgttttaggacgcgacagtgagttgaccttcttcctcgggctacaagtgaagcaagcacaagagggcactttcatctctcaaaccaagtatgtaaaggacattctcaagaagtttgggatggaagatgccaaacccatcaagactcctatgcctactaatggccacctagacctcgatgataatggtaaatgtgtggaacaaaaggtatatcgctccatgataggatccttgctttacttatgtgcatctcgtcccgatatcatgcttagtgtatgcatgtgtgctcgctttcaagcggagcctaaagagtgccatttgattgccgtcaagagaattctaagatatttagttcttactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattccattgcattatccaccgccgaagccgaatatgtcgccgccggttcttgttgtgcccaactcctttggatgaaacaaactctaaaagactttggctacaacttcaccaaaatcccactcctatgtgacaatgagagtgctatcaaaatagccaataatcccgttcaacactctcgaaccaaacacatagatattcgccaccactttttgagagatcataagaccaaaggaaacatatgccttacacatgtgagaccgagagccaattagccgacattttcaccaagcctttagatgagaaaagattttgcgagcttaggagtgagctcaatatcttaaattctcgcaacattaggtgatgggtggttggctaatttatagtcaaacatgtatcactaaaatgtaaattaaaaaaaaattgagcttttgtgtcttgagatcacttcttggtagaagatgatcttgataccaggaataaagctcaaacatttcccctttatccaaaaaccccttttgtgataagttttgcaaaatcctttgtgtgccttttattgcgaaaatttggtttttattttcttcttgtgatgtatattgaccatggttatgtaatgttgactgttgactggtcatatgcatcataagtctctgcatgtccttagttctctatttcccttcgttgaattctcatctcctccttgtttttgggcctgactgccctttttctgtcaggccggaagttccgggcctccctgtccggaacctccgggtatcggggagtatatatactcagggggagttagaaaccctagtctctctcctcatttcttctctctccccgacgccagccctagccgccgctacagtgcccctagtggcgatttcctcttccaaccgtgaaaatttgattcttctccgtggaatcaaccacattggtggtaggaggatcttcctgcgatcattctacgatttcctctctcaaggtagcactttttgattccctctctcggttcattgtgttttttatcccgatctcttaatctgtgaacctagggagaaaaccacttggatagtcttgttcctgctaccttgtagatcagcgatctataggatttgttcacatgcactggctatttttgagacccctgttcttcatttttgccggccggaagttccggtgctcttgcacccagaacctccgggcgctgtccagccagcctgcaattcttgattctctcaaattttgcctaactactgcactccaatttgttgattcctgttgcagtaagcactatgcctcgtgagaaaagacagaaagcctctcaggatgtgtctggtgatgagagtcctcctattcggtttcctcgtggtcgtttgggtaaagagaaagtggttgaaggtggcagtggcagcggcactcgtacttctcctaggtttaccaggcaatccagcaaccgtccagttcagattcgagatgttgacagtggtcaaggaagtgatgctccttcttcaagaggtcgtgggagaggtggtggtcgcacttctagggctggaagggcgtctcatgatttccctgttggatctcgtgagaatcccgttcagctctacaagactcttggatttgacaccactcctatgcaccacattggaagacccaagtccaactaccttcatcagcttgccaagtgcagaagggaccgtttgcttgatccagagacacagcctgaggagtcacaggatcctcgttttaggacgttcacccaattggattggtataactcagtgattatagctagagacaatccaatggttgagatgaagtggattgattggacttacataaggaagaagaacaatgaagtgttcaaccaagcaatgcaagtttgtcacaacaagaatcttggagatattcttgccttggagtatgattggaatgaggaggtcattgcacaattctatgcgacagcattgtttggtactactaggaagggaactccttatgtaaagtggatgactgagggtgttaggcacaaaatttccatagcacagtttgctaagatattgggcttagaggatgaggatctcaatagccctaatattcatagtgaagcacccctccccatgatcaagactaagttcatgtatactaaggatgctcctcggacttgtatgggaactactcatggtt

SEQ ID NO: 4093 - DNA, 19865 bp, Oryza sativa
  unsure (1)..(19865): unsure at all n locations
ncttctgtttannccaggccttgncaangnctngcaaannccagcnccttagactcgggaattggtaccccgtcttcggacccggtgtactcccaggcgccccgagcgcatcgctggagcggcgcaatccgacgacggaggtagtcgccgttgtatgtgtgctaagactgcaaagaaagtgaagaagatcgaaaggcgtcagaaggaagatagaagagaggctgggaaagaagtgtaagatgattgtaaagatgaggtctatgtggatccttttgaggcttatgaggcagcccgcaatgttgccggtgaaggtccatccacctatttcaatgaagagtcttcccgatcagatgatgatgaggaggaggatgacgccgaggcagctgctgaggatgctcccactgatgttgacaccgctgcacagtccgatgagtctcatctctccggtgataccgagattgttccctccgatggagatggagatgagtgatcctcttcttctcttcatggtttcttgctttttggtgccttgatgccaaagggggagaaattgtgaattgaagggggttatttaaatcattttgcgttccgggtcctatgatctggaggttccgaccaggcagattccctcccttttatctctctctctatggacatgtaatcatattcttttatgattggatgtaatgactgttagatgctttattatcctttatgtcagtaagttagtccatatgaatgttgcattttgatgtgatgtagtgttcttttcatctttttgagtgattgccatgtcatctagtctttcttcttgcgtatcacacatcttttaagcactcacatctgcatcttatttgatgagggtagtgtgaagtttcttttgaggtttccttcatcttatgcatattgtattcatctcatttcattatatgcatatctttagggggagcttcatacttctctcatcattccaaatttaaattctattatctttttgtgtgctttaaccatgttgtcatcaatcaccaaaaagggggagattgaagatgcacttaaaccccctagtgggttttggtgattaatgacaaggtggttaaaggggactaacgtgtttatcaagtttattcacaggagtttagtcccaaagcaagttgtgatggctaagaatgtaaggagacccccccaatttgaatgttcctaagtgcaaaaaacatcgaaggtgattagactaggtttttcactttcgaaattgagtttaggaaaaaccgtactattaagaggggtttcaagtgtggttccaaggtatacaaagtgctcttagtcatatccatgagtctaaaggtttttggaatcatttttggaaatgattttccccgagacagagaggcctacccggaggttctggccggaacctccggacaccaaagtttattttctccccgagacagagagggctacccggaggttctggccggaacttccaggcaccgaagtttagctagattttttctaagtgctacccggaagttcttcgcacttttgcccggaacctcctggcaggtttctagttcaatcttgtgagtaacggctagatgacgtcacctagccgttatatatatggatttcgtccccaggtcaccctttagccattccacttcagctctttcatgttctagggttttctagccactcccaagcttcctttgcttcctccactctaatctagagcctatcttgtgagattgagagattagattagagtgtaggagtgttttggagatggcttgaagattaggtttgattgagcactttggataccttgtgggctgtcacttgggcttattactcttggagatcttctcctagacggttaggtgtcgcccgtgagcttccaaagatcttgtggatgtcccgggaaagtttgtgaagattttcctcacctccgcaaggaaacgaggtaagtgagtaaagattcttgtgctgagttttcagaggttatcctaggtagagcaacttgcacttgtggtcttttctagaaggaattgtgagttggatcttggtggtcactcaattctagaaaacgacctagaagtgttgagttgaaggctgtggacttcttctgagatcttttcataagtgaggcaaggggttaatcgagacccggctctttgagcacctcaacggagagtaggatctgtgtgatccgaacttcgggaaaaaatcgcctttgtctcccttgtgcatgatctgtgtttgaatctgctggtatcttgagaattacatcttgtgcaactctgtgcctgatcatctctagctaggacctgttatacttcccctaatttcgtttttctctgctgtccggaagttcctggctcaagaacttcggaagttccgggctactcatcctacccggaagttccggtgttcatcaccaggaggttccgggccctgtcaatttaaccgctgcgattgttgagaaaatttcaggaaagcctattcacccccccccctctaggctacatctctgcacattcagaggagaggaggaggtacctcgatccgatcgtgcacacctctccgatctcagcgtcgatctttactcccggttggttttaccaaccaggactataaatagatctttagtcaccaaccgggagtaaagcgtatggcgatcttttttcccggttggtgttatcaaccaggactacaaatagatctttagtcccggttgctaacaccaactggtactaaagattgaaaagtaccatgtagcttttaaaccgggactaaagatatttttagtcccgatttttaatataacagggactattgtaaaatctggtcgaccgaccaaagatggtttctgaaaatgcatctaggcccctaatgattttgatgattgattactatgcgattagagaggactaacatttttattcaagcaaatgtgaaggttgttaagttctcaacgtgttgtaatacaatgcatatcccgtgaatgcgacatcgcgatgcaatgcggcaatgatcaaatggtatattgtatctttttcctcgcattgtgtcgtaggaaagccgtactattaaggggatgatgcatagacatataaggagtgatgcgtgtgctcaaaatcaattttacttcgaagcatttctcttttggagcgttctggaaattttcggatgttccgaaaatacacagaaccgcgtttgggcgttctggaaattttcggaagttccgaaaataattttcagaagttccgaaaatacacagaaccgtttgagagctctctggaaattttcggaagttccgaaaatacacagaagcgttctggaaattttcagaagttccgaaaatttttttcggaagttccgaaaattgcgttgacttcgatttttctcagatctggaattttcggaagttccgataattgtttcggaagttccgaaaatcccttttattgcactctaacgggcagatttgtgctgtgggtataaatacccacctcccctcacttgtgagggttgctggttccattccaattatttgtgcccttggcttgctctctctctctctagttcatttgagccttgcttcctcgattcatctctccacccgtgtttgatttggatttggtgtgtgtgtgagagtgtggattcgagcttgtgtgggtgcttcttgtggtctttgtgaagatttgtgagcaattgcatcatctccgggagttctttgcatcatcttttactcttggaggttgaggactcctagacggctagatgtcactcccgagccaccgatctacttgtggttggccaggagaagtttgtgaaggccggatctcgcctccgcaagggaagagatacctcttagtgaaaggaggagtgcttagtgcaacctcttgagaaaagggttagctaagacccggctcttagtgagttcctcaacagagagtagaatccccttaaggatttgaactccagggaacaactttgggagctacatcttggtgatatttcttcatccctctcctctagctttgcttgcttgtgccgctattggtctagttgctgattgtgccttgtattccctgttatagtcttatagatctagagttttcattttgtgtgcgctgctctgtgcattttcggaagttccgaaaattcccagcctagctccaaaaattactgcttccgtatttcttaagttttaaattagcctattcaccccccctctaggcctaattgaccctttcagtttctccaccagtgtactatagctcccacgcgtgcactatgagtgcctcctgttttgcaaatacgaaggcacattttactacttgggaaatgtagacatgtgagaccaagcatgtggcccaagatgtcaaataattgatgctaattttgtggaatggcaaagtaccgaaattcctaatttgtgtgccatcaacacaaactaaatcattgcaataaatggcttaagtgagagtatacatgtggggttgtgagataatttggcaaatataagggactatttcaccaatatgctgttattttaatctctggttcatgtggtatatgccaatattttatttatttattggagttttaagaaaagtatgttaccattggcaaatcataagactaattagaggtcccataacatataatgggccttcaaaatgtaacaaaggtaaataaaagtccttgatgagaagtaaccgtcaagtctatgtaaactacatgtgcaacttttatagatgagttcattgacacatatgaatttgtaagctttattcatagcaaattaatagttccattttggtgacaacaggtataaagcacaaacatcacaattagtactgatcattccaatcctagtacaatctagatataatttaaagggtttttcttcttgtgcctttggcagaaggatttgatcctctcaagaccatccaggagagaagatgaatcaatagcaaaagtaatgcgaacccaattcttcattcccagcacactccctgcatttaggcaacatagttaaattaggatacgtaaagtatatgtataaatacattattcgtaaaatagaaacattaacaaggctataacatttactttatttaagatattatattaaatctctagcttaatttactactacagagttaactaatatttaaagtggtagcataatattagatctctttgttagtttttccttcagtacttaaagtaatcaacatccataaactaaaaggacaaagtacgtgtacccaaatattgttggacattgaattatattttctcatataattaaggcatacgcaatttttatttacatgtgattggccctgttcttttcctcttacagattatggattcttacaagcacactttccaagctcatggatggtgcggtttttgcaaaatgttttctacatataagtttcttgtattttaaaacaacttttatcttttagatagtcaatatccgtttgtattctcaaatattataaaaaaagcagatgatctttcatttgttcatccataagacaaaaacaacaggtagggatataatgtgcctgtctgaatatcattgcatcactttgctaaattttctttcatatatagaaataaaataatgtcgtcatattcatatatcacatataaaaagtttacatgcaatcaataaaaaactcataaccacatatatttaaatattctaactaaactattatctattagtgattagagatgcaaaactaaaagtaattaactattaactttttttaagcaacaaaatcatagaataattttcaaagtttcataacaaaattaattaataagcataaatgtttagccaaaaagtaatcattagatttgtgagaaactaaataaggtagcatcacttatatgtcatggtatagcgttagagaattacaagaacataacaagtgaattgaataatataatattaaatttttaactttctttaattaaataggcacatacatatccatttattaacaaaaatgttagatgtacctgggcaaagaatcaccgactcttctttcgcaagttggcaacaaaaatcaacatcatcatggattccctccaaaagatataggttcaatttcacctgtttataggatttcaatgtaagattactggaagtgaagcttaagtgacaagtatgttgtagcaacaaaagaaaattgatgttaacatggcaaactacaacttcctaattatagcattattcttcaacacaatacaccaaaaatttctcatgactctgaattaagtgttttaggtgccaactaaattaaatatagcataattattttttgagtgtgataaattgatgctagtacagctctaatgataaaatgatttaagaggaaatcttaccatcacaaacatggatccttcgggcttgtgaggacaagtgatgcatttaatatcctttattcctctatagcaaatatctgatgtttccgtaagcaaatcaattatcctcttaaagaattcttccttggtattcttaagaatattcggtagagctccctaagaaattcaacaacaaaacatgcacaattcaattatttgagataaaatgaatacacgaggccaatataatatttttaaagcaagataccaataaataatctcagtataagaattgtatgcttactttaacgtaacattgaacttcacattatcacttaaataactacgcacctcagagtgaacacaaaatacaaacctcatcttctcaattaatttttaaaacatattattatgttttaacagaaataggatgaaatgaacataaaaaactgaattaaactttttttgttactttgatgaacttatgtttgattataactctgattcataagtactatttatttggtaagtattcgatagtatattttaaaccagtagtttttctcagctacaaacaatgctagacaccacactgtgcattttgaacagccatccaatttccgaagagcgaccacaacacatagtccaccaaacattacataaagcagataaatgaccaaaattataacccaaacattggcttgttaaggaaaaaaacactaacctgaatgaaagttgctggatcagttgaaacattaaggaaattagtaattaatgttgcaatctacaaagaaagtagtatacacttagaaaaatatatatttcaaatatcaattcacaaaaaaagtatcaaaacagtattaaatatatattttaccttggtttcttgtagagtcttcttggggtcacatattgctacccaaccaagtcgccatcccggcactatccacctctttgatagcgatcctatggttaatattggtacgatgtgcccaaagcaacccattgggacaaatggggaactcccaaaaaccaaattaccatacacctcatcagtaattaccaatatcccaagcttccttgctacctctgccacctaaataacaataatacatatgcacattaataagttgcccataatattatttaaacttttatcaaatttaaataaaccagctgaaccttggataaatgctcgtaagtgtacacattcccgcatggattattgggatttatgatgactatcgcagtagtgttcttgtccgcaatagattctagggagttaaggtcaatctcccagcccttctcaggaataagatcaaagtgacgaacttcaaggttgttgaacgcggctcgagcttcatagtttgggtagcctggtctaggaagcaatatgtttgtgccaggttgggcaaggattgagattacgacctcgatggcctgagttcctccagcggttaggaagatgtcatcagaagatagcttgtatgggaggtcgcgtgacaaatgatctgccacagcactatattcaaaagaaaggcacaagattaatcaagatatattatgatataattaacaatcacataagcaagcatgaaccaacatcacgtaaatgcctctttcaggaagaactgcatcctcggcgcaaataaaacatttaattaataatcatacatgaaaaaaaaaacataatgaacaacatgccattattaaaaaaaacagcatgtaaaatcctttctaaagaagaaatgcatcatcaacccagaaaaaccgaattattggactatatattcttctcccctgcttctagtccacaaaaggcacgattgttctcaattcaaaagagagcacattttccttcctttcttttcctcctctttcttttgttttttcccccagaaatccagcagctacagccttcagtcctacagctagcacagatgcacaatgaaggctccatccaggctgtgcgcccgccacgtcggacgagccgcagcagccggggggcgtgccagcacgcggtgggggcgggcgtggacgacgcggggctcgtgctcccccgccgcgggcgcgtgcgccgctcgggccgtacgtcccgtccatcgccagccgttggttccacttcagttctcctcccctactagctctcgccgaccacgggagtagtacgcctcgagatcgacgccaatacagtattcgcgcacatgtgacatgtgtaataacactacttcaataattgttttcttcatccagtttaaattcaattaaatccatggttctatatgggtttgaatcgaaacaaatcttccccgggattacattacagggaggttgtgagttgtgaccctactgacctcgtgttgcatatggggttgttgttttgccggttctttttttcaactctgaactccaaatttctcatttttcattagcacacttttcaaactgtaaaattatatattttcataaaaaaattatatgtgcaagttgtttaaaaaattcaaataaatctatttttcagtgctacagtccttaaaattatgaccaaagtgtgctcactacaacagagaagacccatgcagcttaattataggtgcctgatgatgtgtatatgaaatatatatcacccgtacatgttgcaaaataggaatcggatcaaagtgaacaaattatataactggtgggtaaagtagcacgcttttgttagtaaacaaagaatggtacgcagactaggggactgttttagtttattgccaaactttatcacgtctaaagtaggcagctccggttcttctggcaaaacgtttggcttataactgcaattgtagcgtttttagatttgcttatagactcaatttgcaagctgatttattttggccataagtgtggcgagctttttgtcgagtgtcgaaaaactatagcttgctaaattggtgatatatgctgtttggcacacaaaataagcaaatgaaccaaccagtccctaaacactattcgtataattcgtattataattatcattaatgaataaaataagcactattagtaaatacgtgttatcactggctcgattcgaaagtactctagttgataaattttttaaactaaactattcaattttgaacgaaaactggcctcactatatatggctcgcctcggctcagcttgctagttctcgttaacaaacaaatagttgagaaaatttaataaactaattttaataaaggccataaaaggcaaacatgaaccatgcacacgtagcgaacaattaatcggcaaagaaacggaagcggaaaaaaaacataaaaccaaaaccgaatatttgaactcgccggaaaataatgaaaacaaaaaaaaaacggaagtggatggcgtgggtggtaccgtcgcgcggcggggaggccgacgccggcggggtagcagttgaagtcgccggagcggagcgcgtcggcgacggcgtcctcggcctcggcggcggtgcggaactcggggaacacggaggggtcgccgtgggcgagcggcaggacggggcgcgggccgcggtcgtcgacgctggcgctgatcttgtaccgcaccgcccggatgctcatcttgtcccccgccgccgccatcgcgccgcccctcgtcggcgccgtcagcctccactccttgctgctgccgtcgctctcgccgccgccgttgctgctcgccgccgccgccgccgtcgtcggtgccatggccgtgctctgttttttgttggtgaattccggtgcaaaggaggaggtggtggtggtgcgcgtcggatagctagtgccgctatatttgtaggagattctacgggtgtgggacacggactcgggtggggcacagcagcatgaagcatgcatgcgcgcctggtgcttggtggtggtgcacgaggagtatataagccccgttcgactcgaattagatacgaatgcgagatttttcggagcacgccaaacgagataattattataaatttatttataaatttaataaataaatttatttagtatttttatatattttttaaaaaggttttcgcacgaaacatatatttaataaacgtgttaatgggaagtgagataaagatagaggcccattgcgacctgatcgatcaatgttggtcagacgcaagccccggcaacattttggcttatttttggggaccgtttcggactcttgtggaccgtatatcgtcacggaggatgcggcaaagcatgatccatgcatgctatgcggtggttctcccctgagctgagtgacgaatgcttgctgctattctttatggaaaagaattatgtgaccattgcactaaggctatccccaatccttcatatcatctagtatccataacattaaatatattgtcacatgagtaaaaatctgatgtggcaagagagttaataagtagagagataaaaagatgaagaaactatttctcattcaagaaaccatctctacacaagaaccaagaataaaaataaagagattggttgataaaatgagagagaatgaagatgattggatgaaaatttaatttaaagacacaatccattggatatatagtttatatatatactgtctaaatgatatggtaagtatggaaagttggaaactacttgatagtttctgagtaagactgagttttaggcggtaacttcaaccaacaactttcttatttttggttaacacgcttttaaacgactaaacaaaattttttgtggaaaaaatataaaaaagttttctttagaaaaataaaatgaatctaaattttaaatttataatagctaatacttaactaatcatgtattattgagttttcttgtttcatttgcgtctgaaaatctccatcaaagccaccctaaaatatgaggcctcgtagggtgtgtttagtttgaggataagaaaggatgggttagacccatccgtattatttagaattggatgattccattatctgtttggcatgagggttagactggtctcgtcttttcttatagatgggaggatgtagtccacttgtcagtgagagagaaattatgttggactggtctgccaaattttgaggtgtgaagctcatccaaaccttggaatattcctttttggaattaactcatccttatcaactattaaataatcatattaaattataatgtattaggacatttcggccaatacaattgtaaccttttgggtttataataaaaaaatacaataattatattattataaaatggatcgttcacctcaaaataagtgcacctaggtaaaaggtatataagcgggtttgcaagcctgcccgcttgcacccttacacctaggtaaggatgtgatacactagacctatgaatctgtacaggctattcagattcgtagttcatatgttacatccttacttaagtacacttattttggaggtttttccctctgtgccattaagaaagatggtgcctgcttctgtgccactaaaaagttcgagcctccctctatgccatcgtcaaactttattgcgctcttcacaccattccgtctgtttttggtcgtaacggtgggtaactgcacagccaaatgacttagttgtccttagacttgagacggcacacagggaaaaacctgctctctctttctctctttgctttcttcgtttctctccctcgcgccttgcgttgcttggcgcggcgaggctaggtgcaacggcgcggccggcgatcgggccgaggcgaccgcggcccggtgtcccggctgggcggcggctgggcggcagtcagccctacgcggccggtgcagcggccaggctaggtgcggcggcgcggccaccgaccgggccaaggcaacgatggcgtgagccgtggcgacggcggcgcggtgtcccggctgggtgacggcgggcggcggcgagccctgcacggcggcggcggcctgaaggtggccctgcagcatcgggggaaaaaggccggcacaatgaaggaggatgggggaaggccggcgatcgggccaaggcgacggcggcgcggcgcccaggcgccggtcggccctgcgtggcggtgacctctcgatatctctcgcgggggccacacggccagatcgtcagaggcgccgtggcgggcccgctcgttgccgccaccaccatcgtcatcatggccatcgcgttcaccagtcccatgttccaccgcctccccgcggaagacaacgacgcgccggcgtccgtctccggtagtagcgctgacactgatgaacaccgtggcctgaaggtggccctgcggcatcggggaaggaggtcagggcggcaaggaggatgggggaaggccagcgcggcggtgatggaggccgtcaggctggaggagccggagcggcgccgggcaaaggaggaggtcgggcgccggttggaggggtggccagcggcgctgtccgctcggctcggcggagacgatggcgacaagggaagacgaggcagacgttgatgccagcgattgaaatggcaagaacgatatttttcttgcccgggcccacatgccagagataccaaacggttaaacctaaacagaatagcgacggaatgttgtggagggcgcgataaagttcgacgatggcatagagggaggctcataagtttttagtggcacagaggcaggcaccatctttattactggtgcacagggaaaaacctacttattttgagagattatcatgtaactatatttaaaagtggtactccctccatcccaaaatgtttgacgacgttgacctttttaaaaatgtttgaccgttcgtcttatttaaatttaattattaattcttttccaattatttgatttattgttaaatatacttttatgtatacatatagttttacacatttcacaatagtttttgaataagatgaacggtcaaacatgtttaaaaaaatcaacggcgttaaatattttaggaaggagggagtagtaacgaaagaaagtatgacgtagataaataagtttttacctatacataatttaattatcaactaagccaaattcgatggaagaagaactcatgcttgaaacggtataacaagtggcatgttaatttcgatcaattaatattggccagaatttgaccaaaacgatggagtaggaattaacagcatatagaccagaatggatatgccactcattgcaaatcattctaggtggttgaatggtgcatatatgtcatctactccctccgtttcatattacaagtcgtttatctttttcctaatcaaacttctttaagtttaaccaaatttataaaaatatatagtgatattttcaacccaaaagaagcatattatcaaaatatattaaatgttagatttaatagaactaatttaatattttagctgttactaaatttttttataaatttggttaaacatttgactaggaaaaaaattcaaaagactataatatgaaacggagggagtagtcaatgctaaaacggagttgataagctgatatctgctcatacttgtaaaatattaggaataatctaaggcatcctttgaatcacataaataaaaaaacagataaataagaaaaatatagaattctgacaggaatacaaatatgcataggtttgcaaaacacataataaacataggaatgaccatttaattggaccgtaggaaaaatacaagaatttgaggagagataaacactcaaatgattttttccattagattctacctcatgttaaatttcctccaaaatttacatggaaagagacattccatagaaattttataagatttcacagggttcattactgtagaaataaagctctctaaaatttctgtgaattttgaatttccttataatcaaaaggggactaaaataggaagatggtaaaaaaaaattgataagccgtgctaaggtcaccaccatcgtgtacccgtcaagtagaaggggctccagtccactgggccaagggcggagcttcatagacaccatcatgggccatgctcctatggtccccaactttcctgaaaatcaatgaaatcattttttttatgacatcagtagctagcccccatggccaataaattttacatattagcccctcaaatttctctcaagctctgttactggttagggacatttccatctagcaatggtgatttacacgggtgaatttaactatttgccactattgcatttggcaattataaaaataccctcttagttttcagcttacaaatttatcactctacataggtgacttcttaactatttgtcacctttatctacgtggtttacaaacatgaaaaacaacatgggacccacccgccagcctcttccttgtgtccatctccctctccgatgcacgcgggcatgacatcatgggcgaccgggtgcttggccaacctgacgcgaggtacttgaggcggacacacacccaagactcttacacaacaacgaagaacctctcaatgatgagcaggtggcgaccgcgccaccaaggtggaagccctacatgtgcgccacgatgcatgttgacaaatggcagcgaggaggaggaaggcacgttggaagccgtagaacctcatgcgcagcacgatgctctatcctagcgtcacgacaacgccgtcgtcgttggagtaggtccatcccgtcggtgtgtgtcggagggggggatggagagaaggggaaacacagactcctggggatagagtggcgagcgtcatcggcggcgtggagggcctacccctcatcgtcggtggtaggggtgagcagaaaaagactgagatcgagaaatttggtcatcaattcgttcctaagtagtgaaagacagaattttgtttggtcaattcgattagtctcatcggttaaccgaatagattgaaaagactgaattaacaaaaaaatgtctaaatgcaacctacaatccactaagttcaataggattaaactctattttttacatttctacttcttctaggcatgcaacctaataaaacctaataagagtctttgcttatagaccgagaccgaatttgtcggtcctgacatttttacgttgaaatttggtcttcactttttaaagaccgaaataaccgaaagaccgaaaaccgagaccaaaattttcggttagaccaaatgtccacccctaatcggtggggctagtgctcgaaagctactcactacaacggtggttgttggggtggcaacagcaagatgagagaggggtggcacgggaagggagtggtattgggggtcgtagcgactagggatgggctgggggtcgtggctcaagctcgccgtgactgtacaaacacgccaaagaagaaaaggaaggggagagtgggagaagctcacggctgagtcccacgctgtttttttcccatttgtaagccacgctgacgtgccacgtaggcaaaaaacctctttagagtggcaaaattgtaagctggaaaattgtaagctggaaaccaagagagacatttagataaatttatctactgtgatggttcccctaattcctctccatcaccctgacaggcaccatggtggcgaagggtgtctatggcgttattttatccaactctactctagtggaatggacagagataaattcgggtgctttggatattttagaaaaaaaaaactatcgacggtgaagacacaaaggaagaaaaactctttatatgatgataaatcgtactccctccatattttaatatatgacgccgttgactttttatctaacatttgaccattcgttttatttaaaaatttatataattatcatttatttcattgtgacttgatcatcatcaaatgttctttaagcatgacataaatattttcatatttgcaaaaaaaaaatttaaataaaacgaatggttaaacgttagtcaaaatgtcaatggcgtcatacattaacaaaatacggagggagtataattcatgtttatagactgcaattactggtataaacaggagatgtagagatcatgtgctgatgcattttctggaaacatctcaggatcatttgtgtagtatgagtatctatcaacagtgtctttgtacctctgctacacgtttctccgtggagacatggtgtgctcatcgttgcacttgaccttgctcatctggcaggcaccacgcaagcacttatacgtcagaatcatacagccaattcattgctgacaagaactaggttttcacagcacaacttggcacggacagacaggaactctcacttgtgtctactccacaagacacttcgattgcgccaaagcaagagcgaaattccacacttaaagttatgagcgatcattatccttgaactcttcaaaacaagattaacacaaacttatttacaagcactcaagtctttgaggtcacgtgttaccgaatggcgacatatgtacagtaccatggcggcgtagtgacatcaaacagtcgcattcagagcagaccacataactgataactacatgatgaacttacgccaagaacctattgtgacatatatctatatcacaaaaaaacatagataatgcatgatcagctgctaaataagtagtgttgcaacttacaatatcaaggggtgcactatactccgccaaggttaatgatagttcaccgagtcgacaacatcaccaatccatccaggatggaacttttattcccttctgcttgaagccctgtgtagatgttattagtgcaacggtactgaaacagggtaaattgcacagaaaaataaacaatataaattttgaaattttaatatctgcaggaatcatcataaaacttccctactcaaacccatattaatatttcatgttctttaatgaataaagcattttatttacttgtaatgtttttattttaccatatcattaattaaagaagctgccaggaaaattttctactgtggtgcatcgaacaattatcttatctggaacattgtataagggtgatatcaacctaacaaacacatatgcaagcaaactcaaattatttactactctcatgtgcaagcaataggacactgttatctgcaggtaattgttcagtcacacagttctatatttagcttccatagtatgaatgaatacactacaccatgccagtacatatagaaatatgtagagactttgaatgtgagttgttgaacatttcagaacacttaacagaacaatagcacttggcaattgcatatcttggaaattcttaactagttaactgcagcagttgaagatcatggcagtccttaatcattggtcaaacccaacaatgttttcattttttttctcgaacatacaggagagctgagcatcgttatattaagaaggaaaagagtccaaaaggactcaaacaagcccattagggcagattttagtacaaaacggcttgccaaagaaatacaaaaggactgcgaccatccatgaaatagtttagttggaatgttttcatgttttcagaggaatattatctggcgaataatcatcagctaattctgtggcaaaagctacgcaaagataggatgaaatagttagttggaataattgggcataaagcattcataggtggctattcaagtctgcagttatatacccaggcttcctggaaaggtgggggaaactaccaagctgaagtgaagtaggggcacacagaatttccagtgagtgctgaattggatataggaaagaagaccaacgtgaaagcactccatttggccaatactatggttgtgtttagttccacactaaaattggaagtttgaagaaattggaacgatgtgacggaaaagttggaagtttgtgtgtgtaggaaagttcgatgtgacggaaaagttggaagtttgaagaaaaaagttggaatctaaacggggcctattttatattgcatttattatccctctcataaggtattttagttgcgcgtcgctttttgtgatgactttttggggtcttgaggggtccttttggatccctcgtttgtacatatttcttcttcttcttcttcttcttcttcttcttattaataaaataaggcgcagtcctcctgtgtttttgagaaaaataaggtattttagttttgggtatattattctagaatttcccacacagttctctttaccctggtgtctccaaaaattatatctcatctggaacatttttttttaaaaaaaaaagtaaggatgaccaccagcagaaacctcctgtcaggcacatgtatttaaccacccactataaagctaataagtagttcggattatgcagcagtcgtacccacaaaaatacagcatttctgcattagatatatgttcagatgaatgtcaaaacaaatgataatatatactttctctgagactctgattccatatacaaactgtttttatacttgtgcacaaggattaagaaagtgatcaaatgagttcgttgcccttcatttatacatagtgggatacatgttcatgagtgataatatgtattcaaaaaggacaaaggaaaaaagagatagtaaaaggtgcctcaagttattatgacttatatttgaaaaagagttaggaattcaaagatgactgaggaagtataatcttacctttttcacatctgaatatagatcttcaacccttttctctgtctgctttgcaaatgaccacattttgtatatactagactccatctttcttgattcatcaattagaatttgaacctgtaatcatcgtacccatgatataaacaactgaacaacattcagaatacaaaagaatgaatgatggaaaagcacaataataggaacagttactgtccagttgtcaaagtcaaaacaccaaatgcgtgatgtatgaccatctaaatgccaaaaaagctatatggcacaggtagataaaaatgtacacatttacatttaactattaactatacttttctaatgtttttactttttagtatataacaaaaattaaaaagcatagaaacccatattataccatcatgatcacttagagtagtatagtaagaaagaaataggaaatcagatcaaatcttccaatactggagagaatagatataaattactacctccgtttcaagttataagactttctagcattgcccacattcatatagatgttaatgaatctaggcacacatacatgtctagattcattaacatatatatgaatgtggacaatgctagaaagtcttataatatgaaacggaggaagtacaaacaacaaaagcggcttatattttaatttcatgtgtaggatataagttaacatcatgccgatatttgaaggcaaatagaatggcaaaaaaggccaatagaattccaacatttctgcgttattcttagcgccccattcccttgttattttctaaactcatcttctaatcgcgcaggaagctgcaagaagatctnnnnnnnnnnnnnnnnnnnnnnnnnnnnnnnnnnnnnnnnnnnnnnnnnnnnnnnnnnnnnnnnnnnnnnnnnnnn

SEQ ID NO: 4094 - DNA, 1855 bp, Oryza sativa
  unsure (1)..(1855): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtcgcgcccgcatgcgttccctgttgtcgcgggataaataccgtctgtcaggatgacttgccgagagagtcgtacctgcgctctggttcagtttgatgttcccaagctggccaacaagtgagaaccccacggtcgtgcatgctggagtgggcatccttctaggcacgtcgacgccgccatgcaccaccattgccgacccggagtacgtagccgcgcgcgtgcactccttggatcgttaagccggtgatcgtggccaatgcgagcggcaggtagcttctcgacgtgacgagtgacgacacggggcgcacaacgtgtgattgctcacgctctcgggtacgagatcgatgtttcctgctctccatggacaaagctagcatgaactagtcattggtatagacgagttaatataccgcaaagcatatgctctacgtacatcatccaaaaattcatatataattgacaaagtgaagctttgatgcgccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcccttttttactaaataaaataatttggctaggaagttctgggtggggggacgggtttaattctttcaaaggggggttaacggtgtctcccaaaacatgggtttacccgtgcaaaactattttggcaaaaggccgcaaaggccggaacccgctaagggcggggggttggggttttttatgggtgcgccccctgccgggataaaaaataaaaccttaattcaaggggtgaacaccccgcgatattaaaaaccaaggtttcctctgggaggtctcttggctctttgtttcaactctgctttagcgaaaacgtgctctttttttctttgagaggaggggtcttttatattacccgtggg

SEQ ID NO: 4095 - DNA, 1683 bp, Oryza sativa
  unsure (1)..(1683): unsure at all n locations
cgggggtcgggggagaatgtgtccgatagaggaatacaacgaagtgggcggtgatgggtgtgattgttgtgagaagcggaaatgtcgctatttatatagaagtgtagtgcgaggggggagggcgaacaagaatgagttgagattgtgggggggggaagaattgtggaagtacgcggaattggtagtgtttttgttggttagagaggcggcggaacgatgaagaattaaggaacgggaaagggggagcacccaaataaaaaatattagggagaagggagggaatgtggggaagaggagggaggagaagaagattgaggaaaggggttttagagactgttgccaattggaagattgaatgaggggggggagtagcgaaagagtaggtgaggtataatatagggggagaaaggggggggatgatgagggaattagagacctgaagtttgtatttttccgcagaaccacgagggtaaggagaggtgtttagagggaaatatgtcggggtgggaggggaaaagggcatttgtttcgcggaaaacgggagaacgggtccaattgggcaagaaggggggggtgatgatggggacaagtttttaagcgacggatatgcgtccccgggggtaaggtttaaggggaggaattttattcgaacatagagaggtgcaatgggcagggggggattcacaatcggtttggcccggggggagtcgaataaatgcgggtggggacggtccggaaacaagagggaaaagggcttggttttttaaagggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctggttccgttcattctaggataaatggaagctcctaaatgagaagataggtgacagttgttgtacagagaacaaacgttcaagtattttactccacctaagtagggagaacacgaactaggtttagttcacccaagtacggagaacacgcacgagcgaatggattaaatccatgagctctcacggggagggggagagggagaggtgagcggcttattaccttcagccagtggcgtcaacggcagtcggcggggcgagaccgacaatggattccggggcgtccaggccgggcgtgaggcgactggcggagaagacgggatggtgactgcgggagcgggataacctggggcgaccggcggcggcggagatccgggtgtcggcggcgagaggcgatctccggcacggcggcgcccgacgaaccctagccgccctagtcgccgcccgtggggaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4096 - DNA, 20919 bp, Oryza sativa
  unsure (1)..(20919): unsure at all n locations
agcgattgtgacaggtgtcgacagatgtttgtaatacttgcttctccgcctcttcatttgtaggtagaggactgttactactnnnnccnncacgtccatggacactctcgaacgcccaccaaccctggggagntccccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggcgtcctgctgctagggggctcaatcctgcctgcctgtcccgggggttccggccgtaggtggggttgggtcggtactcttgtctatggctaggatgggttggaaactatgtcacgtcttccgtccatataccgtggtggtatgtggcacgtggttacacgtgaggaagatgtgtcttgtgggtaaagatgtatacctctgatcagagtataatctattcgaatagccacgctctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacgaccttgtttaataatattgtatagctctagaatcgtgtttataaaatggctttgggtaactaggtgacttttaaatgcggtttactgcaaaacttaacccctattattatccccttgtacccccttgcattaatcatgcatctgctggtgtgacttgctgagtactgtggttgtactcactcttgctcaatcttttcccccccttcagtaagagaagctttggagaagaagtcttaggtggagtcctggcttataccccagttgagcgcctgtgaagatggagccgtaggcccgctagtccgctgctgtttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaatgcaaattttctcggtcgcgacacttatgtcgatgacttggttgtaaagacgcgtaaccaggaaacgttactctcagatctagcggaaacttttgagagtctccgctccgcccgcataaaactaaaccccgataagtgtgtgttcggtgtacctgcgggcaagcttctcgggttcttggtctctacccgaggcattgaggccaaccccgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctctggaccgtttacctggacggaggaagccgaaaatgctctcacccagttgaaggcgtatctaagctctcccccagttctggtcgccccggagccagacgagcccttgttactctacttagcggcgaccccgcaagtagttagtgcggcattggttgtggagcgcgatgaggacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggcctaaggcccctgacgaccggagtcggccctttgcccgcttgtccgacgacgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtaatgcagttcgacggctccctgtctcttcagggcgccggtgcgggggtcacgttgacctctccgaacggagacgtcctcagatacttggtccgcctcgactttcgagcgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagatgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccaactcccttagattgattgcttggatcgccgagatccaagcatacctcatagataagactctacccgaggaccgcgaagggagtgaacgcgtccatcgcatttccaaacgctacgtgctggtagaagggaccctctatcggcgcacggctaatggaatcctcctgaagtgcattcctcgggaacaaggcgttgtgcttcttgccgatatccatgaaggcgaatgcggagcccactccgcttcgcgcaccttggttggtaaagcttttcgccaaggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtacgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgagcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctccctaacccgtggaacatcgaacaccttcgtcgcttctacccctgagggggggggtcgggtgtcaggtttcgggctcgggccaaccccgcaccccctcgggcgtgtagggttggccgggggctgccacacatgcacattcttatttctttttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggactagaacctgggcacgagcccttattcaagctaagacacaaaaggaccacggcacagatcatcctcatctcatactcatagcaagatgaaattaacacaaaaatttcttcatttttgattacagattaagttgatctatacaaaaaagaggcccgaaggccttagaagaaagaaaagaagaaaaaactgaagaatggcgggggtctgggggctcagtccgatgcgcccggatcgccggcctcgtcgtcactgtcgtctgcaccaccggcattgccctcctcgtcggagttgggggcgaacgcgagccgaggagccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggttactcgaggatgacttaatcgtcttctcgagctcctcggggagccgttggagagccccagccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtctagcgcaccctgcagatcggcgatggtgcgttcggcagctgcgaggcgggcggctaagtcgctttcgcccgcggccgccccgccgctgcgcgccctcgcgtccagctccttcgcccgcgcctcgagctcagcggcccgttggttcagtacggccctctcggcgcgggcaccttccagattacggcgcgcctgctcctcctgcgctgcctcgcggagggacaggctgtccgccagctgttgcgccgcggcctcggccccctcgagagctcgctcccgctcggtgagcgcgtcctcgcggaggcggagcgtgaactcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagtggcagcgtcaagcaccccctgggcggcgtcgagcttcttccctagctccgcctcccagctcccgtattgagggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcagggcctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgccgatggaagtgccggactcggggatgtcccccggacccggttggtcctgagcgtcgcccgagggagtgggcccaagcgacgcgcccgcggcctcgtcacgagctgccttggaagtctccatcgcctcgtcctggcgaaatccggcctcctcccgaacggcttcctcggcctggcgggcccgggcgacttcctcccgagcggcttcctcggcctggcgagcccgggcggcctcctgggcggcctcctcggcttcccgtaggcgatccacggcctctcgccggtcagattcccgcctgcgggcctctgcggccgccggatcctcggcctcagactggccagacttggaatggcgggagggacgcgacgggatctcgctgaaacaaaagaaaagaccagaagatgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctgctgctggcacgcgccaccccgccccctcggggaggagatgggggaggtgttcctccctacttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccaccatcataatggtcaggatggaggcgcggtctggatcgctgcagagggggaggattccttggggaacgagggccgcctctatggagttgagattcagcacccgttggaccaatatcttgaagtccttaggagcccagtcccatctcacttcctggtgggtcctcgtgaagtcttcggacccggtgtactcccaggcgccccgagcgcatcgctggagcggcgcaatccgacgacggaggtagtcgccgtacaccatggcccctgtgagcccctgggatcgcaggcccgccaggcggtcgaggacggcgtcatagccatcccccagatctaccggcgcctgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgccgtgcccggctccacgcttctcgcgcccactatttcgccccctcgtttctcgcgcccacgcttccactaatcccattcgcccgcttgcggcgcatgaggtggatatgcggttgtggcagtcgagatagatcatatcgtgcgtgcgttaattacgctcgccgaccgaagcgacgttaccatatctccagacgaaacgaatcgccatgtccagattcgtgtgctactcaagtaatgtggcggtattgaagagaccgctcattattgacagccgagttaccattgccgatgtgcgtggtttgtgaccgttggttttctgcccaattgtggagaccggtcccacctgtcaccaagccttaggagtggcgtcacgcccgaccgtttcccttaaagagggcgattgccctggcataacgccgggggctactgtcggtgacatgggatcaggagtatcatgactagaggtttgaggcagacacaatcgcacacgtggcctggcacccccgagggacgtcgggcccgagggtgatgtgttcgccctcctcttagtccccccgagggggtcgggccgcacccgcctcggccccgagggccgaggcgccccgacccctcgtgggtttttgctccgagtgtatgggttaggtgagcacagtggggctcacctaaccacattttttgcggtttggctgagcgtgtcacgccgcatgtaacgcagtgcagtgcactcatttatccggtctgtgaccagtcacagaccggtcaaatcgcgggttaggtggcgacaggcgatctgacgcacgcctcgccccatcccgtcaggacgagggcttctaggcgctcgcccccagctggagctagcgtgttacctcccagagatggcacgatagtcctggtcagatatatgccaggcttcatcctaaccattacaagcaagatgttgtgtgaagaagggcgaacatgtagattgctaagctgacacgtggtggacaagaatgaccgacgtgactggtctgacaccggtcatgtcgtcagcggacagccacgattccacgtcgcatctgctcccggcgaaagtggaggtagttgtgggccgtctcatcagaaggtgactcggacggcaactatacaaatctctgtccatttatgaaaaggtggggtaagtccccacaaaaaagagagaaatggtgcatgtggtatccccttaagatataaaaggaggaccttgcccacttagatgggggactggacttttccagattaggaactcagaacaagggagaggctggcatatactttgtagctccttcatacacagatctcccaaaaacacaggagtagggtattacgcttctcagcggcccgaacctgtatacatcgcccgtgtcttgtgtgtttcctgtctcgcgaaccttccacatacagagagcttagaatctcaccctgagtccccggccgaactggcaaaggggggcctgcgcggtctcccggtgaggagccccacgctccgtcagtaggctaagagaaaattacaaataaccttatagccaacaacaggttaacggtattattagccttgctgttagccggacgaaatagcaaggacggtcggcgccgcatggcgtcgctgttgtcgcgggataaataccgtctgtcaggatgacttgccgagagagtcgtacctgcgctctggttcagtttgatgttcccgagctggccaacaagtgagaaccccacggtcgtgcatgctggagtgggcatccttctaggcacgtcgacgccgccatgcaccaccattgccgacccggagtacgtagccgcgcgcgtgcactccttggatcgttaagccggtgatcgtggccaatgcgagcggcaggtagcttctcgacgtgacgagtgacgacacggggcgcacaacgtgtgattgctcacgctctcgggtacgagatcgatgtttcctgctctccatggacaaagctagcatgaactagtcattggtatagacgagttaatataccgcaaagcatatgctctacgtacatcatccaaaaattcatatataattgacaaagtgaagctttgatgcgccggtcatgacgttcactggtggaaaaaccatttttggtcggtcgaccagatttcacaatagtcccggttatattaaaaaccgggactaaaaacatctttagttctgatttaaaagctccagggtatttttcaatctttaattaccaaccgggactaaagatctatttgtagttctggttgataacaccaaccgggaataaagatctccatacgttttactcccgaccaaagatttgtagttccggttggtaccaaccgaaaaaaagatcgacgcagatatcggagagatgtgccgatcggatagaggccatctccgcctctccttttgactcctctcctctcctcaacattatcttctctctcctttaactcctctcctcaaccttatctctattcctctccttatctattcctctccttctcctctccttctcctctctactacagcggcggggcgcggagggccggccggcgcgagggcggcggggtgcggagggccggtcggcgcggcggtggctggcggcctcgcggcggcgcggggcgcggagggccggccggcgtggcggctgcggcatgcggtggcgttttttttttttggagaacttgtgattcgtatttgaaattgttgtgtgatgtatttgatttgtgtgtgatgtgaatatgtgatgaatttttcagaagttgtgatgtaatttttttaagattttgtgatgtatttgagatgatcgatttgtggatttggaggcaatttgaggatgattgatttgggattatggggacaggatggggtgaaatcaatatattaaaaacagtgaagaaaagaaaagaataaagaagcaaccggatctagcctctttagtcccgattggtaacactaaccgggactaaaaatgctttatctttagtcccggttggtttttactcccggttatttcacctgggactaaagatagcgtcccaaattcgtagtcccggttgaaaaaccgggactatataggggttacgaattgggagtaaaaaccacttctccaccagtggttgcacggtaattaatctgatccagcatgtttaataggataattaagattgtgacaaactgaagggttaatctgttaacagaagtgtaattgcacaagtgctaatcagacactacacgtgcatgtgtaaattattatcggagttggtgtaagatcgcttgctgattagcttaataataaatacaagctttagttgcttgatattaatatctctcatcatcattcatatcaatgcatttcaacggacgggcattttctagtatatataaaaaaacaaattcaatgtacgaatagtagtgtaccgttaacatctgaatttctctttttttcccttcatgtatagatcgaatttgaacttgatttttgatggattgatagatatcactatactctacatgacttcattttcatttataaaaaaatcataattttgtatcgaatttagaagaaaaaggtacgcgtgagacatcccctcgagaaattagaatccactcccattgctaaacctagcatcattttttttatatagataggagaaaatgagttgtgatcgtaaagaaaaataagaatggtgaatataaaatgctaaatgatttatgataattttattagtagttttgtgatattttatcttaaaatatatagttgtgtgataaatttattgttcaatttatagtttgtaatattttgattaaaatgtctgtagttttgtgaaatttaccaaaatgaatctggaaatcataatttatatagcatgataataaataaaagctaagctacattatttaggaaaataaaaaagcacacaagaaattaaaagttaaacttcatttgttctgtagttacaattttttctgcaaattttgttttagaacataaaagttcacattttcggttctatactatcaagagttatcggttactttaatagtatccaaagttccctctattccctctattccttttcttaaggactcccatcatgttttcaatcatttgccattcactttgactctgtttaggaagcttatgattattggaaatgtaagcaaccggctgggcagaatgtaaaaacatgttttggaagctttagattctttaaaaaaaaaagctctaaagaagaagctaagctagaaagtttttctagcttttagtttattttctaaatttacagctatagcttcttaaaatctagaaaaaaaaactagaatattcaagggagctattgattttagaagttgtatctaccccaagctaccctagacatgctctagaaaggcaggtttttcaccttctagcttctaattcatttttttaattttacaaatacatcttctaaaatataggcgaaaatatgaaaagtttgaagattctagaaaaaaaaaacaacagcaagaaaacccccatacagcacatttggcaaagattgactatatagaaaattccctttctatccaaaagggttgagcgtccatctatttctgtccccgtcccatttgtccgtaccacaagtacatggacacaccgatgaagaaatcatatctcgatctgtatatagtagaaacaactcactaaatcaagaatatcgagcagataaggaagatgcatttttgaacgatcaaaaaaaaatgcttcttctttgaagacctaggactgcctaaatcagtagacaaatttatccatccaagtccctgaagaatgcgagcgagctaggggtataaatacaccaccccgcaaaggggaggttccatggggaatgtgatacaatgtgctcgatataaattacaagatataattatacgcattttccaccatctcatgcaactcttctatacttgtaaaatgtaaaaacatgaaaacagtatatgcaactcttgttttatggcaactggtcatttctttgagccaaatcgcgttgaatagaggaaccacagaatccacattggagatataacaacaaaatatgcctgcagtttggtcagggagaaacttaaaaggtattccaacaggagtaacaccaacgagacaaagggagttgttgaaaagtactcaccaagcagaacgtaattatctcagttgcgaaacctctactgtaactattggatctcattgcatcctggagaaatatctggacctacatatatgtaattcatgaatttagttacatattcatgcgttggagtcacaggatagcaagttaaccaccgtcatgtgaagcccttttggacccattagaacatgttcaatcgtcaagacactgttgtatgtaatttttcttccacattatttatagacagcacatgagacatgatgtacaataagttgcttcctccgtttcataatgtaagactttctagcattgctcatattcatatagatgttaatatgattaagacagttaaaaacaagtcaaccaaatatatcaagggcaaaggactaaaagatgatattggaagatgggtaccttatgatgaaaattttgagccaataacatgaaaatcttgagttgtttataaggtgcagaaatacatgatcgggagatggatccacccaagaagaagacattaggcttatcaacatcgcgaatatgctggccacatattgccttacagaaccgtgatacctgtaaaaagttggaacatatgtcaggagcaatgacacaaaatcattatccatcaagaaaattaggtaccgctagcttaccaatgcttctacatcagtaatacaaagaacttttatggaagcatgaactaagaaaacttcaaggacttcgagtgcttagcacaatattttcatagataccatccaaccatttcaatatgttatatatatcacttatcagtatattttgcatgcttaatgcagctaggtgagaacatggtttgaattgcatacttacaaatattaataatgcatattgcctaataaataagaggtgaacacatatatgggttcaccaacatggaaacataatcatgtaggcacctcatggtagggtctgttcattgcttgtatgaaactcctgccatgtttatatgtatgagaaaagcaggactttgtgtatgatacccccataagaaaagtgccatgaagattcctgaaatactgcagataataaaaccatcaacaaagaactcttggaaatcagaaagggataaagattccagtttgcacatcatttacacaacaggtgattaatgatgtgtaaattaactgtggtactgaatgactgtagctcaatttgcataatgattctaagtgcctaaataaacttaggaatttaatcccattggcttataaatcatataagccaaaaatctgacttagaaaactaagccaataagcctaagtagcccttagtatggcagtataacgaattttaacataaataagtgaatgtagtcgtattttaaaaatgtaaataatcagagtctcagatgagcgtgtttaattaagctgtgaagaacaaatttctggaaggttttgataatgcgatacaagaccaattcacatcaaaatattgcaataaacttgtaatatttaggaaaagaaacatgcaaaatatatacattgtatttggaccgcaagatgcagaaattatataattcacaagtatatactgaacgcgaacatattaatatatataaactgtcaatataccttaaggactaaatcttttccaggccatttataagcagtctcggataacctgcttctttgatgaacttttgatgtcatcatctgcattcatttcacttgatgaataaactagtgaactacttctgcataatttatagcagcacaaatatatggtaaattaccttcgtcaacacaaatgcctgttcaagttgccgaatttggatccattgttctgcaattacaccttccatctgattcaaaaattgtgaaactaacagttgttaagcttttgtgagataggtataaaataaatctagtagcagtgtagcaccaatgaacattaaggtcaatcataacgacgaatggctgctttataagaatgttcagcacttcttatgtgtaagggtagctctttgaaaactaattctagatagctcaactgaaccacatagtttttgctcttcattgttaagacttaaaacaagctacagaagatgatttatatatttttttacaaatatctttattacaccatagcctcttgataagccacaaatgagcactttgaactttacaaaaataagcattaaacatgttattttcctctgtcgaaataattaatacaggtgacatgagtaatgagtcaaagaaaaaaaaattaaaacagtagcattcaaatcctacagagcatgattctgtttatctgatgacgaagaaggataaaataacttaacaaatttccgaccttgtctgaaggaaagtagatattactctattaaagattcaactgatcagttacataatacctttttgacttctgaactcagagattcaacccttttctcagcaccatttgctagggattctattgagtcagcattctcattcatctttctgaccactctccagaggagctgcacctgcacaggaacactgtcaggagtcacatgatgaattttccaattgaagtctgatctcatcatgttcaaaattttggtggagttttgtttgcaacttctgctaatttgcacttgtggaatttagaaaattctaaaaaatatatatatgctgacaagtaatttatacaaaatatgatattatgtgtgtgatacaacaaagacataattttccaatcttctacaagtttttgctcaaatagattagtgtggcatgatctacatttacatttttttcagaagtttctaaattacacaaaaattaatttgcaaatgtccctgggactagctgcaacttcctcataatattttactaatactaaaacattatactgaaaaatatatgtagctttagccagcagaatatagaaacaagtatatatatgtaatatatcatttcaaagatatgattatataatacacccaacaaaagagggaaacccaattatggcatgttatatcatggataataattaataaattattctaaagataaagcgagaggtacctcatcttccaaagctttcacattgctttctgggtaggatttgctttgagatttctacatccagagagtgtaaatattagcatatgcgaggaaagaaattatatgtacatcagcagttggacaaaatttctagaaagatgacaaatagttgaatacatcctactgcagacattttcacaataggagacataaaatcatcagagtaaatgctgaataagtcagttggatgggtcgtgcagtggtggttaaggtcaaacatacacattaagttttaagcaatccccactaacatgtcatctcactaagccattgaatttcaaatattgatagagaacatagaaactgagatcttttaattgtaaaaaagattcataaaaaatagtatatgaagaaaattatccactcatctacagatctactattgcagtgctcatcttatctgctccccaagtccccactaatatagccatagatatttgtttcggtaagaataatatgaccagctaataaacgaagttatacgagaacgatactgtacactcctttttcaaaaaatgtaatgtgtgcatgtagattttaattgatattctacttcctttgcccctatttatcacatcttctcttagctgcattatgatttaatactcataccaattattttctctcatatttcctttgtacttaagtatggaagacatgattatttcctcttcacttttttctggtttcatacccttcttcatctttgttcccatccaaagtaagtcttatattttgaagaggaggaagtacatagttagcaatgatacatccacaccattattcactttattagtcctaaagtggttttctacaaaaaagaattccatgatttttgaagaagagattatgtacagtgcaagtgatgtttattcatctacagcgagatggctaacttgttacagagcaacataacacaagcattcactgatataaccgcataccttggtactctcatatttgttcattaaaatctcaatatcatgttccatagttccaataagattgctgttctcttccaaattgtttgctttactcttcaaagtttttgtgttttcctccaacaaagattctggaacaaaaaatataaattttgtaaaggttgaaggatgatatatttatcaaaattcaaaacaaatgccattggctcaatcagcagtaaagaattccagatgcaattaaactatattgttgacagtgtcaaagaagcttcgtaagttagattttgcaaacagaactagagcataaagggtcaaaaacatattggaaaaccattacatatggtgttgatatgatatgctaccaggtaagctatttcgattcaaaggagaatacaatgtaaatgtgtgaccacgacgcacagccagctgcagaaaggcaacgactccagcacagcagcagcattttcaaccaatcaggatccggtaaattgattctttcatctctagttctctttgttgttaggattagttaactattgcaacgatccagtccatatttactattccattacaatgggtgttaggacactcggtatgtaatgtggttcgatatcattgatcaggaataaagcaaaaggagattaatcaatctaagtattagatccctattggaaatcccagcatctagcctattctctcccctagctagctagtaaataccacccagctatgacaggctgtcctcccggtggtgtttatcccctaaggatccaataacatattaacatcacaggcaggtaacagtctacagttaggcttaattcaactaagtctaggaaagcttaaccggtctcattgtgatagattgaattcaaccacagaatgaaccgacaacgaataattagaaatttgttcgtcaatagcataccgccatgaggatcatgtttatgggtttcaagttttatgaccaaacccaactgcagaagagtaaaagaccaaatcaatggatttggcaagcagttttaaaatcataacactaaccctgcaggtacaaacaaacaaaacaggaactagaatagcataaataactcacaagtacacaaaatagccagaagaatcacaatcattcaggtccttgatccactttttacttcttggtcagattatagaaaactcattgaattgtgattcttatattcatataatgcaaaaaagtacactgccaataaatttaaatgaataacaaattataagtgcaatggaacttgaaacagagttttcaaattctatgttagaaacagttgtacttttaaatccaattattgtggaaacgtttacattacaaacgattaaaactgcaaatagtgttacaaattaaaatattataacttcaggaatagcatataatgtagaaacaatagcataaataatccctgaacctggagtcaatatcgaaagctgaaataagtacaagcattggtcaaataacattgtagttccaattctgaataagtttttttaaaccctattattcagacggtgtgattcaagcaaagtactcgtcgactcgtcgtttacttagtacgcccacgcaagttttcgagcactaatatgtcagtgtacgcacgatgagcacaagacatttcaaatctaagatatggcaagaacaccaaacagcgcgcaagaaacagcactctgccgaggtgggaaaggggagagggccaaagcaagcggtgcctcacccaaatgcagaaccctgagcctgagctcgtcgacctccgaccgcagggcgtcggcggggcgcgactcgatggttgcggacgcggcatgggtggtggcggtgaggagcgcggcgactaccacgacggcgagcagcgccacctcttcggcggagcggcggcggggcgaggggacggagacggagggcgagatgcgtagcccgaaaaaagccatgtggtggtggaggaagaagaggaccgcctccgccgcggcggccatggttttagggttttacggctggcggccaggggggtggcgggggtttgcgctctccgccgccgcggcggtgtccaaatatgagcgggaggcgacagggggggggggggggggggttgagttattaatgtgcactggcagcttaagcttcactttcagtaatcttacattggaaatctataaaaggtgaaaatgaacctatttttttttggagggatccatgatgaagttgaattttgtgcgcattttgccaaaaaaaaaccggggtttctttggccagggtcctgctacgattttggtcatcaaatgagtttgcatttgcctgtcttttttccaataggaggcaaagtgacaaggcaatgaccatatccactccttttggtttggaaatggaaaacatcatttcaggcctaataacttggattccttgggtgcccaccacctaagcaccacatcttattctttcctaggtaatttaattaagaaccccaaaaccctttgggccgttggaagtgggccattcctttttaaggccaaattgtttgtttagcacccaatagaatttcttttaaaaaagccaaccaattggtttctgctttaaaacaaccaatagcccaccttttttttacaggcattaagtgtgccccttttggaaaaatggaatacaaaaatttcccctggttttctttacttttggaagttaacattttttttcaaaacgggcttttggttttttccaagggggaattaa

SEQ ID NO: 4097 - DNA, 7601 bp, Oryza sativa
  unsure (1)..(7601): unsure at all n locations
aggcgaggttttgaggcccccgggataaaccggagatttcacacggtcagtgaagcggggcgctctaagagctagatatatggcgcgcgatgctagtacgagggatgaggacccgaaataggtgcgcacaagagcggagaaaaataagaccggagagcggagagatgggcgggaggatcggagtgcaagagccggaaaagagagcccctcgttaacgcgcctttaaggggagcgataagcgggggttggacagacgttatagggcaaacgagcaggggtggaacgcgcgtaagaaggcagtttggaaaattgagtacgcgacatgaggtgggcatctaggcagaggtaggggacggttaaggacgggtataagggagtgatgccaagcatgcgccggcgtgacccagtttgtggcgattgtgctcagctttgtggtcaattggtggcagcgtccgagccagtaagcggggttttgcggacgagacagcgatggttgggggaggtgagatcgctttgtcagaggggaggggggtggaaggagatgaaaaggagggaaaaagnaaggnaaaaggnnngggttgggggagtgggaggtgctggcccgccgcgacgttgactcatgagatgagaaacccatgccctatttgcaatcccgaggatgtcgcgggtataagttttgcataaattttcccagaaagttcaaattctaaatcaaagaagagataaaatgctcgtacattatatgaatatttgtttgactttaatattcatcctactataatttcatatgagttgacttaagcctaaattacaacataagtcactcttggagtctttctctgtgccatcaagtaaacccctctctactcatctagtgcaaaataatatagtcgaccgtttgctctaagagcaggtacaatagtagactataagccggctataaacatattttaatgaggtaaaagaagagatataagagcagcgggctacagatttatagccagctgcagcacagactccaagatgtatgtgtgtataacatctgggacctgacattaattatacagtacatgtttattggtaactattgtatcaactagctattagctaatttggagcccatagttggctgtactattaaacttgctctaattgatatagatagtatgttatttaagcaatagttaatatgttatacgtacaacaaacattcaacacttttttattttttaatcaagctaatctctacttccaagttactagccaccacttcacgttcatattatactacctatgtcccataataattatatttttaggaaattaaagacatattaacagcaaacataatttaccacaataaccctatttaataactatattgtatgcgtatattccatatgtatacttgattaaaaggaatgttaagcgacacaccatatgtaatcttaattaaaaggaaggttgtgggtacacattccatttgttgtgtcccatcttattagaaatacaattttttttgacaaattttgcatgatagaaatacaattattataggacggaggtagtatttttcattccttgttgtgagcaacagatgggtcatggcaggcaaaatacctctacatgcacgtagagccagtgaatacttgaagccggcgacggcgcggtggaagagccgttagcgagggaagagaggatgtggcgctgtgggtggggggcgcggtggcacgatggtcggcgaatcgcgggcatgggcgggttggagattggtggcggcgattatggagtcggactcgggaggggaaggggaacctgcggggtaggaagaggttggaggtgggatgaatctcaagcattggatttaatatggacaatttgaaccattgcattgagtgatgaatgaaagatagataaatagatagataggcatagagaaaattcctatatacccttaaaaatttactcaatccctttaatacccctgaatttgacctcatcccttatatacccctgagttttcattttgatcttctctatacccatctccgttagttaaccattagttgaccgttaaatattttaaaatgactatattacccatcctatacatatgtggtacctacccaataaattttcatatgaaaaaattaacttatacaaaatacaagcaatataatcatttgatgcccaacttaaaaaataaaacttattattttttattattttttaaaaaatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattacatcccctttgtttttttacaacgaatctttttttactaaatatttgttgaaaagtaattttcaaattttatgcagaactttttttacaataaatcttttttattttcatgaaataatgttttgtttttaaaaattcataacaaatatttagtaacttattccttattggttttcacaactcaaataatttacacataaaacatttctagcttttaacaatataccaaggacaataaagtaatttcttcaataactaacggtcaaactaatggtcaactaacggaatgggtatttaagggatgcaaataaaaacttaggggtatataagagattaaacaaatttatggggcgtagaagggattgggtgaaattacaggggcatgtaggtaattggcccataggcatatgcttgtggttatagggcttgtttggttctttaccctaccaattcattggtagtgccaaagtctagaaaaattttggcactaccaaaatattggtagggtaaaattatttagctaacatttggattgctaccaatttaaagccaaatttttatagcatagtgaagaaacttctagaatatgaccaaatattttaggggcactaccaaatatttagtctcaatccaaactaacacacaaactattcaatttgccaataaattggtagggtatgtttttggcatcaaaccaaaacggcccatagttttgtcaaggtctaagatatagaataagtttagtaaaaggggtaaagtgtaaaaattcctgccaccccaatccttctcccggccgtacaccatttcgttccgacgcgagtaattcctccccacgggcggcgactagggcggctagggttcgtcgggcgccgccgtgccggagatcgcctctcgccgccgacacccggatctccgccgccgccggtcgccccaggttatcccgctcccgcagtcaccatcccgtcttctccgccagtcgcctcacgcccggcctggacgccccggaatccattgtcggtctcgccccgccgactgccgttgacgccactggctgaaggtaataagccgctcacctctccctctccccctccccctgcgagctcatggatttaatccattcgctcgtgcgtgttctccgtacttgggtgaactaaacctagttcgtgttctccctacttaggtggagtaaaatagttgaacgtttgttctctgtacaacaactgtcacctatcttctcatttaggagcttcgatttatcctagaatgaacggaaccagcggttttggatgagttcagtactgtggtactcttgttctcgtggacgatttagaggagccactcctgttgagaagaattatatttcatagttccccgatggtaatgaatcactagagcccgtattttgctagtatatattgattaacttccacaaatgtgaaggataatcatggtgcatagtttttgtatgtcaagttttctcaatcaggtggcagctgtattgcttgctagtaaaaatgttgtgctgattggttgtttttaaaggcgatacgcagattggttgcttttcttagatgaaattctgattggttgctagacaagcagtttgcccttcaaatgctatggcccacctgcaaacgccctagagtgctttggtgctctaatctaaatgacctaggaaaggattaggatgctgttgcttaagttgtttgggctgcaatggatacaagttagttagggctggaaatgatgatctccattttcagaacatataaggctgggaatgggccttggcctgtcaccaggccttcaaatggagaatagacaaactatgtcgacttattagttgtgttttctcttgctcttcttttgtctgtaagtgttgggtgttctatttgtttttatacggaattaattgcacgcaaaaaaccgagtgctcacttctgcaacgttctaatggttgcgaccttgggtcgttctcccggtggactcgtaccacaaaatccgcaactgccgctgcacattaatcacttcctccttgatttttcaattttaaaattgaggcccccccacccccgcaaacgccaatcagatggatcggaattccttaattattgccgaattattatggaatcctatgggttgtttgtcgtacaaagccctttggaaacttcattttgctcagcggaggacatgtgctggttagttacatatggaattataagcaggaaatcagctgcattttgcattctcgttagtaagattttctttttatataaaaaagaacccatattaggaccgttatctcgttctcaccccacagattgcgtatcttctgcttcttcttcttcttttttttgctaaactgtgaaatcatcgagaaaatcccaaatttttaatatcatttttacagtttaagcttcaaaacctccaataacatgaatataaatgtttatccataagatttttttgttagttcatttgtttttttgtcgccttatcaatgatagttcaaatgattagagcttagcaatccttttttcaatttatactctcattttccacgtgtttcccgaattgctaaacggtgtaattttcttttaaaaatgttccacaggaatgctactttaaaattatattattttttattttagttaataattacttaatcatgcgcaaataagatacatcgttttttttcgggagaaatgggctagcagcaatgttgcaagctactacatccgttttagattataagctattttgactttgatcaaaattaatctactctaagtttaatcaagtttatacataaatatactaatatctacaacactaaattagtttcattaagcttataattgaatatattattatagtatatttgtattgcgttgaatatgtgactacttttctaaatttaatcaaatttgaaacaattttactttaatcaaagtcaaaatgacatataatctaaaatagagtgagtatctctgtagggtgtgtttggataataggaaatagggagtgagattgggattgaaaattgaatgaagagttaggattaaatgaaagagagagaataaatggttaggatttaaatatgtttttagtaggtgggaaatcatttccatatcctattagccaaacactggcctaagctaataccaacattcttcaggagctggatgcaaatttggcagaccaagtccaaaacacgacagccagcagcagcagcaggacaccaacgcgacgccaccacagtataactcgacgcccccactcgctctcttccccaacccaatgacagcatcagtattccagtagcagcggagagagagagggagcggccaaccaaaagcccaagccaagccaacgccgcgtcgcgtctcagccagccagcgaactgcctccccgcccccgcgcttgccggcgaactccccccacctccggcggcccggccccgcctcgctccccggcatcaggcgatcccccccatccccttccccgccccctcccctccccgcgcgcagcattcgcagatcgcatctggctcgctggccgcccgggccctgctctcgcttcgcgtgtgatgtgatgtgatgtgatgtgatctcttccccccatctctcgcggcgggattttctgggggattttgtttttttttttttgttttttcttctcgggatttatgggggttggatgggatgagatctcgctgccggacttagggatggagtacagctgaaatggcgccgtcggtgtagtgtgtgtgtgtgtgtggacagcgtgcgccggtgtgggggtagttgtgaattagcggtggtcgtggcggcggatttggaggggagatctagcccccgctcggtgcttcctaggtttgttttcctaggtcgtggacggaattgaggaggtactgattcggatgagggtgtcggtagaatacggcgttccggacgacttgctggttgctgcttgttgtttcgggttgttgagttgactgtagctgagttgctgatccagttcgttgtgaattatgcgctaatgcagtggtacttctccatgatgatgattttgcctttttgtttccccttattattacatgattcctcagtacaaatgagcaatcattcgctttgtttgctttggagtatggatattagtggcggtttaattattgtggtacacagtggtggaaggattgcagagttatatatatacctggtggaatttggattaacgagagctcaataacaaccacattgtggttgatttggtcacctatagtttcctatgagcatctgagggctgactaattgctggactttagaaattagaatagctgttgttgcttattgtatttacattgctgttgttatattgttcctatatggatttgtaggctacagctgtaccatattttaattgaaaatgctccaattacttgtcagatatgattcactagctgcatatgaaactttaggagaggtctgagttgtacatggccttatttttctacaatttctctgcacaggtgtgaatatgtcggacagtgcgttgaaagatctgaatctagctcagtgctgggacttcacctggtgactctccctctccctctccctctccctctccttccgaatggtgacgatttgcgcggtcatattttttttcaacgattcgtgccttctcgatgagcaattttggatgatatttctcctaccggagtgcatatgctgctgtggtgctgtgctatccccgtgttgctttcacctgcgctcgtggtgttcgacgaattgcctaaaagaagcatttgctactgtttatgctttctttggctaggcggcggtttcatttcagtttccctgcctatcaatgtgttgcgcatacttccttatacctttttttttacccccaaattcatgcaaatttgagacctattgatactatgatacatagtatagggcaatgactgctattttcgaagcattttgaactgaatcggtgggaatacctgattattttcatggagtaaatatcctgtcgtaattggtaaagctattattttgcgagggtacgcaaagctttgttctcaatgtaaacccacgacctgatggatcattaaataaccccctcccattggggggtcccgaatccctcgagtctaggggggcgtgntaaaggaggggntgtcaaacaaannnacccggcg

SEQ ID NO: 4098 - DNA, 5777 bp, Oryza sativa
  unsure (1)..(5777): unsure at all n locations
gttgtttcgggttgttgagttgactgtagctgagttgctgatccagttcgttgtgaattatgcgctaatgcagtggtacttctccatgatgatgattttgcctttttgtttccccttactattacatgattcctcagtacaaatgagcaatcattcgctttgtttgctttggagtatggatattagtggcggtttaattattgtggtacacagtggtggaaggattgcagagttatatatatacctggtggaatttggattaacgagagctcaataacaaccacattgtggttgatttggtcacctatagtttcctatgagcatctgagggctgactaattgctggactttagaaattagaatagctgttgttgcttattgtatttacattgctgttgttatattgttcctatatggatttgtaggctacagctgtaccatattttaattgaaaatgctccaattacttgtcagatatgattcactagctgcatatgaaactttaggagaggtctgagttgtacatggccttatttttctacaatttctctgcacaggtgtgaatatgtcggacagtgcgttgaaagatctgaatctagctcagtcagcagagctggagaaaaccaaggacagttctgccaagtcttgcatcaccaagcctgtcttgaatggcaacaaatgcaacaatacggaagaaaatgctccacctgtactccctgatgctgtgactaatgggtgtgaagctggaaatgcagatgttgagtatattgattctgagagtctgacagatcttgaagatgctggtgcaacccttagtgtatgccaccagatgtttatattcatgatcttttttgtgcttggcatttttctgattggaccagccctaacatttgatcatttcttactgcttgatagactttagttgcaaggttggattcaaaagactgggttatgacatgtgaagctctaaataatgttcgtcagttggcaatatttcacaaggatagattgcaggaacttctgtaagttgcttaccttgttattcaatcaaaaggatctttgtttttgggcaaatgttacttatccatgcctgaagctatagaattacatcattctctgtatcttaatttttggatttgaattatagggaacctctagttcctcttatcatgaaatctgtctgaagaaattcattctgttttttttattggacccagttttattctcttcgattgcttgtatctcaaaacactcaagaatccaaggagcgctgcctgtaaagctgcactcatgacctgttctaatcttaatttttggatttgaattacagagagcctctagttcctcttattgtgaaatctgtcaagaatccaaggagtgctgtctgtaaaaccgcactcatgacctgcgctgatattttcaaggcatacggtgacctaatggttgactcaattgatccactggtgtgtgtttctcagttctcaaacttccattcacaattacactagttctttttcctgtactaactacgctatttctcaaaacatcttttctgccaaatttgttctcagttagtgcagctatttctgaaatcttcacaagataagcgttttgtctgtgaagctgctgaggcagccctcatatcgatgacaagctggatcgccccttctgctctgttaccaaaaatgcaaccttaccttaagaacaggaatccacgaattcgagcaaaagcatcaatgtgcttcagcaagagcgtcccacgcttggtaagtgaaaatctcacctgaaatttattttaagctaaccgcttttgttttgcctcaactgttatctgattatctcctaattaacctaggagaggccaaagacaaactcaacataggatttagctctcttttctcacattacaagtactcaatgaatatcttaattcgtggtcttgttggttggcttagagttaacacgcagttttctcgaccttttttagtctatttagatatgcagatgcgggatgaggtttctgtattataagacagacctgtagcttttccaaaactatgggctagtgtgtttggtagagattctatatgccgagaataattagctgacaaatgatttttacctgtggccttttacttcgaggaacttcatctaccctaaattgcctggccattattagtagtgtgacggtatctggaatttttttttcttaattggcttttatgtagtttgtatatcaatggttccatgctctaaccaatgctgataacatcagttttagatgttttacttaaattgacctattttgtttccagggtgtggagggaattaaagaatatggaatggataagcttgttcagatcgcagcaactcagcttagtgaccagcttcctgaatccagggaggctgctcgcaagctggctttggagctacaagcattctatgagaaatcccaagcttcgagttctggtgaagttgacgacgcacctgctacctcacctgatgctgatgctgatgctggtgctgaatcatgggaagctttctgccaatcaaagctttccccattaagtgcacaggcaatccttcgtgtcacctctacgacgaaagagggtgtggctgtgggtgtcacctctacccctccgaaagaaggcgtcactgttggttgctagcatcaggaggtagtagatgcaatgaggttgtggtttttccatccgattcaccttttgctgtacatggttatggttgttctttctctacatccaatctgggattcgttcgttaagcatcggttcgagagttgaggtgtgacctgtgggtgttaatattggtgcgagatatacctgttatagttgactgtatgatcttccttttctcccactgcttggtattgattggtcaggcgaattgtagaatttcttccactattcaatattactacacagtaatttttccatctcgtggccttgtgtttatttgctggtgttcactatttcgtgtttttgaattctaacttcttccattattcaatattatcgaatcaattctcatcagtgctttcttccactggtttctattttactgaaatttttatgctgttctatgagcaagaaataactaactgggctcaaccaactggtactccaaagaactgtgacttgtgaagtttgatcactgtacagttgtacatatgtcacagactcatagtacacgttaaacatcagagaaccccagattatcacagctgcacgaagattaagatgatcatgtatgcatgcgtcgccggcaacacattctgtgcacagagaaaaacttggacaagaacatgccaacagctagcccatcagccggcgatcaccgccggcgaccggccttgccgcaccggacgctcagccaacgatcatcggcggcggcgtcgccggagcaaccagcatgaggtgcgccgccgggtgcagcctgaacaccaggccgccggcgcacccgaccgtcctctcctcggccatctcacgctcgatcctcgccaggacggcgacgaactcgccggcgtcgcaggggagctcgagcgggccgtccgccacgtacccgtactcctcctcggcctcctccagcagcgccctgaacagcgggtggttcacgcactccgtcctcaccacgaacctctccctcgccgcccctccgccgccgccgccgccgccgacgtacaccgcgaagctcccctccggcggctccggccggccaccattcctgtgcttggacaaacacctgtccagcagggccttcatgatcactccctgcttgttcctcacacctctctccttcatcaacacaacagcaaattaaccaaagcttatctgaacacaactatcctatctaatttacaacttagtgaaggttgggttgtattaattagctgatcaagtgttgctaattgctatggccttgtccttaagtgacatcagatcaaactgagataagatggttagtgatcaaagttttgggagggggtcagctaagacctggcctgaagaaagagtgttgcacttgcacccctgcaccatatatagactgtactgtgtggggccttcattttattttaattatttggtgtgtgtgacaattaggagtaagattgtatatttggtgtagatgatgagatcctgtgggtctttcctaatcctacccatcattagatatttaatccatggttaggttaatttttaccatcttgtcctcatattgcacaagggacctgttcttgacaagggttgtgttggcaagatggcaccatgttttgtgaaaaccagattatattgcaagggtaagttagtaatttcacatcacgttgaagacctttgtgtacttgaccgtggtaccggttcaaagtttaggatggaattgacaaaactgaaaatttgtttagtgtgaagctaaaatggctaatgcgaaaccagaggttggacaggattccaccatctcattgtcaacccacttaatatccaatgtcatcagggcaataatacacatgttagtataagatcataagaaaaatgtcactttattggttgcaagttgacttggagctttgcatcggtcagcaagtttaagtgaaactctccaaccatgactagtttactctaatgaatttccttcttcagaatctgccttttcatttctgtcagcttgcatcgagatctgtctgaaggattcagagaacggcacatcgacatcctaaatctgcccaagggtttaacacctggatcaatgcatgtcttaatcctatgagattagtttagaattcttgtcttgattaatggtgctctaatgacaccttgaccgacaatgagcaccacttgtcttgatttttgtggtgcaaaatgatactaacaaacaatagtaaagtaagggttaatttgggaggtagagtaaaagattgttcgaacaagacattgtttagattagataaaatcataaaatacaattcatttcgtcgtttagcgtgctagtctacttcaccttccatcatccgctcaacggtgaaattttttttatcgcccaaaccagctattattaccgcggaattgcgtattctactctatctttgtcaaatcactccacgataatctgcttgttaattcacctggtaatgctgtcttttattaatttggaaggttggaccccctactgcaaatctgcaatgatgcagatttttcatgcgtgctgaattttgtgctctaatggtggattgtgatagcgatttgcaccattttgtgcgaagaacttacatgaatcagatagatgaaaaacctcgagctgtcagatgatgctggagaggcatatgctattctcctgaaagctcaactgcctgaagtctgaactctgaacatgttgttcagttggcctcgttttctcacctttgctggaacaggggtaaataaatggtgacgaattgataccagaagaaagtgtggtaattaattaattaaaaagcataattaacaagctcaaatcacgatgctcaatataataattactctttttttttgttcttcctcgaactcgaagaacgatgaattaatcaaaatacctccacccccaaaaaaatcataatagctcagaaaagtaacacatcaagattgaactagaacattcagaatgacaatattgcaacacatcaaatttatttaccaaataagatnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4099 - DNA, 17347 bp, Oryza sativa
  unsure (1)..(17347): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgtcggagccctcctattcgcagcaaattagacaagcagatgttcatctaaagcgttgggggttagaaatttcggaaactgattggtctcgtaaagcgtctccctccccagactccagagagtgatgggatttgggggggggggatgattatgctgtacaagagtagtttgatagcaatgttagtggtagaagtgaataatcttgtatggtctgatgttgtgtttgctgggatgttgcataatggtgtgtctctttttttttactgcttgtgtaggtttttgtcatattaatcatggtgcttagcaaggttgaagtgaacttgataaggctgcttgaggcagctcctcgacagcagaaccagactaagcttgtccatgtaagtgtacctcgtacggttttttcttagatacgaatttttccatcatactttgtttatgttaataggctaattatatacctttagttaggagaacaaagaatccctcaagtgagtatttttgtgtgtgtgttgaaagtaagaagggaatatttctggattacctcatgtgtttcaattttagcacttactagtagctaatgcatgttctttttaatcttcttctctatcattttgaatggaatctgtggttgcactgagattctccaatcaactgcagtatgtaaccacagccagggaactgttggagcagctaggatcagaaactactccagaagggatatcaaggtattcattcatgttttatttgttctctatagcactacacatatctttgggaatatcgacatgttggctgtagtataatcttcagtctgtgacccagctataatctgttgagcatccatacttaaaaagcactccagttagtatatgacaaggcaaaaaccaccaaatctctgatccaatataaaactgttataggtgaatctgatctctagatcctacactgtatttcatgacactaatatgaccaattcagtgaattgttttttttgttaaaagactactggatgctaattttgtttacatgatgctgctagtttgctttggtggatggtgtgttcatactttcaacctctgtacatgaatgaatcaggcataatctactgtaatactattcaatgagcgcaaaaatttgatgcactaactacttagctacacgtatcttaagttagttcctagtcaataattgatcttcttctactagtataattctttagtatgcaccatgctttcccacatgataaatactctgtgggagagcattgcatattttgtagctctgttttcatttggtagcagttgttcttgaaaatctcaatactcctttaaagatatgcttttctgtgcgtgagaaaagaacagttatatgaatgtttacaacgtaaattttagtcaccttccttcattttgatgaacctcagtttattatgtagattcctggatttttgctaccttttccattagcaatcttataccttgtttaattgtcctgttacccagtggagcagagcaagcatttacctacattgagttttctttttttttttgtgttacttgtgtaatataatatttttccccatgatcaaacgatgttcattcatgaatttcttctttgtccagtgtatcaaaagctaagacaagtgagtattcagaaaagattgaagcattggctgcccggcttgctgctccagaggtatgctgttgtcgtgctaatatcttaaattcctcaattgatacttcagttctttttttgggtgtggggaatagttcaattgaatgcaaaaccaccaactgcagcatatggtttacttagttttttcttcaaacaaaatcaacttacttttcagaacatatgcagccacaataactcagatggattatacttttgtttgatttttcttttgttcagccagaaaatgaaatgccagttgatgagaatagagaggtagaaagctcttatgaaggagataagccaggaagtccaatatcattatcatcaggattacgtaggagaccaatgtaagttttaaaatttgtatgtttctttttcataattattacaattagcgagctaataatggatgtaaattgaatagagctcacaacgttgttggacctagcagtcatgagagaaaagacagagacattggagcacctattaaattggatgaagaagcacaggctcatattgagaagcataggtacattaaactcttctgtatcggcaaagttcttttctttcctggtctctggtttagcttctgcgttattcttagcggcaaattcccttgttattttctaaactcatcttctaatcgcgcaggaagctgcaagaagatctgactgacgaaatggttgagttagcgcgccaactgaaagagagcagtctcaccatgcaccaatctgttcaagaaacagagaaggtagtatgcttctttccttcacctctttttcctgcagctatggtatgttgacattggcaactgtttgggtagatccttgattccaccgagagagctgtcgagcatagcttggcgagcactgggcgtgcaaccacgcgagcggcagaggtatactcgctggcttccaagacgacatgcttccagtggctgctcatcttcatgatgacctgcatgttcattatggtggttctgctcatccgggtcacctaaaatattgtaattggtgttgtttgagactgactgattgagttttgtattcagttgtgacaatgagcatgaacggaaacgaagtaaaaaaaaagtttggagaacctctgccccttggttgtcaccgcaattccttatccagttttcacataaatatacttgcattttggatatttatatgcagtatattttcggtgcaaattagattatggagctgcttattttggctctgacgactctgtgttgccgaagcacatgcatatattacaaactgcatatgaaatgcatatagtactatagtagcactttctcagttttatgttataagactttcattggtttcatattataagacttttattgaccacattcatatatatatatacgttaatgaatctagacacacgtatatagagtcattaacatttatataaatgtggacaatgctagaaagtcttatactccctccgtattttaatgtatgacgtcgttgactttttgataaacgttgaactttcatcttaatcaaaaaatttatgtaattataatttattttattgtgatttgatttatcatcaaatgttctttaagcatgacataagtatttttatatttgtataaaaattttgaataagacgagtggtcaaacattgattaaaaagtcaacggtgtcatacattaaaatacggagggagtagtagtgtagtgccctttttaacgtggatgggctgaaaagcccataaaattcacgtggcccatcaagtcaccatcaatccatctccaattctccatctctcgtgcggctgtggcgttgagctgagaagctgagcacccaaaaagcagcgcgcgcgcgccggccctagccacgacgcaccacgcgcgccggccgccggcgaggcccacgaccgccgccgcacgcctttggccagatcgcgcaggcgagatcctcctatggccgcctccgtagcgccagcgtcgtcgtccggctgggacttcacctggtgactctccctctccctctccctctccctctccctctccttccgaatggtgacgatttgcgcggtcatatttttttttcaacgattcgtgccttctcgatgagcaatttcggatgatatttctcctaccggagtgcatatgctgctgtggtgctgtgctatccccgtgttgctttcacctgcgctcgtggtgttcgacgaattgcctaaaagaagcatttgctactgtttatgctttctttggctaggcggcggtttcatttcagtttccctgcctatcaatgtgttgcgcatacttccttatacctttttttttacccccaaattcatgcaaatttgagacctattgatactatgatacatagtatagggcaatgactgctattttcgaagcattttgaactgaatcggtgggaatacctgattattttcatggagtaaatatcctgtcgtaattggtaaagctattattttgcgagggtacgcaaagctttgttctcaatgtaaagccacgaactgatggatcattaaataaaccacttccattggcgacatttagtttcttaagagttaagactggaagccagaaattctgtaataatttatcgtagtgttcagagttcagacaacacagaagaaatgaaagtgtgcagcatctgttaggaagttacaatgatgtcccactgacgcacaagcaaatttgctgggttatggaaattagagcagaatagtgattttatcgtttgaccatatagtgttattaaatgatgtattttcatgagcgaatgatcaatgccaaaaaaaaaatagcttaaaaacttgtggcgaatggctgtttcatggctatagtctcacaaacccagccttgcagaaaactcttggagctagtagtaatcaacttgatatatgttgcttttatgcatactgaatcatctgctacctttaatcatcctgttcctcagacattgctacttacgcatagtattgcatcaactatgtagctcatatgtagagaaaatttatcttgcactaacaacctttttgtatggcagtgactttgaaattgattatggatccgaggaacgcgcatccatagtttacaaaacgctagctgttgataaggaggtaagaagttatagtacactttaacatggttcttgttttcataaggagtcccaatgtttcctcttttcttcatgctagcttgttgagaaaagaactcgaatcctgtggtatttatcttgcagttgcaacctgacaaggtaaagagggagatgtctgtttctggtggcaagctcgtcgtgtcagtaaatccattcttaacaattgctatcgattgtgtttactttgattcacgatgtgtactgatacaaaattttctgaatctaattcaggcactttgaagctgtagaggctcggttcctgcgagcatcgttcagcgcgttcgtcgatcttacagtactggttaccaagcttgttgaagaatatggcatcagcaaggaaggagaaggcagtatctagctagttttactcccctgtatcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtcgccttaaatgaaaaatcatgcatgtatagctcactgtattatataacctgataatgatgatgatgaatcgtaaaaaatggacggaaatccaagaatgcttcgtaaatatatgtagctgaaaataaattgactcggataaagctaggaaaaaacagaaacaaagtctcccctcattaattaatttagtaggaagagaagatgacaagagtgctatctcattgatagaaaaatagaattggcggaatattactccctccttccctaaatatttttgatgccgttgatttttttaaacatgtttgataattcgtcctattaaaaaatttaagtaattattaattctttttctatcatttgattcattattaaatatactactactatagtttttaataagacgaacggtcaaacatatttaaaaaaaaatcaacggcgttaaatatttagggacggagagagtattacccaacaatacaattaaacacgacgtacgcacgatcattagactcaatttaaattacgacaatacaattagccagtctctcatagccgaccgatcagctaagcgacatacacgcgtacatgcaactaaatttaaattacgacacacacaaaacctagacacacagcaaactaaatttaaattgcgacacacacacagaaacgaaccttagctagctctctccaacctcactaaattgaacatgacacgaacacacacaattagtacagctacatagtactacgctactactcctatatgggacacaggtgcatgcgtggcacggatcgatcacactagaaaatgatcgaactacgaacgtcggcctgcaggaggtatcttcctgggcggcgtagcgtccctggggctgtccgacttgatggagcacagctcgtccgaatcctcgccatctgaagtccgagttatgatcaagtcgtctatgtccagatacatcggtggcagatctgcaaagtttattaattttacagcaattaatgcatgcaataatcaagtaagcaattgaagctatggcaataatgcaagaaatcaagaatcaagaagaagaagaagaagaagaaagctagaagttatataccgtgtttctccctctctcgttgtgtttcactcacgctctgctgcttctgggatgatgaggatccctgactttgctcaccttcacctccatgctgctccccggtgcccttctttctaccagacttgagagctaccctgtgggccgctagatttcctgtaggttccacagccaactcacaggaatattaattttcttgacggggttacttatacccacagaaaaattgtgttatttttgtaggttttcacacagacccacagaaaaatagcgctgacaagtaggcctcaagaaccatcaaataaaactcaggcagccaagtcccaaaacctaattccccacccctcttcccaaaccctcgagccgtcgccgcccctctattctctccagatccgcatggcgagcgcctgtgcgataccttcgacgaacggcgggtcggctaccgagcctccgcccagcgccatcggcaagatgcagccgaccatcaccaccatctcctgccggcgacgagcttccaccatcccctccactgccggtgctagccaccccaaggcccaagctcagaacctctagatctggatgccccaaccctgggaaccacggatccagccgtatcgagtgtgggtgctccagatctcgcggttctcggctccggcagcgccggcaggagaatgggcgctgcccctccttcccctcctcttcagtaagtaaaagcatccaaaaatatgtgtttcaatggtgaggaaacggtttggagcacctctgtccatgctagcatgtgtttccgctgctaatcccaaacaccgatttgttcagatagccgccggcggagatttctaggagttcaatttaatctgctccaaagttgcagccaaccattctccttcaggatgaaaaagtgtaagtcatactagtttacacttgtggattattttggctttgatccgtattacgtgactgcccagtagtagatctagattgggttattggcccttgaccacaagtttaatgattgtcagtggaatgtcagtagatctagattgggttcttgtgtcaaaacctgcgttgctgcattcatcaactaatctagattggattagttgatccattactgttgttgccaattattattttttctcagagctctgattcccagatattaagcaagacaagttggttcccatattgtctacattatgtgatttagtttctataatagaaatttaattttcttggattacttactcctagagtataatatttattttacatctaaatgatttgtttcttgtttcagccttgtaagacaattatgtctggaccaactaattttcctctagccattttgtgaagacctaatgttgtggcatgacagattgacaggtactcccacactagagtccctgctattcataaaactttgtttgtgtctggtactgagttgtttgacatggaattaatctatcagtggattatcatgcactatgctttcttggtcacatttagttagaatgcagatgcttttcttatgctatttttaccttgcaattcatggtaaggattgtgtgaataatgagtattatagtgttttattttctctgttttagtagctaagaaaacatatttttagctcaggttgtatgcatgaaatcattagtgctttctagtctctactagtgcatatacatacttcacaagtccaagtccatgtatatcttttggcaagtcacatactgctacatgtgttggatagatacatgccatcagaacaataaattagtttcagtctcttgtttttaaaattttcttatgtacaaaccctttataatttaccttgttcatggcactttgtatttttcttaacaggccatagcttgaatctttaagtgctgcagttaaatatctacagaacgttgcacatgatgaaaatcaaggtatgcttctcattcagtggatgaaatctttcttagtctaagatgtcctagcatttgcaccatgaaacttgtcatttaagcatccatagaaaatgagtttgatcctattatcctagcatttatgtcttatctgaattggcagagtactacaggaagtattttcatggtcacttttcatttcagttgccatatttcattttcatgctttgtagttgacaaatttatgttgctcacttcagtttttcctgtactaatctatttgtttctctataactggggtattcagaatcattgttatttattttgtaatgaagaaaattatgaaattgaacctcttttttaaaaccttttagcttcctttgcccaaggttgaagcaccacggaacacggactgctgctggaagacaatgttcttttacatatgtttgatgaattgtaactgaacacatttatcttttctatggaccctttgtatattactaaatccggtttgaatgaatttgtatgtactgaacttagatggactatttatgtaagctttgcagacttgaattttgatgtatggattgtgattgatgttcatatatttatccaaatcaccatgtgtttttttttgggcgtggaactcattttttctgacggtggatgatggtttttcctgatgggtccacgtcaaaaataagctttcacaaacctgacgccagttgattttttttgtgagccaaccgacaggaattcccgacagaaatgatatttctgtcaggaaaacgacagaaaaatttattttctccgtggtcttttttctgtcggcaaactctgacggtgcacccacagaaaagtattttctgacggtaattcatattattctgacggttttcggcctacagggtagacctcttgatcttctttttcttctcatcatcctccttcttgtcttccgacgactgtggccgctcagcacggttcttctgcctgtccattggagcttaatttgctagctaactaataactatagctaatagctaggcgctggctaactcgatcgaaaagagctgcttatcccacagcttgtctgcaggttgcgatgacctatatttatagtcagtgtacatcgatcattgaattgatctttgttcatgcttacctttaatttgcttctgacttgctgcattatatataatccaggtcttgagatgaccagatcagtgcggcgcatggatgtgtcaaaagagatcactgaacaagtatagtacatgcacgtgaactagctagctactgtaaaatggatcggagtacattgcgacagagagcacatacgtactgtgaaacaaattaaacatcataatctaattcttgcacttaaatgtccaaatgctagtttctcgcaatctctggttgtagcagaaagagccttaattttggatcttaagagctgctattattacttgatgacgagaagtctctgtactttaattagccgtgcatccaaccaaagagtgcctccatgctggttctcatttcggtttagaagaaaacggagacggcccagcaaaccaaaacgacccatctgtgagcatttaatttgcatgtgtacgccttacgcatttcttcgctaaaaaaatagttaaaatttttcgggcttggttttgtatatatatctctctccctgcccaagctcgtccaataactatcgtgggccttttttttttttggccagacttcttcggccccggggaggcaagcctagggacaatgcatatttataaatgaacaataatccaaatgatttaagttatttatatatattattatacggttggtcagtgttggagaaatttattacttctttccaaaacaaattaaccaaatataaaatgtttaaattcataatattatgatgtatcgcatctcatatttaattggtttattgtaagatagagggaatactattaggtacgcttgatcatgtggtgtgtgccttgcattcatatgaatactactctcttcgtcccttaatataagagattttgacattttagttacactgtttgactacgtcttatttaaaaaatttgtgcaaatataaaaagcgaaaagttgtgcttaaagtactttggataataaaataagtcacaaataaattaaataataattccaaaatttttttgaataggacaaatggtcaaacagtgtaagcaaaatatcaaaatcccttatattaagggacggagagaatagtattcatatcaaatggaccaaatacaggcagctgatagatatagggatatgctacacaaagacaagctcaatgtttgtgtggtgtgatgtaatcttaggagtgagcccataaatagtgggataatgttaaagcaattcgcacaatgctattgctatggctaggatttaagtaaccataagatagggccacatgagatagaaaaaaaaatacttcagctcttgtttatgaggtgaatgagagagataaaaatattttaattttgtttgtgatagaccttaagtataatgtgcaccataaactaatgctacttaccacaatatatgtgacttattttataagtgtaattattattttaagattatatttttcataaattattattgttgcgctaacgccatatcgatcaaaaaaagtgagcagaggggaatatgcatgatatatagcatatcacgggtatgattttgactgctagctgctgctgtatgtatgataggcacaaagctggttggccatgcatgtactgcgtttgcgtggtccatttgaccagatcgacgtgagccaaagcttaagtgcggtatctccaatagggaagttttttttgctagtatcataacacttatcgttttgctaaaactgaaatcaaactttgtacagctttaactatgaacaaaatttaaaatatttattttagaagcatggaaactatatgtatatattaatattgaaatatactttaataaaatcatacattcatgatatttatttaaatattgtaatagaaaatagtgataaagttgcttcttaagattgtgtcccttgttcaaaacaacaagcatatttttaaatggtactacctccgtcccatataaattataattctagatggttgcatatattaaggattgagaaaaaaaactataatcgatgctccttattaaatgttctatatatagataaaagtggaggggtagttgagggtaaaatagagataaatttgaatgagaagtgattaatgagaccattaatactatattgtgataattattttgggacaaatttaaatcctagaaatataactattataggacagatagtaactagcactctttttaaaactaattaatatgggtgttaaatgctgcgtgcatcttggaatgcgttatatataggagtatactactagtagcttgtgtgcctataaatataatcgtatgtcatatttaaccatattaattgtgatatatattatcacgattgcatgcatggtcaatataattcttttatttattaattaatgtaagagtttctggcatttagagtaaacgcgatgttacctttattttactatgtttataatatatatagtccagtatatatatctgatacattggttgacaaacttagtattacttaaaaaaagatgacatcaatagcagtttatttcacgtacggtagatcaatgcggcgtacgttgctagacaaaactagtgcgtaaaaagtttcgagcacacgcagtcataataatgcagtaatgcagatgaccaaggtgaatggggtagtgcatgcatatatacacttggtcaactctgtcgtatacagtagtagacatgtaaagtactaaactttattcggtctcgtcatcgatatatcgtcatactactttactgtagttcatcagctctgcatttgcatatgcatgcagatatgattcgacgaccaaaattaattaaggctgtgtttaatccaaagtttgatccaaacttcagttattttttatcacatcaacctgctataaacacaacttttcagtcatatcatctccaattttaaccaaaattcaaactttgcgctgaactaaacacagcctaaggtgatgtcaaccacacgacgaagacgcgcgatatgaagcggtccttgttgggataagacgtactacgagcgatccttttggacctcatggtcagtactccgcatatccgtactgacgattatattgctggatggagcggcttgttgcatttcatttccagtagatatagattaattgtttatttctttattttttcttaaaaatccagttaattagattgcacagatggttttatatatgatcttcattttggacgtcaacgaaattacaggagagtgaatcgtgttagcctagataaagtatggttgggctagtttgcccatataaatatagtttccgtttggtccactatgaactctgcttgtctacctaccccaccaccaccacccttttctctcccttggtgaataatccaacattttttttcgcgaaatacattacagacggagacactcatatatacaaacgtgcgcatgtaccctatatatctctatgaaatatacaaaaatgccaataaggagtacatgacataaaaattgcaaattagctccatcagcatagactacgaccttcttttttgaaagtcatggggatacgcaaatgcaaagcattcgagtggctagttatctactccctccttccctaaatgtttgacgccgttgacttttttaaacatgcttgaccgttcgtcttattcaaaaacttttatgaaatatgtaaaactatatgtatacataaagtatatttaacagtgaatcaaatgatagaaaaagaattaataattacttaaattttttgaataagacgaacggtcaaatatgtttaaaaaagtcaacggcgttaaacatttagggatggagggagtaatatagaatttggacggaggacacataaactactattgccctctctgcaaatataccttcgaaacttacttccatctccacacgaaaggcagatacacaagtatctggaacatattagcaacttggatcggctgcgaggagggacttctgaaaggttacaaatacggtgcacaagtacgtggagtgcccacctaaaggtcctgtctagacctatgatggtgaggcgaagactgaggcacagttacacgctgttctattgtgagcatgaatgggatgatgttgcgtgccgggcggctggcttgggtcgctgtgtgtcaacctcgaacgacccaataaatagtggaacccgattagagcaaggataatagtgagatatgcttatgtggaggagagagaaaaaaaggtgttggctctcatgcaagagctagctttgcacgtgctccaagacaaatacattaaatgtataaatgagagaaaaagataggagaagaaaaatcaaagataatcttagagctagctctgcacgtgctgtttttcggaaaaacccctttattttttatctttatagcgctacctctagaagcggaattttcttttcttcgcattgtatttctgtgaaataggagggctttttcagaacaaacacaacagggtgttgtccagtttgaggacatatgcgatattttgtgcaaatacgaggagtttttttttttttgcaaaatagccttttaatgaaaccggctccaacccacggtgcagacccatagcgcctaaaattgcgtttggccggttaccgcctacaagcggtcactcgtgcgcgcgcgaggagccaactacagcaaatgggcgacgtgtaaatttacgggatagctaaaaaataaaaaacatgagaaaaagggtacggttaggctggttattgattgatgataccccatctaccatggggcatagagagaaacaaccaagcaagtggttgtgccggctcaggtacgcacggagcccagcattgagacctcatacatctacaacagttggtatatataagcagtagatggaaatacattgaaatccctaagttaaggagctgcaaagacagatgaagtagcactgcaaaacaaatgtccctcttaggaggatgaaatggactacataaacacgagtttcttagtgcccaaatatatcaaccacaaagttctgtaattgagcatagctgcccctgattttagatatgcagaccacagtgaatgattttcttacaagttccaagctaagatcattctacagttaaactcatgatctcaccataatacgctgggttttctctgggttgacaaatacactgattatattcatgaaaatcattaagcagtgcaatactacctacatgactcagcgacacacagaaggcaacgacggacgaagttatggcagaaacactcttaattttgtaagtgtttttgtatttggaagatcaacaaatcttcttttggatagggaaggtcaacaaatcatttgctcaagcttaatgttctcgcaatatcttctcattgtaagtgataaaacgaaacctgttagaaacttccgtttgaaagaacatgttattgaccctaaggaaagaatgtggtattgaagcattccaatcaacacaataagttattaaacagttgctatgatcacaaaaatgttcgttcttttagaaatcaaggtacaaaggaaaatatctggtttcatgttggagacatggcagcatctgattcatattcatgcggataaatcagttatcacatcttctgattatgtagagcttgtttttatacactcaacaagctgcaaccaaatgtcagttcgaccaaagtgttctgctcacatttcctaattaagtatgtccctgtttcagctaatatataaaagagcactctataaagcaaccaacctcatcctcagtttttgtgattctgaaatttgcttctttcctctaagaagcggctaagttcaatccctaagattgaaccagattatcaaatgagagacacgccaagatgtgttagctgctcgatttacacggtttctctagaatttatgttagccgtacaaaagaaaattaaccagttgtattagcactatcagttgtattatcactgtgtaattaagtacacctctgaaaacctggcgaattttgtttcacatttacctgcccctgcagagaattgtggtgttgagattgcttgaagtaggtcgaggtaagtaattatctgaaacatgaataatagcacgtacagttttgcatcaatttagggttgaattaacattacgatcaagagctggtggcggaagtagggccaccaggggcgtaaccgccactctgtgctgcaaggacggagcgacgtacgcatggcgagatgaggcgaggtggttggcaaagaagacgcggcgttgattgaaccgctccttgccggccgtccaagtggtgaaaggcggacggcggaggtcggcgcgaggaccagcagattcaagtgcaggtttagcatcgacggcagatcaaccggtggccggcaattgagcggggtgcgggagtggaggcaatccagccgggttcactcgacgataatgacttgaagccggcgacggcgcggtggaagagccgttagcgagggaagagaggatgtggcgctgcgggtggggggcgcggtggcacgatggtcggcgaatcgcgggcatgggcgggttggagattggtggcggcgattatggagtcggactcgggaggggaaggggaacctgcggggtaggaagaggttggaggtgggatgaatctcaagcattggatttaatatggacaatttgaaccattgcattgagtgatgaatgaaagatagataaatagatagataggcatagagaaaattcctatatacccttaaaaatttactcaatccctttaatacccctgaatttgacctcatcccttatatacccctgagttttcattttgatcttctctatacccatctccgttagttaaccattagttgaccgttaaatattttaaaatgactatattacccatcctatacatatgtggtacctacccaataaattttcatatgaaaaaattaacttatacaaaatacaagcaatataatcatttgatgcccaacttaaaaaataaaacttattattttttattattttttaaaaaatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattacatcccctttgtttttttacaacgaatctttttttactaaatatttgttgaaaagtaattttcaaattttatgcagaactttttttacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4100 - DNA, 1191 bp, Oryza sativa
  unsure (1)..(1191): unsure at all n locations
agatttaaaaatttaggggggaaaaagattgggtgaaatcagcggggttggggatggccccaaaccaaatattttggtaaaggcgtttttggttcttcccccccccatttcttggaaggtccaagtcaaaaaatttggggccccccaaattgtgggtagggaaaattttaagccaccctgggatggccaccaatttagagccaaatttttaagcatagtgagaaacttatagattatgccaaatatttagggggcactccaattatttagtctcaatcgaancttacacccaacctattcatttggccatataaatgggtagggtatgttttgggcacaaaccaaaacgggcccatattttggtcaggttctaagatatagaataggtttagtaaaaggggtaaagtgtaaaattcctgccaccccaatccttctcccggccgtacaccatttcgttccgacgcgagtaattcctccccacgggcggcgactaggcgggctagggttcgtcgggcgccgccgtgccggagatcgcctctcgccgccgacacccggatctccgccgccgccggtcgccccaggttatcccgctcccgcagtcaccatcccgtcttctccgccagtcgcctcacgcccggcctggacgccccggaatccattgtcggtctcgccccgccgactgccgttgacgccactggctgaaggtaataagccgctcacctctccctctccccctccccctgcgagctcatggatttaatccattcgctcgtgcgtgttctccgtacttgggtgaactaaacctagttcgtgttctccctacttaggtggagtaaaatagttgaacgtttgttctctgtacaacaactgtcacctatcttctcatttaggagcttcgatttatcctagaatgaacggaaccagcggttttggatgagttcagtactgtggtactcttgttctcgtggacgatttagaggagccactcctgttgagaagaattatatttcatagttccccgatggtaatgaatcactagagcccgtattttagaagatgctttacgctattctgatggcctcgaggaaactgcgccattatttccaggcgcatcgggtcactgtagttacgtcttaccccctcggtcaaatcttgcatatcgagagggagctgtgccaaannncacaccca

SEQ ID NO: 4101 - DNA, 1185 bp, Oryza sativa
  unsure (1)..(1185): unsure at all n locations
gtgttccttacgttgaccttgtaancaccncaaanttcagannnnnnnnnnnnnnnnnnnnnnnnnnnnnnnnnnnntgatgaatcccctaatgatntttatttaaatcattaagttaaggtagatacgcatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctggttggtacctgttaatcgagtagaggaaagtacaatatgcagacctaggagccgaaaactgtaaacctataaccacttacatgatatgtcatctaatccctaaaaactttaagctataagagggtgacttaaagcaattccaacttatgccaaatttattgcataaatttgctctaaggccggaaaaataatgctcgaaacgactattggtaccacccgtcactaaaatctactcagcggttggcaaaggagccaggaatctagcactcaactacctgtggaaatcgaacacccaaaacttgttatatttattcaagacaatgccattggaaaaaccttcgaaattgaaaagcttgctacgacttagcttcccttaacgaacaacaattgagggttgtattagctgctaacgccgagcttaatacaagttggttgggcggtagcttacaacagggtggcaaccattcggctaacaac

SEQ ID NO: 4102 - DNA, 1436 bp, Oryza sativa
  unsure (1)..(1436): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagagttatatatatacctggtggaatttggattaacgagagctcaataacaaccacattgtggttgatttggtcacctatagtttcctatgagcatctgagggctgactaattgctggactttagaaattagaatagctgttgttgcttattgtatttacattgctgttgttatattgttcctatatggatttgtaggctacagctgtaccatattttaattgaaaatgctccaattacttgtcagatatgattcactagctgcatatgaaactttaggagaggtctgagttgtacatggccttatttttctacaatttctctgcacaggtgtgaatatgtcggacagtgcgttgaaagatctgaatctagctcagtcagcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4103 - DNA, 846 bp, Oryza sativa
  unsure (1)..(846): unsure at all n locations
tattttctttttgtggctacaacatacttgtcacttaagcttcacttccagtaatcttacattgaaatcctataaacaggtgaaattgaacctatatcttttggagggaatccatgatgatgttgatttttgttgccaacttgcgaaagaagagtcggtgattctttgcccaggtacatctaacatttttgttaataaatggatatgtatgtgcctatttaattaaagaaagttaaaaatttaatattatattattcaattcacttgttatgttcttgtaattctctaacgctataccatgacatataagtgatgctaccttatttagtttctcacaaatctaatgattactttttggctaaacatttatgcttattaattaattttgttatgaaactttgaaaattattctatgattttgttgcttaaaaaaagttaatagttaattacttttagttttgcatctctaatcactaatagataatagtttagttagaatatttaaatatatgtggttatgagttttttattgattgcatgtaaactttttatatgtgatatatgaatatgacgacattattttatttctatatatgaaagaaaatttagcaaagtgatgcaatgatattcagacaggcacattatatccctacctgttgtttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnan

SEQ ID NO: 4104 - DNA, 934 bp, Oryza sativa
  unsure (1)..(934): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatctatttgagcaaaaacttgtagaagattggaaaattatgtctttgttgtatcacacacataatatcatattttgtataaattacttgtcagcatatatatattttttagaattttctaaattccacaagtgcaaattagcagaagttgcaaacaaaactccaccaaaattttgaacatgatgagatcagacttcaattggaaaattcatcatgtgactcctgacagtgttcctgtgcaggtgcagctcctctggagagtggtcagaaagatgaatgagaatgctgactcaatagaatccctagcaaatggtgctgagaaaagggttgaatctctgagttcagaagtcaaaaaggtattatgtaactgatcagttgaatctttaatagagtaatatctactttccttcagacaaggtcggaaatttgttaagttattttatccttcttcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4105 - DNA, 904 bp, Oryza sativa
  unsure (1)..(904): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttattttattcattaatgataattataatacgaattatacgaatagtgtttagggactggttggttcatttgcttattttgtgtgccaaacagcatatatcaccaatttagcaagctatagtttttcgacactcgacaaaaagctcgccacacttatggccaaaataaatcagcttgcaaattgagtctataagcaaatctaaaaacgctacaattgcagttataagccaaacgttttgccagaagaaccggagctgcctactttagacgtgataaagtttggcaataaactaaaacagtcccctagtctgcgtaccattctttgtttactaacaaaagcgtgctactttacccaccagttatataatttgttcactttgatccgattcctattttgcaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4106 - DNA, 910 bp, Oryza sativa
  unsure (1)..(910): unsure at all n locations
ccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagttattagttagctagcaaattaagctccaatggacaggcagaagaaccgtgctgagcagccacagtggtcggaagacaagaaggaggatgatgagaagaaaaagaagatcaagaggtctaccctgtaggcagaaaaccgtcagaataatatgaattaccgtcagaaaatacttttctgtgggtgcaccgtcagagtttcccaacagaaaaaagaccacggagaaaataaatttttgtgtcgttttcctgacagaaatatcatttctgtcgggaattcctgtcggttggctcacaaaaaaaatcaactggcgtcaggtttgtgaaagcttatttttgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4107 - DNA, 936 bp, Oryza sativa
  unsure (1)..(936): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaccaatgtgggagggtccgtatcgagtggtcggcgtcccccggccgggctccatacggctggccacgggcgacggcactgagctccctaacccgtggaacatcgaacaccttcgtcgcttctacccctgagggggggggtcgggtgtcaggtttcgggctcgggccaaccccgcaccccctcgggcgtgtagggttggccgggggctgccacacatgcacattcttatttctttttcagtatttcaataaaagcagtttcaatttcctaaaggctgtatctgtgctgttttttccttttgaagaatcttgacttgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggt

SEQ ID NO: 4108 - DNA, 881 bp, Oryza sativa
  unsure (1)..(881): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttgaagctgtagaggctcggttcctgcgagcattgttcagcgcgttcgtcgatcttacagtactggttaccaagcttgttgaagaatatggcatcagcaaggaaggagaaggcagtatctagctagttttactcccctgtatcttagaaaaatgttttacaacacctttgagcattcataccttcttttatatcatattatgtgtgttcttcgtttcttaggccagaaatctacatgagtctcatctctccggtgataccgagattgttccctccgatggagatggagatgagtgatcctcttcttctcttcatggtttcttgctttttggtgccttgatgccaaagggggagaaattgtgaattgaagggggttatttaaatcattttgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4109 - DNA, 964 bp, Oryza sativa
  unsure (1)..(964): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccgtattgagggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccgtgtttagtttgaggataagaaaggatgggttagacccatccgtattatttagaattggatgattccattatctgtttggcatgagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4110 - DNA, 1687 bp, Oryza sativa
  unsure (1)..(1687): unsure at all n locations
cgtacaagaagaaattgttcgaacaaaacattgtttanataaaataaaaccatacggnnnnnnttnntttggttgttaaggggattagtnaacttcaccttccatcatccgttcaacggtgaaattttttttatcgcccaaaccanttattatgaacccccccccgggccgggagaaaaattggggcggtattctactctatctttgtcaaatcactccacgataatctgcttgttaattcacctggtaatgctgtcttttattaatttggaaggttggaccccctactgcaaatctgcaatgatgcagatttttcatgcgtgctgaattttgtgctctaatggtggattgtgatagcgatttgcaccattttgtgcgaagaacttacatgaatcagatagatgaaaaacctcgagctgtcagatgatgctggagaggcatatgctattctcctgaaagctcaactgcctgaagtctgaactctgaacatgttgttcagttggcctcgttttctcacctttgctggaacaggggtaaataaatggtgacgaattgataccagaagaaagtgtggtaattaattaattaaaaagcataattaacaagctcaaatcacgatgctcaatataataattactctttttttttgttcttcctcgaactcgaagaacgcacaccgtctccctctcgactgtgactctccccgtgtttgggccacacgaaatcgagatcagaatccgttccggcccaatgagtagcatgggccgcacataagtctaatcctactcctttgcagaagagcgttccaccaccgcgtccgaccgccgacgcgaccggcggtgaccctccctcttcagccgttcgccggacttgcggccagactgatccccttcgccgccgggagcaagatcaggcggtgtccgcggcggggctcgtcgggatctgcccccatccatggtcgcacggcgccgcttctgactgctccgcccccgcgttgatgcgctgcccgcggcatcgagccgcaaggtaattcctcgtcggagccctcctattcgcagcaaattagacaagcagatgttcatctaaagcgttgggggttagaaatttcggaaactgattggtctcgtaaagcgtctccctccccagactccaaagagtgatgggatttgggggggggggatgattatgctgtacaagagtagtttgatagcaatgtcagtggtagaagggaataatcttgtatggcctgatgttgcgtctgctgggatgttgcataatggcgtgtctctttttttctactgcctgcgtaggtttttgtcatattaatcatggtgcttagcaaggttgaagtgaacttgatcaggctgcttgaggcagctcctcgacagcagaaccagactaagcttgtccatgtaagtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 4111 - DNA, 1257 bp, Oryza sativa
  unsure (1)..(1257): unsure at all n locations
agtgtgcaattgcacccttgatccgcgtttagagatcccttnnnnnnnnnnnnnnnnnnnnnnnnnnnnnnatgtagctcatatgtagagaaaatttatcttgcactaacaacctttttgtatggtagtgactttgaaattgattatggatccgaggaacgcgcatccatagtttacaaaacgctcgctgttgataaggaggtaagaagttatagtacactttaacatggttcttgttttcataaggagtcccaatgtttcctcttttcttcatgctagcttgttgagaaaagaactcgaatcctgtggtatttatcttgcagttgcaacctgacaaggtaaagagggagatgtctgtttctggtggcaagctcgtcgtgtcagtaaatccattcttaacaattgctatcgattgtgtttactttgattcacgatgtgtactgatacaaaattttttgaatctaattcaggcactttgaagctgtagaggctttggtttccttggcgggagggcccaattttcccggggcgtccagggcgtttgttgatcttacagtactggttaccaagcttgttgaagaatatgggcatcccaatggacganaaagcnnnntntaactanttttacccgcccgtctcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtccaccacaaaaatcaagacaagtggtgctcattgtcggtcaaggtgtcattagagcaccattaatcaagacaagaattctaaactaatctcataggattaagacatgcattgatccaggtgttaaacccttgggcagatttaggatgtcgatgtgccgttctctgaatccttcagacagatctcgatgcaagctgacagaaatgaaaaggcagattctgaagaaggaaattcattagagtaaactagtcatggttggagagtttcacttaaacttgctgaccgatgcaaagctccaagtcaacttgcaaccaataaagtgacatttttcttatgatcttatactaacatgtgtattattgccctgatgacattggatattaagtgggttgacaatgagatggtggaatnctgtccaccc

SEQ ID NO: 4112 - DNA, 865 bp, Oryza sativa
  unsure (1)..(865): unsure at all n locations
ggttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagataatgcatgatcagctgctaaataagtagtgttgcaacttacaatatcaaggggtgcactatactccgccaaggttaatgatagttcaccgagtcgacaacatcaccaatccatccaggatggaacttttattcccttctgcttgaagccctgtgtagatgttattagtgcaacggtactgaaacagggtaaattgcacagaaaaataaacaatataaattttgaaattttaatatctgcaggaatcatcataaaacttccctactcaaacccatattaatatttcatgttctttaatgaataaagcattttatttacttgtaatgtttttattttaccatatcattaattaaagaagctgccaggaaaattttctactgtggtgcatcgaacaattatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 4113 - DNA, 835 bp, Oryza sativa
  unsure (1)..(835): unsure at all n locations
cgacagtcgcgtctgttgtgcgcgaatcgtgtttacgcctttcctcccttttcgtccagccgctgnnnntggattgacttnctacattnaatgctttttcctctctnnnnntnnnccccgcgtgngttttgttgacnaccntctnnnnnnnnnnnnnnnnnnnnnnnnnnnnnnnnnnnnnnnnnnnnnnnnnnnnnnnntttacattgagaacaaagctttgcgtaccctcgcaaaataatagctttaccaattacgacaggatatttactccatgaaaataatcaggtattcccaccgattcagttcaaaacttctgaaaaaaatgtaaatgtagatcatgccacactaatctatttgagcaaaaacttgtagaagattggaaaattatgtctttgttgtatcacacacataatatcatattttgtataaattacttgtcagcatatatatattttttagaattttctaaattccacaagtgcaaattagcagaagttgcaaacaaaactccaccaaaattttgaacatgatgagatcagacttcaattggaaaattcatcatgtgactcctgacagtgttcctgtgcaggtgcagctcctctggagagtggtcagaaagatgaatgagaatgctgactcaatagaatccctagcaaatggtgctgagaaaagggttgaatctctgagttcagaagtcaaaaaggtattatgtaactgatcagttgaatctttaatagagtaatatctactttccttcagacaaggtcggaaatttgttaagttattttatccttcttcgtcatcagataaacagaatcatgctctgtaggat

SEQ ID NO: 4114 - DNA, 957 bp, Oryza sativa
  unsure (1)..(957): unsure at all n locations
naaaagcacccatataatcaaacaacctctccctaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaattccattcaaaaaaaaaaaatggtggtggtgcgcgtcggatagctagtgcgactatatttgtaggagattctacgggtgtgggacacggactcgggtggggcacagcagcatgaagcatgcatgcgcgcctggtgcttggtggtgttgcacgaggagtatataagccccgttcgactcgaattagatacgaatgcgagatttttcggagcacgccaaacgagataattattataaatttatttataaatttaataaataaatttatttagtatttttatatattttttaaaaaggttctcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4115 - DNA, 710 bp, Oryza sativa
  unsure (1)..(710): unsure at all n locations
gcgtcntttgacattcagttcatttgatnaccctcttgctnnnnnnnnnnnnnnnnnnnnnnnnnnnnnnnnnnnnnnnnnnnnnnnnnnnnnatcaagaatcaagaagaagaagaagaagaagaaagctagaagttatataccgtgtttctccctctctcgttgtgtttcactcacgctctgctgcttctgggatgatgaggatccctgactttgctcaccttcacctccatgctgctccccggtgcccttctttctaccagacttgagagctaccctgtgggccgctagatttcctgtaggttccacagccaactcacaggaatattaattttcttgacggggttacttatacccacagaaaaattgtgttatttttgtaggttttcacacagacccacagaaaaatagcgctgacaagtaggcctcaagaaccatcaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4116 - DNA, 2762 bp, Oryza sativa
  unsure (1)..(2762): unsure at all n locations
agaatacaattttttaatttgcccaagcttaaagatgtgtacaattgttggggccctcttttaacaagtggaaaatgtttcagggtattttttgttttggaagcgcaaagaaacaaaagataggcaggggccccaggtttttattttatttgtgaaaaggttaggattacaattggttaggaaagtatttcttactttttacactcaaatatagttctacaccctttctcggtaggcttgcaaatgcccacctttgtaaatcagaactccctttttcttgattcaccaattagaattggaccggtaatcatgggacccttattataaaaatttgaccaactttcggaatccaaagagattgaatgatgaaaaagccccaataataggaaccagttcttgcccagttgtcaaagtcaaaacaccaaatgcgtgatgtatgaccatctaaatgccaaaaaagctatatggcacaggtagataaaaatgtgcacatttacatttaactattaactatacttttctaatgtttttacttttttagtatataccaaaaattaaaaagcatagaaacccatattataccatcatgatcacttagagtagtatagtaagaaagaaataggaaatcagatcaaatcttccaatactggagagaatagatataaattactacctccgtttcaagttataagactttctagcattgcccacattcatatagatgttaatgaatctaggcacacatacatgtctagattcattaacatatatatgaatgtggacaatgctagaaagtcttataatatgaaacggaggaagtacaaacaacaaaagcggcttatattttaatttcatgtgtaggatataagttaacatcatgacgatatttgaaggcaaatagaatggcaaaaaaggccaatagaattccaacatagcttggaggagaacaatcgttatgctttgttagtaaaaagctgcgcaaaagcctttgatctaaaagaaacatagcttggaggagcaatcgtgctgtcgatggataattggtcatagaacacctcactattgcctatcggtaacatcatggccagaaaacaatatcgagagcaacaactaccagttcatgcaatgagaccttatgtacaagcttacagctagggtcactgaattcacaagttctcatctctcttctcctcttccctccattgaatatttgagtgtcagcgcaattgcaagacactgtagtcatcatacgccaccattcacaaagaccaaggtggcatttaacataaaagaattaactacagaacggctttacattgcccttattaaacggcatgatacaattaggactcaacccctttcatgcattaggttaagggtagagagtagaattatgactaaactcttggttttctcgatagacaagcactctaaaatgccatatcctaattaaatagacaaacattgtgaaaacaagagtataaatttagacgtgcttgaatttgaaaaattaaaattctactctcatataacaaattcaaataaattatatgcacaaaggaacagtacaatgcagcttctaacaacctcaagagtcaagacaatcaaaataaataataacctagatagtgatacctttctcatatctgaatgtagaccctctactcttctctctgtatccttagccaatgaccataattcacgaacattagagttcatctgtcttgattcatccattagaacctgaaccttttatcacaatgctgatgagatgaattaatcaaaatacctccacccccaaaaaaatcataatagctcagaaaagtaacacatcaagattgaactagaacattcagaatgacaatattgcaacacatcaaatttatttaccaaataagatagcacaatactgagtcttcatatgtatttaggcttgaaagacatttttaaaaaaatgtattcaaatgtgaggtttctaatctcagatgaaaaaacacaataaatcaaatgcatgatcaaaaactaatattaataaaatgttatagaattggtagttactcatggcaatcaaaactgatgataaccttaccatattaacatctgaatgcagagcgctgactctattatctgtatcctttgccattgaccatatattgtgaatattggagttcatctttcttgattcatccattagaatttgaatctgtaatcataatatccatgagatgatcaccttgaaccagatttcgtaatatattatactataataattataatgaagggctctcaaagtaattcattttgtgcaagggcaacataaataacctaagattggtacaaacaaagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnagtgtcattcatgcgcc

SEQ ID NO: 4117 - DNA, 607 bp, Oryza sativa
  unsure (1)..(607): unsure at all n locations
naggatggggnacgtagaacgtacggccccgccacatgagaagaaaccatcccgcacccttatcgtagattgcaccaatcatacgttttttatggtgtcctagcacaacatgaattagggtgagggcccttcattgtaatgaggatgagcataatatatccctgaaatgtgcatcaaggtgatcatctcatggatattatgattacagattcaaaaaataatgggcgaatcatgaaggatgaactgcaaaattcacgaatatatggtcaagggcataaggatactaaaaatagacacagcgctctgtatacccaggtgaatacgagaaggatatcataagtggaacatgccatgagaaactaccaagtctataacaccacattaatattacttcttgaacatgcatgtgattaaccgcgcactatcatgttaaaatagaaacctgacattgcaatacatttacctaaaaaagtacatcaagcctaaattcaaattaagactcatgaatgtgctatcatatgagagaaataactttgatgtggacgaatattgcaaatacaaacggtctatatacatgtgcacatggatctagaatgagatcatatga

SEQ ID NO: 4118 - DNA, 807 bp, Oryza sativa
  unsure (1)..(807): unsure at all n locations
ncgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactaaattgaacatgacacgaacacacacaattagtacagctacatagtactacgctactactcctatatgggacacaggtgcatgcgtggcacggatcgatcacactagaaaatgatcgaactacgaacgtcggcctgcaggaggtatcttactgggcggcgtagcgtccctggggctgtccgacttgatggagcacagctcgtccgaatcctcgccatctgaagtccgagttatgatcaagtcgtctatgtccagatacatcggtgcaagatctgcaaagtttattaattttacagcaattaatgcatgcaataatcaagtaagcaattgaagctatggcaatctccaacctcactaaattgaacatgacacgaacacacacaattagtacagctacatagtactacgctactactcctatatgggacacaggtgcatgcgtggcacggatcgatcacactagaaaatgatcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 4119 - DNA, 726 bp, Oryza sativa
  unsure (1)..(726): unsure at all n locations
gcggccttgatggacctacnnnnnnnnnnnnnnnnnnnnnnnnnnnnnnnnnnnnnnnnnnnnnnnnnnnnnnnnnnagctccaatggacaggcagaagaaccgtgctgagcgctgagagatccccttataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtatgcctagtccgtaggcaggacttttcaagtctcggaaggattcttcaatctgcattcgctttgaatagatattaacaagttgtttgggtgttcgaatttcaacaggtaagttagttgctagaacccatggcttctttgccgacgcttagtagattttaggtgacgggtggtgacaatgtgtccgtggagaacgctgattctttagggctttagagcgaagaatattcaatagaatttggcctgcgattggattgtttttaagcagcctcttatagcctatagtctttgagtgactaggtgacatatgatg

SEQ ID NO: 4120 - DNA, 743 bp, Oryza sativa
  unsure (1)..(743): unsure at all n locations
gccgctttgaatcgnctgtttgaaaagcnnnnnnnnnnnnnnnnnnnnnnnnnnnnnnnnnnnnnnnnnnnnnntcacgtaatacggatcaaagccaaaataatccacaagtgtaaactagtatgacttacactttttcatcctgaaggagaatggttggctgcaactttggagcagattaaattgaactcctagaaatctccgccggcggctatctgaacaaatcggtgtttgggattagcagcggaaacacatgctagcatggacgcttcactatgaatattagggctattgagatcctcatcctctaagcccaatatcttagcaaactgtgctatggaaattttgtgcctaacaccctcagtcatccactttacataaggagttccctttctagtagtaccaaacaatgctgtcgcatagaattgtgcaatgacctcctcatttcaatcatactccaaggcaagaatatctcccagattcttgttgcgacaaacttgcattgcttggttgaacacttcattgttcttcttccttatgtaagtcccatccatccacttcatctcaaccattggattgtctctagctataatcactgagttatacccatccaattgggtgaaacgtctaaaacgaggatcctgtgactcctcaggctgtgtctttggatcaagcanaccggtccttttgcacttggcaagctgatgaaggtagtttggacttggtctttcaaatgtgtgcat

SEQ ID NO: 4121 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnnnnnnnnnntctcgtaaagcgtctccctccccagactccagagagtgatgggatttgggggggggggatgattatgctgtacaagagtagtttgatagcaatgttagtggtagaagtgaataatcttgtatataaagcattcataggtggctattcaagtctgcagttatatacccaggcttcctggaaaggtgggggaaactaccaagctgaagtgaagtaggggcacacagaatttccagtgagtgctgaattggatataggaaagaagaccaacgtgaaagcactccatttggccaatactatggttgtgtttagttccacactaaaattggaagtttgaagaaattggaacgatgtgacggaaaagttggaagtttgtgtgtgtaggaaagttcgatgtgacggaaaagttggaagtttgaagaaaaaagttggaatctaaacggggcctattttatattgcatttattatccctctcataaggtattttagttgcgcgtcgctttttgtgatgactttttggggtcttgaggggtccttttggatccctcggttggacatatttcttcttcttcttcttcttcttcttcttctaataaaaaaaataaggcgcagtcctcctgtgtttttgagaaaaataaggtattttagttttgggtatatattctagaattcccacacagt

SEQ ID NO: 4122 - DNA, 1281 bp, Oryza sativa
  unsure (1)..(1281): unsure at all n locations
gctgctccccttttagattgatttctctncgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatttggcggtaattaagtaaatgaagcggtatactgtatgtagcttctactccctccgtcccaaaatataagggattttggacggttgggacactttctagtacaatgaatctggacatgagtgtccagattcattgtactagaaagtggattttgggatgaggccacccttatgtggggatcctctccccctatttcttctataacattcttctttttttaaagagtctcagaagaacgggctaacaacattgctgatatttgcagacctgtcattcgtggccgaccaagctcaaaaagatcaattcatatttgcggccggcctcgatgggtttttgttgtattatttcctgccgggtaagataaagcgctggcctccatacatactattctagaccatagttttttttttataaaaaaaacaactaaataaataatgaactcaacatataatttattttatttttgcagtaagctgcttcctctggatgacctcatgtattcaccttacggctctgcgggcactaatggttggtctgcttggtgaggccaaacttgaggtttaaaattttcaaattgtgcatgtgtgcctaatatataagtttgtgccttgcaacaacctttgtttacgccagttttaaaacacctaatctgaaaacaccccctgacacatttagggagggaatttgaacatcatcgctgaattattgcgaggtttaaaacccccttttttgcctaccccatgtgagttgcctgcaaactttatcggaatttttggatatan

SEQ ID NO: 4123 - DNA, 38766 bp, Oryza sativa
  unsure (1)..(38766): unsure at all n locations
aaggtaagagaagggggctaaaaagagcccacaggaggtaattgtggtcctactcgggaaggtccccttagtccaatgaattcggaaccccctcttctaagaaagtacctgcataaagggagatttttaaaccccggtttcttcccctccgggggtgtttactaccacaaggtgtgatgttaaattcttgaccaaataatggatgtttgttgctgcgcacgtgcttccctgaacgggtcaaataagggatataataatgtttctatgagtaacccgggtaatgacgttccaaaccaggacctccctatggtccaaaatcccttatattttgggacatagggagtacttggtttggaacgtcaataccaggatactcatagaaacattattttatcccttattagacctgttcagggaagcacgtgcgcagcaacaaacatccattatataggtcaagaatataacatcacactttgtggttgtatacacccccgttggtgtagaaaccgggttttataaattcccattatctaaaataataataatataacaacacacagtataatgaaatggatatgtaggttcaaggctattgtaatttgtaatatctcagcaatgctattattcacctttgatctctggttattatgttgcctgtctcatttctcattacatgtgctataattatattcatctattgtcacgtgatcttgtttggtttttatgtcgcaaccactggccttatcaggacaattttgtacatcttatgccatgagctattttatttgccatcaaggcatcaatcaagtatctcattatcttgaaccccttctactaactcataacagtgcaccagttatttctgatgttcttgttttatgatgttcaggttaggcttctcaggggcgacgtcattgttaatccccacagcgtttataagacccatgaggagctctgggacggcgaaatttagatgcagtcagcttacgttagtgccagtcactctcactgaacattattttttcacgaatttacgcttatctaatgtatggtgtttgagtctcttgagctcctattcaatgtaatgaacctgcttgatcagcagcatcatgttcccttagaattcgtattagcgctcctctgaataatactggatcatgtcatttgtatgcttcgcctctggcatcatttatcccatgctacttgtttgtctatttgtcctttggcatcatcattttttcttgtaccgaggcgttagtttgatactcatgttcctcactgaaattagtcaaattacttagcaggctaacagacatttgatagtcaccctgaattattgttggtagtaggtattcagccatgccttttgctttgatttgcaccttattcacgaaagatttcttgcaacattttttctctgtgagaaacaggtcaattctagctttgttcaggaatactatttttttccatagcaccaaaggcgtgccacaggcatagtatgattgtgctatttccttatcttttgagccatgatatggatgtccgtatgctctacaaacatggcgagaatcgttacccatcgcttgtgtttgtgttgcggggcattcctgcagaaattgataccagcaactaattaatggtactcctgtggagtcctggttcagtaagtgtttaactggcactcctgttaagtcctggttcagtaagtgtttaactgctaagggtatgactttaagtacacagggagattaagtgattaacaccgactagtttcagctgaggtgatggtggaggtaggatctatccaatgggatcaattatgacttgttatttacttgacgctatttttctattttgtttatagtttcccataaaattgaagatctatagattgtttgtcccttcagataagcgatgatgctactggaattctacatttgcctcgacgccggtgactctcgaactctggcagagaacccatgaattaatgttttaggggttggaggggatgggaggctgtgggtggcggtaagagcaactttagaagaatgactggagtgacgaaagaccgacgttgagcgacagagatggacggatggtgagacgctgacggcaaaatcaaagctacggggatgaaagaaagcggtggtcgggatcaacgacgggagcgagggaggcctactcccaccgtcccataataaataaataaactagatgcggcatattatactacaacgaatctgaacaaacgtatatctagatttatagtagtaggatatgttacatccagtattaggttagttttttatgggacggagggggtatgtggttaggaagttgggacaatgataagatagaagagtggaggcgtggcgaggggaaatgacgttagactgaaagacgtactccctccgtcaaaaaaagctaacctaggcaaggatgtgacgtccagatttcgttataccatgtgctcgatttgttacaccatgtagtatccaattcttacttaggatggttttttttggatggagggggtagtggaagtagacgagctactatgtatctagctagggaaaaagaaggaataagttaggggacgaaagatgtagaaggcaacgacaacgatgtggttggtcggaagaagtgaggaggggtaaggattagaattataaagggtagcacagatcttggagtaatctcaaccgttaaaacaagtggctacattttttaagaaaatcaggtgatcaataaacaacaagaagccccttagaatccagtatgagaatttactatttatcattcttccaaatatacatgtctaaataacactctcttaaaattttattctcatttaccatcgactcgagtggcgaatgagaatgaaaatagtaaattcggcattgcaaggaatgccaatggacgggtggagtcattattttcagctgctgcccagcctacggttccagcttccaacagctcgagaagagtgaagagatggcaacacagacacaggaaacggtcgcgcgcgccacagcgacagcgatagagccgctccgcgtcacggcttacgcttccgttgcgacaagctcgcagcctcgcacggacacaacgctatcgacgtggtgtcgcgtcggcctcagcctcgacccgaactcgtggagcgcggagcggaagcgcgggcagtgacaccacggggcggccggcggcggatgctgagagtgtgtccccatgcgttcggcatctcgcgctgcgcggggcggcgggggtcaaaactacaccgtgtgcgatgtggacaaaaaaggtttctccgttttctcctttaggccggagattcccccggccgaatccggcgaatcggcaaaagcggccacatgcggccaacagttggtgcacgttattgtcaaaaaccagtccttacgcaagacgccacgaggtcaacccggagaggaactacatgaatgaataacaaagacgtgattgaaacaaatacggagtagtacgtggttaggacctctattatcgagtaatgatactcgttaggacaagagacaattgaagcaagtagacgcaaaaacgtactcctcctagaggtcacgctagtactccctccattccataatataaggcaccctttgattcaaagaaaattcataggaattttaaagaattttatttctatagaaatttttactatatagccctgtgaatcaaatgaatgaatgaatcctatagaatcctatgaaattcctatggaatgcctcttcccatgcaagttttggagaaaatttagcatgaggtaaaacctcatgttaagaattctttgagtctttatatctcctcaaattcctgtgttttttctacagctcaatcaaatggtcattcctatgttttttaaatggttattcctatgtttttcctgtgttttgtaattctctgttttacacttgtattcctatgagaatcctatgtttttcctattcctccgtttttttcattcctatgattcaaagggggcacaaccactttttttaaagatgtttctaatataagacatgcatgtaagcatgcaattaactatgacatctaatcctattggatgcatacattatatttattaggataatccaaattacaagatgataataattatttcttggtctttgggttaagggtggttgtgccttatattttgtaatggaggaagtatctactacctccgtcccaaaataaacacaaccatgagtttctgcgctcaactttgatcgtccgtcttatttaaattttttttatgattagtatttttattgttatgagatgataaaacataaatagtactttactcgtggcatattttttttagttttttttaaaaaattaaataaaacaaacgattaaaattggacacgaaaagtcatggctgttagacggagggagtactaataatgcgcccataatgggctgtccttgtcacgggctaagctatccacacgatggcacatctaagccaaagcccccgctattaatttgccaaaccacgtccacctggcgcagacaccacaccaccaccgcaacggaaacacggtgaacgcctcgtcccgaaaccccggaaagccggcgagagctcgagaagtcgagaccaacctcgccgagcggatcactcgcactactcccacctcgccgcccgccgccgccgccgccgggttcccgtgctgcgcgcgcttcgatctccttctccttctccttctcgcggccgttcttgtgcgtgagtgagagacagtgaggtggtgggagacccgtgggaagggagaggggggcggaaatggcgaagcacttcgtgctcaacaccggcgccaagatcccctccgtgggcctcggcacctggcagtccgaccccggcgtcgtcggcaacgccgtctacgccgccgtcaaggtttcccccattcacccgcgcttcctcctcctcctcccctttttcgtttcttcccccatttggcttattatgtctggcaaatcaatgtaatactgttctcggatcgtgcaggcggggtatcggcacatcgattgcgccagtgcgtacaacaacgaaaaggaggtaacttggtttctccaaagctctgaatcgttcacgaattactggggcatcactctgcgtgttcttgtttgaaacgattggcgtatgaattttgcattagtaacatgggtgataataacagaagaaaggcacaaaaaaaagtatttggaaacttctactccttcatttttatatttggcaaagaagattcatccattttatatatatggacagtgaactattagtactttagaagggagtacctatacatctttcgaaagatttttataatcgtatcacacagatttttaatctttggattaaaatccgatagatataataaaaagcaaaaagcaattaagaaacactataatggacactaaattaccatatcctcaagaaaaagaccaaatccaatacaaaatttaaaatttacatgcgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctttagaaaggttgatgacaccttcacaaaaaagaaggaagaaagtaggggcagatccgctctacttttagggcatgtataatccgcactactcaaaactaagtagcacttacccttcttgcttactaccacgtgctttacacctggtccaatattatctcgtttcaagacaagtaatataacaaacaattaacaaacacattttgggttttcaggtagggttggctctgaagaagctatttgaagagggtgtggtcaaacgcgaagatctgtttatcacgtctaagctatggtaacctcaaatttatgtgtgattggcctgtaattatgtctttgcagttgaattggaattccagtgcttgcttggagctttacttcaactgatcagaggtgatgggtatgtttgtcaggtgtgatcatcatgccccagaggatgtgcctgaggcactagatgctaccttgaatgacttacagcttgagtacctggatctttacctcgtacgtatcttcttttattaagaatttggttcaatatgtgacttgcttgattctgttctctccaccatcaaggtcttgctttggaatcattggcatcatcaacctatagcaactagctctatttctatatgctgcagaataggtctccccatttgtcagtgcgcattgatagctaatgttacattgtccagcaaaatttctgcaatctgctatggaatacacctgagccatccatatcagaatcatcagcattctgttatatgtgctagactgctagtccattgcatatttgcatgacaatttccttttatcattcatccatgcaaccacaataaacaaagtactccttgttttggtatcagttcgattgttcaccttgaatgacttacattgaagtatactctccacataaattggggcatatacctgtggttaacttttaatttagcagattcctttgttaaaatgtttcagcatcttgttacactaatcagaatttctaatcaccattatatttatgcagattcattggccattcagaaccaagaagggatccagcattggcaaacctgaaagctacttaccacctgacatcccatctacctgggcagcaatggagaagttatatgattctggcaaaagtcgtgccattggtgtgagtaacttctcatcgaaaaaattgggtgacctgcttgctgcagcccgtgtacctccagctgttgaccaggtggagtgccatcctggttggcagcagatgaagctgcataacttttgccagtcaacgggcattcatctttctgtaagtctacatactaaaaaactgagtcaatcctctgactgatattagtaatgaacaaatgacacctgtggtttttccttttctgaaacctactgatccttttcttcctccttttttaggcatactcgccgctaggttcacctggttcaacatttatgaacggcaatgtccttaaggaacccatcattatctcgattgcagagaagcttggcaaaactcctgcacaagtggcgctgcgctggaacattcagatgggtcacagtgtactcccaaaaagtgtgagtgaagaaaggataaagcagaacttagatgtttatgactggtctattccagaggacttgcttgctaagttctcggagattaagcaggttagttcaactttctttgagcacctatatttgtcatctatgttttcacttttcatacatgtgaacagactgtttcttaacagcgagtgtttgcttcatatgattgggataaaattacattgatacttggtaacaattgataccgggctatatatagagagcaagctgatgttgcaaaagttctccataaaatgtttcttaattctatatgacaacctttatccttggaaacaaatttgcttgtaaatactctccaaagaaatttgtttacctcgaagcatactagattgtagaaacttagtgtattgtttgttagcatctgcttgttttggaacatcagtgccaggatactcttaggaacattcttttatcccttattacacctgttcagggaaacatatgcgcagcaacaagcatcaattatatagttcagagatcacacatgataatgcagtgacgtgtatgctcaaggctactctttgtaatttgtaatatctgagcaattttttactcagcttcgatctctgatgattatgttacttgtttcatttctcattacatttgctgcttttctattgtaatgtcatgtgacatgacaaactgtctgttcaggtttggctttatgttgccagtactcactagtggccgcaggacaattttgtaggtcttgcgcagtgtggtagtattttgtttgccatcaatctagtacagctcactcattaattcaatatcttgcaccccttccagtaactcatatagcagtacaccagttatttctgacgttaattgttttatggtgttcaggttaggctgctcaggggcaacttcattgtcaatccacagagcgtttacaagacccatgaggagctctgggacagggaaatttaggagttccgtcagtgccaatcacgcttattgaacattgattgtattagcaaatttacgcatatttaatgtttggtggttcagtgctctcgagctcctctgtcctatgtaatgaagtgcttgatcagcagcatcatgttcccttggaaatcctttttactgctcctctgaataaaactggaatgccattttggtgcttgtgcttcgcatctggcatcatttatcccgttattcccgtgctacttgtttgactatgtccttggatcatcaaattccctcgctgaaattacttagcagcctagcaggctaatcaacaaaaagaaattatatatgtaccctgaattgctgctggtagctggtattcagccatgcctcaccaacgattatagcttctttctgtttttattcttagcaccgaaggtgtgccgtcgtttgtgcacttcccttttctattgagccatgatattgactgtatttcttctgtctcataaaaaacaaatctaagatagaatatgactatcttaatactacaaatctaaacagctcctaaaactatgaatttgaatctgattgtctagattcgtaataatagaatatgttccatcatatctaggtttatttttaagagtacatttattaaattcccatgttttaggtgtaattgtgattttacccctacttaagtagactttacaattttacccttaattttctcgaactgaataatctgtttacccctggtttagatgtccagtcccacataaagtgagttcaagaaattagaaaattgactaagaaaatatgtaaatactctactaaccctcacctattcaaacaaatccactgcccccactctaaatcccctcacaaccaaaatcgacatcccgatcccctcccgtacttggcggtggcccgtgggccatggcggagcaagcggtgatggcggaagcggcgcacgggagcggggcggagcaggccgaagaggggcacttcacatcttctaacctgttcccccatccaaaaccataaccaaggggtggtgctgccgtgatgcgttgccctggggcgacgggagttgtatgtcataaaggaagaagcttaatagtaagatagcaagtaagatgtaaaatgtggtgaagaagacaccatataaagataagaatcgactttgctacaattaccgatcaaaaatacatattggtaaaaaatctatcttctattatataataaaagtccatgaaacttcctacaaacgctctcaagccgccacgtggcgctctaataaaatagagaaaatcctagaaattctaagaaaaaaacaaaacatctatcccttgattttcaattaaattggtgggtccaatattacacaccgttagataaaattgatcttaaaacaaactaaataccatgggttccacctatcctcctcccgcgcattggcaggtggagtatatacgtacgtactgtacgtatgcttcctcccctttttttccttttttcttcttttttcaatttatatatataatggatatattttttaaataataataattttacaaacaaagaatctaccatcatataatttaaaccggtgtactctttactttgtactattattttcaaataatgcactattttaaaataaattttacaaaattatattgtgtacctatcaaataaacaatatcatattaacaaatttatacgtgcacttaaactgatggccccattatataaattatcggatctacttttttacattggtctattattctcaggtaatgcactgtttcaaaataaggtctacaccattatattgtgtatccattatattaacaatttaaaatctatattaactaatttacacttacagtagaactggtggacatattattataatcattggatctattgtttgctaataaataaagcgtccgaaattctctttttgcctgctgcacaacgcacgtctgcaccttggcctttcgcacgtgtgacaaagcgtagtgtctaagacatctaaggtgatcacaaccgctgtagcgctaccgctttgccacatatcaaatcatatatgaagatgattaattttgttaataacataaaaataaaattaaaggtgatgcagcgagagaataattaagcaccatgggttgtgtttttctcaacactaattagctctgtttaagttgaaaccgagagttgattacataataattataatgtatttgtgttatgtcgtatttggattttgtactatttatccgtacaggtgaaaggaatcattatgttataaatgtgagtgcaatattgacgaatatcaatagaactcttagtacgacaagggtgataaagggagtttaaggccctctctttttttcccgattccatattttggattttttttgcacgctttccaagtttctaaatggtgtcttctttaaacaacattataactttttagaagtcaattcattcgtttataccctcaaatagctatcacataaattatataattcatcaatttcagctatcctaaaccttaagtactacatatttttttcatgcgagtcatggtgatcagtaaattggtgatcaacggatcatcgaagtcgtaagatgaatatgtaagagttactctgaacaattgtaaataggtgtcaaaattaattgctattaattagacatctaatggcttgctagccacaaaattaatttctctctacatatatataaacatggacgaagttggaacaaatattaccatacgtcccatacatatatattgcgcagttaatattctaattagtcatttaaaattccttaaaatgctctcaagctgccacgtgatactctaataaattagggcaaatattagaaattctaagaaaaaaaagacaaagtatcagttacttgattttcacttaaatcggtaggtccaatattataaaccgttagattaaattgatcttagaacaaactaaatactacgaggtcccacctcatcataggtatgcacctacgtgcatgggtacgtatgcctcccctcccttttttatttttctctttcttctttttttttcccatgcatatgcttccctccctttattactatatcatgcgtcttcatgagatgatttaatcaaaattctagaattttgagtatcatgcactcacattttttatttattacacgtatgtatatagatggactgtatgataattaactagcaatacttttttatttactcgagaaaaaaaacatgattcaaaagttgtaattacttaatccatcccctattcaaaagtttgtgaatggttttctaagatacctcgagaaaaacagaacctttaatttattataaaataacattatccaaactttagtttgccctaaatttatgagacaaaatttctgaacaaacaataatcttatcttttaaaaatataagtgcacacgcgggccaccttcctagttatcctaatagtaacattcttaagccgaacctttcatttgataattgtcacttgttcttgattgcaattttagcatcgcggaaagcaattctcttgcaggtggcaggtgggatccgccggctgacatacgctgtcactgacatgcgggacccctggttgagcacctcaatgtgcttcggatttcatttcacactataatcgcgacaggtcctcgcctcctcggtcgtttgcgcagcctctgttgaagagcttgttccgttttttaaaagacatggcatctcaacaatactcctgattttctactactgattttcccttcgtcaagcgactccaaaacgtgccccatatctaatctgtctcgcacgcggccggcggcggaagagcagagcatcaggcgcgtgtggatagccggaggacatggccacccacttcacgctcaacaccggagcacgcatcccctcggtgggcctcggcacctacaaggccggcaccggcgtcgtcgccgacgtggtctccgccgccgtcaaggtcggtctctctgaacacttgctgtttacttgtacgcccgtatccatatgcatatattgttctaagtttacttgctgagttgctgtggcaggcagggtaccggcacatagactgcgcgccgctgtacaagaacgagcaggaggtagtaaggctattccctgcaaatctttgaagtgttgagtgttctatcctcgattggcatgaattgcaccggtttaacttgtgagagtgatttttgtgtgtgctcctagattggtggtgctctgaagaagctcttcgatgatggggttgtcaagcgggaagacctcttcatcacctccaagatatggtgctgactgctgctgtcttgttccttctattgaccgacctcaacttctgaacgctactagtagtgcaagtttattctgctatttcgaattatgttctatcccttcctcttgaagacgtcccaaactctgcaggtgcagcgacctcgcacctgaagatgtcccactcgcaatggatagtacactgaaagatctgcagctggattacgttgatctgtatctggtaagctcatcatgatcagcgtaaacgtagacagtgaaaggtttgccattttgctctgcttctgacaggtgcccaacggtgcaatctctgcagattcattggccgtttcagatcaagaaaggcacggagctcagtccagagaacttcgtcaagcctgacatacccagcacctggcgagcgatggagcagctgtacgattcaggcaaagctcgcgcgatcggcgtgagcaatttctcctccaagaagcttggcgatctgctctgcgtcgcccgcgtccctccggccgttgatcaggtcgagtgccacccgggctggcagcaggcgaagctcagagcgttctgccacaccagtggcgttcatctctctgtaagtcctgcatgtttctgagctcatcgatcacttgatatgtagtagtagcattgtgctgtggttcactgctcacatgattcttgcaggcgtatgctccattgggcaggatgaagggcatcgccgttgattcggtgttgccatcggtagccgagatgctaggaagaactccggctcaggttgctctgcgctggggtcttcagcagggtcagagtgtgcttcccaagagcgtcagtgaggcgaggttgaaggagaacatggatctgtttggttggtctattcctgaggaactgtgtgccaagctctctgaaatcgaacaggcaagtgcatccaacctttcagctgtctcaagtgcagaaaacagtttcacttctgtcttcatatcttatgcaattccggatgaataaacttcatacagttctgaacttccgataagttagtaaccagtacagaaaaaagtactattgaacaaaatgcaagtatagtggatacgccaagggtttcttgtagttgtaggccttgtattggaattgtaataactgaaaatgcattgttcatgttggacaggttaagcaaatcagaggagatggatttgctcaccccgagagtgtctacaaaacctacgaggagctttttgatggagaaatctaaaagaatggaaatcacctatgtgaaacaaaatgtgccattactgtaaaagaacgatgaaaaataacaggcatttcacaacaatatcttttttcttctcttcaggatagctgtctcttttacatgctgttccttccccaatgtatcaaaatacagtagaagttttggaccagaagctaaaactatggagatccatgtggtgggggactagaataatccacaatctaaagccaaatccataaactggagaaaatagcatgcctatttttaatctcccacaattaaagagtcgcaagaggcagcagagatatggaacttggtaacatttttaccacataaatctgcagagaaaatcaagaaattcgaaagcacactgaagtaggtccttctacattgcaccaccgcagagacatccaataagcagctccacaatgatgcactgacagaacaggtagcactttaagcccttcgctagattcaattttcgaccataagacagcgatgaaggcactcacatggggtagacaaaaagggcgtttaaaactcgctataattccgccatactgctcgaaattcctccctgaatgtgttcaggcgtgctttcagattaggtgttctgaaactggcgtgaagcaaggttgctgcaaggcacaaacttatatattaggcacacatgcacaattttaaaattttaaacctcaagtttggccttaccaagcagaccaacaattagtgcccacagaaccgtaaggagactacatgaggtcatccagaggaagcagcttactgcaaaaataaaataaattatatgttgagttcattatttatttagttgttttttttataaaaaaaaaactatggtctagaatagtatgtatggaggtcagtgctttatactaaccgacagaaaataatacaacaaaaacccatcgaggccggccacaaatatgaattgatctttttgagcttggtcggccacgaatgacaggtctgcaaatatcagcaatgttgttagcccgttcttctgagactctttaaaaaaagaagaatgttatagaagaaatagggggagaggatccccaccttaagggtggcctcatctttgctgctaaatgtggtgaaaattgtctgactgtccttgtgactttctcattgaatgtaactgcaaaactgcatatcaaacatgaatcatttgaaaaagcagttctagtgggagtatcactatttctagtggagtggacaaacataggaattgactacagaaatacacatatgagcataaaatctgtcagttatctaatgagtgttaagtttttttttctcaaaaacatagaagaacagcgtatcatttcattaaggggaagaaaaaacaaagtgttaagttgttaacatataactggtgcaagagtgctgatatgagcccttaagctaaaatatgaaatgcagatgtctcccaatctatatccattgataataataacagcagatgcttagcagattcaaaatcaaacaacatttatgtgttggaaggaatgcgacatgcgaaataggggttaatgtcacatttgcaggttaaaggaagaacagcttgtaaagtgcaaaatatctttcttcccaagagcactaacggtgccttcaattgaatccaaacttacctgtcattgagaaatgcaatgctgaggcctgttgaaaaagctgcaaggatggaaactggtttccggagaaagcccatccctgcaaaaagagagacacaagatgactatatgaaagtcaaaaaaatagtagggatgggggggttgggggagtacagcacatagaggtctctctgcctaccaagaatgaacatgatcaagatgaagtagttcgtcctgtagctgcaaaccagcaaaaacgttggaaattaactttgttgaaagatgtaacatggtacaaaacaaatatgtatttacaatataagttctaatgtaaaatggtagaggaacttccaggttctattcctaaataatatcgatatgctgccttcctatttacacgttaaaatcaaagtacctgttcacatattctatgattataggttactgttgatcatcggttccatacaaaatattgtatcacactcagaggataaccgtgtggtttactataatatggaaacatcacggaagttttgattatgcaccttttatactcccctaagtctcacatataaaattccatgatgtagccaagctaccaataaatttcaagtcacgatttagtgagctacacctaactagaattatcagcaaacgtacacctcacagaacaagttataatcaaatctagattccacgtttaactccaaaagtagaattcagatcgatgccctacacacattaaatgtgaaacatctctgcagcagctaacgtatcgttccaaatgaatctaaacagttggcacctcatgcatcgccccctattccaacccgatttaacccaaatcacagtgggccaaccaatctagctcactcattcttcgattcgtgaggagaggcacagaggtgggaggtagattcgagatagaagccgtactacttactagtagaggttgcacttgaggcggctggtccacttggagtaggatcgcggggcggtgaagcgggagaagaactcggagacggggcgcggcggcgtcgaccagtccacctcccgcagcgcgtccaccagatcctccgcagtcacggagctccagtccatcgccgccgccgccgccgcctgagccgacgagctcgccgccggctaggaaatccggtgacctagagaggagatggcgagtcggcggcgacgcttctagatggttcgaaaccgacgaggagagggcgtgaggaggggcaagtggttcgtggaagagctgttcggattcggcgacgtgtggcttggtcggatcggaaccgatcggacaggcgcagttggcacttgggacgaagggttggtacatgactggagtactggacccgttttttgaccgcccattctatagatcaacgggtcagatcgagtaatatgatcacccgagatgatagccattttttggttgattcccgcaatccagcattggttcctggcagcggggaactggagattgtctgtagcactactgatgtattgtgagacactgacacgcaagtttagatgtaagggtttaattcaatccatgtcattgaaaatataacattttagataaatattattacagtgcgtctatttgtagccgtgtcactgaaattttacaaaattataatcgtgccactgccgttatgttttctatcttctttctctataagtgagacccacccgtcaaatacatttttttcttcatcatctctttctcttcttttttttttcatcaatctccaccacttgttgagccaaattcggcggatggcaaggagggcgcctgcgagggaggcgacgccggacagcagcgggcagcatgtgtcgctggccttggtgccgactaccgtgtgcaccagcccgttcagcatgttcacttacgccagctgttgtatttgtcttttacacaagtcatgtacgtgtctcaattttttggagaggcagatgaaagcatgaattatgctgtcattatccttgacaactttacacgatcaagatatatttttttccactttactaagtcattgtacttagtatcttgctaaatacttatattttaaggattaggcggcatcggaggcttaggcgtcgggcagtaggagaaagcaacagccggtgctgtgatttcgatcgggcctaacaggtgcgagctgcgcggacagggccaacgccataatgaggaggatgacgacgtcaatgcagctgttcttggcagcggtgcccatggcgccgatgagtgaggagctatcgccacctcccttaccagcggtgaagggagataggaaaataaggacatgttcagattgtagccaaaataaatcttaccaaattttggcattgtcaattttagcaggatttcttatggacaaagtatttgttaaatttagcagcaaactaaatgtagacattttttaagtaactttgacaaaaaaaaatggtatggttgaaaatgacatcaatctaaacagaccccaagaaaagaggggagaaagaagattaatctaacgggtgggtcccacttataggaaagaaaaaaaagatgaaaaatgtgacggtagtggcacggttctaattttataaaatttcaatgacatgactacgatttgaataaacgaattgtaatgacatttatctgaaataacatatttgtaagggaaaagtctgaattacccttgaactattgtgtgcgtatgaattactctcttagatccgaaaactagaaatctttcaccctcaagtattaataccagacgaattaccccctaactcaatatggagtggttttggtcctacgtggtagtccagtcagcatttttttcttaaaaaagggtgacacccacatgtcatattctcttcctcgcccctcgccccgctctcttctccctccgattctctcccaaattggtggctgggggcggtgagctacgagtggcggggtggaggcggctccacaagcagcgagccggaggtggagggcgacgaggaacggcgtggggtcctaggcggtcaacggcatggcccaccagatagacaacgagggatacctccgccactcgctgcctgaagccgcatccgccactcgtcgtgtcccctttccatccgccgatgaggaacgccgcctggcggtgtcccctctccatcctttcagtcgtctctgctggaggccgaggaggaggcgcctccaccgcttgccacttgccaccggcggtggttcgactggaaaaaaagggaaccagagcccccgccagtccagtccccttaaaagatcgggcatgcaatcaggccggagaaaaccagttaacttgggtagtttttatataaaccggggattaaaataccaagaaaattggtggagaaaccagttaacttgggcggtttttatataaaccagggattaaaataggagaaaaccggttaacatgggcagtttttatataaaccggggattaaaatcctaagaaaattggtggagaaaccggttaacttgggcggtttttatataaaccgaggattaaaatctcaagaaaattgaccgattaacttgggcagtttttatataaaccagggattaaaatcggagaaaaccggttaacttgagcggtttttatataaaccggagattaaaatcccaagaaaattggtggagatgaggattcaacctcaagtcataggattgagagcaccacacggtagccatgccaccatcgtaccgcttgtgctattatataaacatttattctatattactaatcaaaccgtggttggaccggacaaaccagtggtccgaccactaaaccagtgaaccgagagctcaatcggttcatttatcggtccggtcttaataactatggtcccaacgcctcccaccgctcaccgctcgctacccctagtagccaatttggatgagaatcagagggagaagagagagggtgagggagagaatatgacaggtggtcccacctttttttagaaaaaaaatgccaactaaactaccatgtataaccaaaaccactccggattgaattaggagagtagttcgtccggtatatattaatagttgaggatgaaagatatctgtttttcgagtctaagggggtaattcgtactcacccaatattttatggggtaatttagacttttccctatttgtaatggtatggatcgaattaacctatcagttatgggcttatggctactgtatctacggcagaggatccnnnnnnnnnnnnnnnnnnnnntagtagaataacttcgtagccatttcttcaatgaggctcctttctgttgcattttggtttagctagactattgcacgttgagtagcatcaccatctaccacatgctcctactccctcatgtcaatatatttaaagtttgagacaacaaaatcatattaaatcactcactaattttatgtcctaaaagctatgtaaaagtgaccatagggagcatctgttaggcggagctgtgtggcacattgattctaggcttctagcatatctattgtcgtcagattatgctaagtgccccaaccactgattaggaggaaaaaaatatgcggaagttttaaaattttgattgggataacaaccgtcacaaaagataaacaagtctcttgaattgataatggggaatacccactgaaaaaacatcaaatatgtgaatacccgtgaaaaccggatttaaaagttctctaaattcatgaaaaaaaattactagaaatagttgtaggcgtaaaatacattcacaccaaatcaaagttcaaactcaactttgtttagaagtaacaaaagagacaaaatttggatgaatgacaatgtagaaaagattaagaaaaatgaatttgcttgagaaaagaaataaatgaattgccaatgtataaaagagaaaaacacactggcaatttggtgaagagagacaattggtaatatacaaaactcatagctatagagaggaaagaagaaaaaaaatcattttttttgccaatgtacttgaactcaccctccgtcgagcaaagaatgtaattctaaaatttgtccaacaaagagtgcagaaactcatatgagaaaatttgtcagttttgccaacgtacaaaactcacgaaaaaacaattacaaaactcagcaaaaaaaagttatcaattttgcccgtgcacaaaactcaatcagtaaaatatttatcagttttgccaataaactcgccctatgtccaacaaagaatgtaattctaaaatttaaaatttgtcctacaaagcagtggcgaagccaccgcccagataccacaggcagccgccccgctcgctgtcaaacgttccattgaatttttagctcttgaaaggattgaccatagaactggatatagtttgagttttgctcagggttaaaaatctttctggctcagctatactatagagactgcagaaacttataggagaattttaactcagcaataaattttgaaagagtgcaaaaactcatagcaaaatttcaacttagcaaaaaaaaaaaagaattgtcaatgtctcaccctctgtccaacaaagaatgcaattctaaaatttaaaattagtcctacaaagcaacggcaaagccaccatccggctaccacgggcagctgcccatgctcgccgtcaaatgttccattgaattttcagctcttgaaaggattgaccatatttgaaagagttcaaaaactcatagcaaaatttcaactcagcaaaaaaaaattgtcaatgtaaaaaactgcaatgtctgagcgtgcaaaaactcatgggagaagttttaactcagtgaaaaaaatgtcaatgcaaaaaataagagaaattttgcaaatacaaagaagagaatttttgcaaaaactcataggataaattttaactcagcaaaaaaaaaattgtcaatgccagaagagaaattttgcaaaaactcataggataaattttaactcagtaaaaaaaaagtcaatgccaaaaaactcataggctaaattttaactcgagaaaactcatatcattggataaattttaaatctcaactcaaaaaaaaaatcataggctgaattttaactcgagaaaactcataactcttctcataggataaattttaaagtttaactcaacaaaaaaataatgtaattgcaatgtctgagcccataggataaattttataaagtttaactcaataaataattgcaatgtctgagccaataggatgaattttttaattgtgtctgagccaataggatgaattttataaagtttaactaaaaaaacattgtaactgtgtctaagtccaggttcgaactggagacctttagtgtgtgagactaacgtgatcaccaactacaccacccagacctttttgtttatataagcatgcacattttaaatcaatgttaaatcaacaaattgcagaaagcaaagatcacggatacaacgcagacgctgtcaacagtcaaaatctgttttcatcgttcatctaacagccgcacttttgccggagtgcatcggccagttgcttaccttttctttgagacccagcggagagcatgctccatccataaatatctggattgcaacagtaattgaagtctgcaacttcctcccaaccatgcatgtgcatcgatctctgcacgatctgcgcgccgcgacctgacaagcaatcggtgcatgcatgcgcacgcatctcggtaagagcaggacctaaatacaaggccacaatagaagaaaacaaacgggaatgcgtcttttgtgcatctgaggctggtccgtgcatgttaggggcttgctattggtgcagtagctattttgcctatttgatgtgttatcacacacgtctctataactgtcatgtagtagtagtagtagtagtattcatttttatacagatcgactgggcaaatacagtgcagaaaagttcgaatcaagcagcgaaagtatggtactccggccgtatacatactactgaaactgactcaacactttggacacagatcgcctaccttcaccctgcacatgttgcagcgtgcaaacgcaatatccattgtgctgaactgctgatctccgttgtctcagctaagatgccatacatactagtaggaactactgtatcaatctgaagtgcatagggggcaacatcatttacatctggtgaacacaaggcgacaactcaatcacatgaaaacttatcaggtctttaaaaaacttggcgatactgtgacggtgtgaccggagtaggagtaccacctggagtacatagctgtacatgtattcccgtaccaaaagaacacagctgtagcttttcttttttggcaaaaaaaacatgccatgtataaagcgatacttgtcacaacttcatatacaatttttaaatctagtatctttagctcaaattttgttttttttagaagtaatcgggaatatactaggttaccctattttatgcaagaatctaataatcccatcatttcacttatgtttatacttatataagccaaattttgataatttttttacttaattttgtgatatttttgtttcatcgtagtttattttataacatctacttttgaatcgctaagaacatgtctgtaaaacatttagctatagattattatttttagttaatgataagccaagtgaataagcataaacataaataaaatgatggggatgttattattggagatttaaagccatgccaaacagatcattaaaaattgttgattgttgaaatgcccagacttcaaactatgtatgcgctaccatttatttttctatcaagagggtaaacactaatgcactttacacgctcatgaacttctggcccataataaccttacacttcgtaccacgatggtcttaatccaattctttcaaattactcatctggttagtaaaatggattatttattttattctttaaaaaaatgcatttttaaaaaaaacctttattttatcgcaatgctaagattattgttttacactatttatcaagtttatttcttaaaatatttaacataacttataatcaaatcgagcaatataatccactcaaatcaaaatcaataaaactatagtattttccctatttctcttgggattcatctcgggattaatctcagatgtagatcgaaatgctatacaagctaggacgtgtgtgattttagtgcgaccgtgtgttaaccgtgtattggaggtcgatctgcggctatccaattttcttaccgtggagcacgtgtgctatgaaacgactggctgtacacgtttcaacattttgtcttctaccctgaaaatgtcccaagtattacagtatttgatattgatttttttgtgggaagtgcgtgttatggactaatgattgcattgtggagacaacaagcaccatccgtcgtccccgtccatggctgatcagataggacacacctacgtgacacgtatggttccaatgatagacggcagcagcaagtcaggaacgtttgatcctctgcacgcagagggtcttacgaatggtacggtgtacgtgtgtgtgggagaaacagagaggagacgaggacagactggagcaatggagtggatgaatggagggtagacaagtgtgtatttatgtggaacacacgatttgtcaatatccacgttagctagcaaaagcaccacgaaataaacaccttaaaatctgtcatcgtcgtatcatgcatgtcgaatgttttggttgcaaccgattgaagtaaatgaatttaggaatttgtacgtgaaaacggtaggaataatcttgttaagtatatctccatgaaacattctttatgtccactatctcgaaaataagtatatttttcattcgtgctatacatatcaaataaaaaatattatcatcattttatcaaatttcaatataattatttcatattttatctactcccaatgctttgccccatgcttttataaactctaatacaacgattgtttaaaaataaacttattttagaataaacaggagcgaataaaaataatcttatttcgaaacagtgatgtactagtttttaggaatttggtcagtatttcagttcacagtttatccacaattaaaataagtggttactgtggctgggcctgcgtgagctgggctgactagagagagggagagaccgcaacacagaagatggcgatatttttgggagcaaaccgctgattccacagatccgggagcccatgtggaaagcgcccgttggcggttcggcgatggttacgggccatcacggggtccgctcgccgcagacgatcgcggcggcgggcgggatctcgccacacacgtaatccgacgcccgcgcgacgggacgggacgcggctacgggctaccaccacccatccccaccaccaccaccacctcccttcctctcccccttttaaagccgtcgcaccctggcggtgtgtaagcctccgcccctccccgtatctctcgcgtttctggtctaagttccacgccacttgttgccgcattccttctccctccctgcaaatccaatccaatccaatcccaccccaagctcgcggaggaggaggaggaggagatggggagaggagggatcggcggcgcggggctggtggcggcggtcgcgaaggcggacgtggagaacaccgactccacccgcggcttcgtcaaggacgtgaagcgcatcatcatcaaggtgagtgaacgagggcgacgtgatgcgcgggttgacgatcccgtcagcggcgtccggcatgcgactgtgtcctcccttcctgtgaaacctgccgttctgccgttgttgttgtttgttgtttcctttttttttcagtgacgatagtttgtttgcgcgatctgtgatcggtgaaactcgaggctctctcgatctgatttgcgaaggatcggagaacctgacaaaaaaaatggccttacaaactgcaatagatttatttcattttttgtttttgggagctgcagcatgcgttccaaaggagtggttctaatctattcttgtgtgctgttcatgttcgtacttacgtttgatagattcatacaacgcgtgaccataagaagaacagcagtagtaggtaatttttagtgaatttttatgagctccattatgacagcatatgctgtcacccgtgatttgtcctttttttctattttttttaatttaaaatcactatggctatatttttatgtttaactctttaccattcatacgttttttaggtttaactatttaccataaatatgtttttaggtttaactatttaccactcattaattagtaccattctctaatgaaggatattattttttttccctctaaatatatgttctgttggctggcttaattcgacaggtcggcaccgctgttgtgactgggccgaatggccggttggctatgggcaggctcggtgctctgtgtgaacaggtaaactttccccccaaatttttttaccagaggttaatgctctgaccaaccgagcttgtgctaatcagtgtcagttaaccggtgtgataaatttcccaggtgaagcagctaaattttgaggggtacgaggtgattctggtcacctctggtgctgttggtgttgggaggcagaggctcaagtaccggaagctcgtcaatagcaggttgcagagagttaattggctctgaacagtaaacagtgttctgctgtagcattcatttctgatctctctcttgcttgcagtttcgctgatctgcagaacccacagatggacatggacgggaaggcctgcgctgccgtcggtcagagtgtgctgatggcgatctatgacacgttatttagccaggttggcgtgccattcctgatggatttttgtgtaaaaaatatgatttttttgcatatattttgacacgttaaacttccttcgctgcagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggtgtgtttcctaatgtgatttgtgtgcactgggagcttcactgatatatacgtattccaaattccattaacaacaaacactaaccttttacactttactgattgtaatgatcaaccgtgtgtaggattcatctggcatattctgggataacgatagtttggccagactgttagcgcaagaacttaaagctgatctccttatcatgctcagtgatgtggaggggctctatagcggtccacctagcgatccacaatcgaagattatccacacatacgtccatgaacaacatgggaagttaattagctttggggagaaatctcgtgtgggaagaggtggaatgcaagctaaagtagcagctgcttttactgcttcatcaaaaggaatacctgttgtaattgccaggtgagtaaagcttgttttcttctatcgttgcatgaattgtagcacaaatgttaaccaataaatatatgtctaaaagataatatactgcaactgcaacaacgatttatattatttttcagtgtataagaactatatgttctacttatgatggttagttacactgtcacgtggtgttgtatttgtacacaagtgtttacacattgactaagacggtaatattttgatattttggaagcactttcctgataataatagttgagaatggagagcagctgcatgcctgcatcacaattttgttttagaaaactcgtggactgctttagttgctactattaaccacctgtacgaggctctggtagagacagtattcaatagtatcaaagtgctgcatcttaattcctacatttggtgtgttattatgaaactagctgggtagcccgcgcaattgcgcggctagcacctaaataaaatcatataattttttagtatgattttacttaaaatttattaaatagctatctcatgtcttaagagtttgaaagattaaaccttatcatccccgtgtttctaattatatatattttttaaaagtcacaccagttgctaccccttatgacatctccttctttatttgcttgctcgatataccactatttctattcattctccttgaaacctttaaaaattagatcttatagtttttagagtttattgtcatgttgggtttcgtttttataatttctagacgtcccgtcaaacgttgccattatactcctctatggcccgtctactgtctcttttctttattgtcattgagattttaaaaatcgaacataattatcgtttcggttcatttttactttctagaaatcccgccaaaccatcagcggcttttccattgtacttctctacggctcgcccgctgagtcccttctttattgtcattgagattttaaaatcgaacatgattatcattgtttttttttaccttttcgaagttcggaacctttaaaaattgaaccttgtagtttttagagtttattgtcttgttgggttttattttttataatttttagaagtctcgtcaaacaatgccactatgctcctttatggcccgtccgccgcctactctttctttattatcattgtgattctaaaaattaagcacaactatcgttgcaattcattttttattttctagaagtcacgtcaaacatcaccggctctaaaactatactactatacaccccgcccactgcttctttttattgtcattgagattttaaaaattgaatatgattatcaatggggttttttttttactttctagtagtcccggcaatcacattgctcgtttgcttcacggcctgcctatcgtccctccttttaatcgttattaggattctatttggtgttttattaacagtttttatatgtcgtatcaaccgccaccactctactcctttataggcctcttacttaatttatctcgtcatgtgttttagatggtctttctttaaatagtctttatttttatcacaaattttagttatttataaattgtattcctaattgaaatcttatttttctttttctaatttcagaatttattttttttcaaattttaattaatatcgtattgtgttattttagtatttttattttttattttcaatttcagttgtttcaaaattgtattcctacttgaactctcttttagtttttctaattttgaatattattttattttttattctgaattttaattaatctcgtattgggtttttatatggattcttatttcaatattgcttatttttaattccaaatttaagctaattttaaattgtattcctactttaactcttctttttttttgctaatttcggattttatttttttattcctaattttaattaatctcgtaattgggttcttatgtggactctttttttaatattccttattttaattccgattttcagctattttaaaattgtattcctacttggactatccttttattttctaattttgttttattttatttttatttttattttgaattttgattattgggttcttatatggaaacttctttcaatattgcttatttttaatttcgaatttcagctattttaaaattgtatttctacttgggtctctttttttctttctaattttggattttattttatttttattttgaattttgattaatcttgtattgggttcttatatggaaacttctttcaatattgcttatttttaattccgaatttcagctatttttagattgtatttctacttggactctccttttctttttttttctttttctccgattaatgtgggaatttctagcctctacagcgaacgtggttccttctttcaaagctgtaatttattataaattaaattttagttgttaaaaataatatcattggatattcatttaaatttaattttatatgattatgattttgttgctacaatgaaaaatttaaagttaaagtttagtttttaagaccgtactaaatttgaacacgccttagcgagttggacggagagatgtatctctaccaatgcataagttttctggtctattttctctttttttcatccataggtaaaaaaaatcacattttaattctaattatactggctccaaaatatatatgcacgcactgtgtttgaatcctaatcacctgatttgttgattgatccttagtgtccatctaggataagaaaagaatcaaagcaggagtacgtccacctatttggacttgtattctagtacttgatcagtgtcgtccgtttgatctagcagttgttttctattcagacttctattatcaaagttaatctacaccatcaaattctagtcccagtataatctaacggtctagatttttcttttttctccgattaacgtgggaatttctagcccccacagcgaacgtggtgcctcctttcaaagctgttttaataatataatagatttcaagttgtcagtaagacagtaagtaggaaagcttgtgtgtattttcccaacagcagtcttgtgattcaactctgctttctaactatttttattatccatgaagtggatttgcaatcgatagcattattaaggtcatgcgaggagagaaaatcggtacgcttttccatagggaagcaaaccagtggggttgttccaaggaagcaacagcgcgtgagatggccgttgctgcaagagattgctccagacatctacaggtattctttcctttcacttccttttgtgaaggaatcaggcaatgcaattttcaagctataacttcaaaaaacaatcaaataattgcgtgttttcttcatgtcatattaaattattacaaaggcatgtcgtcgtctttaagtagtataaatatcaatattgtttattttcttgctgcctttgctaactacttgtgttgcatgtggtcacctaaacagaaattgtcgtctgaggagcgtaagaagattttgctagacatcgccgatgctctagaagcaaatgaagatctaattacatccgagaaccaagctgatctggatttggcgcaagatattggttacgataaatcattggttgctcggatgaccataaagccaggaaaggtaggccagatacatgtgccatcttctgagcggtgtcatctttaagttcattatttgttgaagtgattcttggctgttgtatgaaatgtcctcactatatttaatatctattcgaagataaaaagcctcgcaggatcaattcgtgaaatcgctgatatggaggaccctatttcccatacactgaaaagaacagaggtgaatgcatataccctattctaaaatccaaacacgatgtgataagtactacaatcaatcaatgtgataagtactacaatcaatcatagcttcatgtgatttgtaaccaatgaaggacttgttttgtaggttgctaaagatcttgtttttgagaaaacatattgcccattgggtgttctcctaattatttttgagtcccgtcctgatgccttggtacaggtaaaatgatttttttagttggaaagaaactgtatcagttaactacaaagcaacgttatttatcatattaacataacattgtacagattgcatctttagcaatccgaagtggaaatggtcttctcttgaaaggaggaaaagaagctatgagatcaaacacaatactgcataaggtattatgtacttaactaactgatttagtagtaatgattaatgaagcaatagtaggcttcagtaataccaacatgctgtcttttattaggtcataactggtgcaattccagatgttgttggtaaaaaacttattggcctagtgaaaaacaaagatgaaattgctgatttgctcaaggtgagtatgtaaagtgattctttgggtgataaatttaagaatttaatctaaaccagaagtactctgtgcagcttgatgatgtgattgatcttgtaataccaagaggtagcaataagctcgtttcccagatcaaagcagcaaccaagattcctgttcttggtcatgctggtaagcttgtttttgttattgaattcttgtcactaaatattactagtatgataatggttatttattttgcataaactaagcataatacatttcctttttttattatgatatacattgaatgaatgttttttttcttctacagacggtatctgccatgtttatattgacaaatcagctgacatggacatggcaaaacgtattgtattggacgcaaaggttgattatccagcagcgtgtaatgccatggtacttctctaatttacaaatttattagcgtgtgcccatatggtgatacctctctatttattgtacttttttttaaaaaaatgtatattacgaattgtatgtgtgttctacatcgttgctggccactcatgctaacttacaagtattgttgtcgaacttctggctaaaagcaatagttcactgtggaagatgccattctattcaagtctaactttctatatttgtccacttaatttatttcttggaaaattttatcatttgagcacagatatctaaatattttttatattctgtgcaggaaacgttacttgttcataaagatctgaacaggacagaaggccttgacgatttattggtggagcttgaaaaggaaggtaaaatccacacccttgtagttgaagtattgcagccatttgtatcttgacatgtgttctgcaaaaagtgctacttcctccgtttcacaatgtaagtcattctagcatttcccacattcatattgatgttaatgaatctagacatatatatccatctagattcattaatattaatatgaatgaggaaaatactataatgacttacattgtgaaacggagggagtattttattttattatgagaaatgatgaacagttatgtagctcaacatcaaagatttgatgttcttaattactttcaatgcttctcaagggagcatattacagattttacttattatgttgcagtcaatccaaaattgctttgcaacacgagttcttgtgcaaatcagcaaaaggggatcagaagagcactaatggattttaattgatgtcatgttgcaggggtagttatctatggcgggcctgttgcacatgacactttgaaactaccaaaggtagattcatttcatcatgagtataactcaatggcatgcaccctcgaatttgttgatgatgtgcagtcagcaattgaccatataaatcgctatggaaggtatgcagtttttctccatactatatcctcatcactttttttttttggaagtatgcagtttttctccttactatatccccatcatttcttttttttttttttgaactaaacttgattgtgttaaatatatgttcatttcagtgcacacacagattgcattatcactactgatggaaaggcagcagagacttttctacagcaagttgataggtgtttaactaatttcctttgcacaactattatgtttgccgcttttagtacataccttaattaatggagttattcttctataaattgcaacagtgctgcggtattccataatgcaagcacacggttctgtgatggggctcgctttggtctaggtgctgaggtatgtcctttaaatttgtatcactttataacttggacattttcgttaactagttatcaaaaaaaaatagttatcgaaaatatatgttgttactattgaatggtcagcgtttcattcagtcccctattttctttcctttatcaaatataggttggcataagcacagggcgcatacatgctcgggggcctgttggcgttgatggactcctaacaactcgatggtagggttatcatgccatattgtcttcatgtccaaacattaaggacaatactattgtgcaagatgttttctgcatctagcattttatcatcatacaatattttttcagctaaatgttattatcatactaaacagatggaaaaaatcagtagttttgtatttactactagtatcttcatgtaatatgtgtgcattggtttttcgttatatatagcattttacgaggaagtggacaagtagtgaacggcgacaagggagttgtttacacccacagggagctccctttgcagtgaggtaggtagtgttcttttattttgaaagatggcatactactgattactaaccttcaacatctctggtttcaggtgaagtggcttgtgaaggagctgttgtagagcaattttttgcagacgctcaccgtgctcctccttgagagctgcttctcttcatgacatgcaatgggagcacgaaagcatgtcaaagcaggaagtaatgaagggcgaagtaggtcagaaacttatagtactatgtactatggtgttgctacgtagttgtgtggtattccttattattcattgtaccatgaataatttatgccaatgtcgtagtagctacatgtaactatattggctttcatggacacgtctatggtactagatgtaaaactgctagatggctttagatgaacatctcagatttattttccatagaatgcacatatgaaagtacctgagcgtggcgacgctggtgctttccatgataaagatctggctggtgtagggcggtctgctgctgaagccggagacatgcacatcgcagaagcctaatcatcagactggagcctcaactgaaccatcccgtatctgatctgtttagataaagacagttatattagaaatcgccaataagtctcggacgaaaattcccagcatttcacaacttaagaagttcagaattctagcagctattcgtaatgcatcccattgcagtattgcataacaaattacagagatgaatatcaatctcccagctcagggcctctaaccatgacagatggtagatactctcgtatcagtgtcaacattaggtggggatattacaatattacatccatgtctggtatccacagtaccatcaccattccaaatgtgtcaggataccgttactactactgatgtgttaaacagggatccatcacaaatgtatcaaaattgtctggcagagattccaattctctccaaacaaacaactcagcaatcttttgaggtacctcctgaaagactgagtcatgatggctagtctaatcaatatgttaggctatacaacaattcctacgtcttcagtggttattctgtataaatcagtaaagctcccaaaaaacattaatagagtccgcagcatcttcaccaataatccccacatgaacaaattccatccctgaagtggtgaaaccgattcacatccctcacaataatctctcgctctgcatatttggagatgaacttggtgacggaatgacagtcctcacatagcctgaggttcttggtgatcctgatgacttctcccctgccagtgttgataagcccgaaggcaacagctagcttctcactgtgcccaagcaaaatcttctccttctcttcttcttcaatatcatacaaaacagctcctgtgtcaggcacatagccatcattcttcatctgtgtcacaaactcacctatcagagcttggagctcctcaatctgaggattcttgttgtccacagagacaaacatgtgcaatctcttcttcacctctatccagctgcatccaggcaccttctccaacgcatgctcctcaagaagatcctttagcacaccaacttcactatgcaacttagctcgagcatagatatcagcaaggagtacataatttccagcatttctaggctcaagatcaaagagttgtgagcaagccatctccgcatactccacatggcgatgaatcctgcaagcaccaagaagtgagccccacacttgaggactcggcctaatgtgcattccctgtatgagctcaacggcttcgtccaaatgcccggcacgaccaaggagatctaccatgcaggcatagtgctctgcacgaggggtgacattataatccaccatcgactcaaacagcctcttcccctcatccacgagtccagcatggctacaagccccaaggacactgataaatgtgatgatattgggtgaaacgcccatttgggtcatgtcttcaaacacctgaaccgcttcatggccaaatccatgcatcccatatccagatatgagtgtattccatgacacaacatccttccggtgtcctattaaatcaaagatatgccgcccagcttcaagacatccacatttcatgtacatcgccatcaatgcgttcagaactgaaacaagtgagtcaaaacccctccggaggatatacgcatgcaacaatttgccctgcccgagagcgttaactccagcaaaagcatgcaagatgcatactattgtgactgaattgggtacaaggtcttcatcagaagccaccatctcctggaatagcaaaatggcatcacctggtctctcgttcttggcatagcacccaatcatggcagtccacgacacaacattcctctctggcattgtagcaaacacactctcagcatagctgacgattccaagctttgcgtagcagtcaataagagtggtggcgacatgtgtgtgcaatccgtagccacgacggacagcatgcgcatgtatctcgcgtacgagggccgacgccggcacatgagacgttgatgcggcaatgcaggccttgagtccgtgcgcgtagctgtagctgtcgaccggaacgcggagccgccccatgtcagccaggcgcgcgagggcctcctcgccatggtcggcgagcgcgagcgccttgagcagcgcgttccacacgaagatgctcttcacgggcgcctcgtcgaacacctggcgtgcggccgggagctcgccgagcgacgcgtaggcgtcgatgaggcgggtggagaggaacgggtcggagcggaagacggggtccgccttgagccgccggtgcacggccgcggcgagcgccgcgtccccggcccgcgcggcggcgaggaggaccgacttgtaggtgcgctgcgtgggcgcggggaggccctggaggagcgccgcggcgcgcgcgaggcggccgctggcgcacagcgtctgcacgaggtggttcgcgttcgcgggcggcggcgtcggcggctgggacgcgagcgacgccacgcacctggaccgcgacaccctcgggcgcgccctgggcccggccgccgggcgggagaggtggaagagggaggcgggcggcgaggcgggcgcgggggcggacatggggtggaggaggcggaggcggagcgtgcgcggcgcgagtggcttcaccgtgttcgggatatttttccggtgcggtgtggtcggagttcgggcagcggatggggagagaggcgaaggcgcgccgcggcggtggagaagcgtggggatttttgctgtggtagtgacaggccgaccgttgatgggctacgcaatcttttgcagtttgttgggctgacggattgtggcatgggccggaatggtgataggccgcttttgcaccgtgttttccaaataaacaggtccaaacagaaaacacctcggcaatgataggataggatcatagtagtaggagagaagaagtctggaccgctggtgattaggcaagtactataacgatgccgatagcttttgccactgtcatcgattaatcattattcctatttacaggttctagttttggtggctggctgtctcttgtacaagaggtactgtctacggattttttttttttagtgccatgtcaatgctagtagtaacagaaactgtactgaacatgggcatagagcagcatgaattgataaaaagggttgtgcctgacgggaaagccagggtgccgcttcccatgaccaatccccctttgatgctctcgcactgcgctgtgtgtcatttccgagaaaagcaattattctatgcagcaaacagtatgtacatgtcatttccgagacaaaagcagcagatgtgccactgccactgccactgcaattgttggatagtggtgggagcagctgcagctgagagagagccaccggattgggcgagatatcgacaaaaccaaacaagcattttgaaaagcgttccaaatccaatgagggatcaaatcagccgtatcttagagtggaaagaacatatgcttaacgagaatccatcatcacagattagattaaggaaaggtctctagtagtccactgcctcaacttttgctcatgtgccccctgtgcccatcctcacaagaaaaaagtaaagttagaaacaaaattgaagctttgctttcaacaggcatgtacctggagaaggaagcaagcagaaggcctgtgtaccgaagctttctacagtgccagggtgagaactcagaagaggccatactatctgcagagcttattgaattgggataccatagctaattttataaaaaaaaataaaccagtagtactatatagttgtatttttgtcatgaagtagtaacagtgagtaaattagcaggagcaaagttgcagcataacaggaggaacaaagtagatattactattccgtaatgcattctttgtccaaaacatatattccgaaattgacttgtgctgatctaaagttgacacgcacacacattccgggcttttccggcttgctttgatttcgttgcgagatgagaagtgtaatactctctcctgtttcataaattttgacgttttagatgagattaagataaaacttttatttgatcatcaatatctttaaaaatatttagtttaaaagcactataacatcgtagatagatctgtctttaaaaaaaatgtaattttttttgttatatatatattgtaacaaaaaggtaaaaaaaacataatcaaggacatacttctaaaaccgtattatatattgtccaaaaatatcaaaagttaattggagggatactagtacgaatactggtagctttgagttactccatgcctcacacgccacacatgtgtagttacagtggtcattgcatgacatatcgaaagaacaattatgcgcctcatccaccgcctgacgcccaagaaaagaagcagcagtgcctcttttcaaaacatgaacagtgcttgcagtacctgctacaccttctttttttagggagttgttgtttgttacagtaccctgtgacgtgcatggattcccctccaaacgaaaacaacgtgcatggagccatggaagaggggtccctcccccccccccccttttttcttctttacttaaaaaaattttaaccttaaaattctttttacatacaactcctcaaactttattctttaaaaaaattttcaattctcaacccttcctttaaaattatatacaccttttatattatctacaatata

SEQ ID NO: 4124 - DNA, 16839 bp, Oryza sativa
  unsure (1)..(16839): unsure at all n locations
cgctcccgcgcggctgtcggggattcctcgccggggctgtatgttttgtgganaagtgcgcgcccctcttgccccaagaggaagaaaagcgccggccccggttttcccgggtaagcgcgccccggtgttggaacacggggtggagcgcccccggggggacgtttcccgagggggaacgccgcccgggcttccttaatagaggtcccgggcggggttctgcgcccacctgctagcttggaggggtcgtcttttttgtgggtgcctcggcccgcgagggccggaacccttttggaaaaaacgcccagccaacggcggcccttttttgcgggttcccggggcttttttggttggccctgtttggctcaccattgttcttttcccggcgtttattcccgttgatttctgtgggattcaccggttttaccgccttttggagtgaacctggatcccggctcggcggcaccgggaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtgttatttttctttttcgggtttcagagtttattttttttcaaattttaattaagatcgtattgtgttattttagaatttttattttttattttcaatttcagttgtttcaaaattgtattcctacttgaactctcttttagtttttcaaattttgaagattattttattttttattctgaatttaaattaatctcggattgggtttttatatggattcttattacaaagtggcatattttgaattccgaatttaagaaaatttaaaattgtattcgagctttaacttttcttttaatatgagaaatgcggattttatttttttattcgtaattttaattaataaagaaattgggttgttacccccccccccccccccccactcgagctgcctatctccaggtaacaacgctggatacacatacaaaattcatccattcacataataatcaaatgatgctgcagaaccaaagatgcatggagccaagacagccaggctccattggagagcttctgcctgcagatccagacaaattgtttactactaatgcatcgatcgaaaaagatgagccaatctactgcacagaccccaacgaaaattattagtgtaacagaggccagttagaggttaacaaatggtcaaatcatggtttgtccaagctttaggaggctacccccgtctaaggatacaagacatacttagaaaaaagtctactaacttagtttaatactgctcacccaaagaaggcagaaaggctaacaaaacaggctgaaagataaatcctagcaggtcttattctacagcgacaaattgaagcttcagctactttagtacatttggtaggatcacctcactttttggccataacatcagcttctttttctctgccagctaagcccatttcgtcatcacagtacaaggattaatctaagcatataacaaatggtacacaactttactgccttgggaaggtattgtcaatctctctatagcccgcaaggtgtcaaatatttgacagcatacctggatctacatgaagggaagatcaatgttttttcaccctccgaacaaattgattcagactgatcatcaagccatgtcgccaagtgattgacttatataccatcctaacatcatactagcagtacattacaagtgcatcaccagcaacctgaggcagcagccacaatcacccgacaaaatcatgcagcaagtgaccaccaatctccttcccgaaatgccggtcctgacctccaaatgagctcatcacataggcgtcactgacttcctccagtccgaaacggtgagctaggttggccgggagagcagccgggagaggctcggcgatgcagaccctgttgttctggtgaagaccaagggtgagggagacaccgccattgccgcctccgataccaacaccgccgacctgctggtgctgatgatgtggtgatgcaatgttgtgctgcgaggtcagcccgttgtatgcgaagctcacctgtccctggatggactgggacatctgggagagctcatccgggaagccctgggaggcagcggtgttgtggttccgagttatgctgctgctctgtccaggatgggagtccgaaggaacggagggattcccgctgcactgcgaagaatgctgggcctgatgatgcacgctatgctggcccttgtcaaccaccgagtgcttgtgcatttgcctcatctctaggttgtgaatttcttccaccattggcttccacaacctaacccttgcgttgataaaccagttcgatacctgcaccagcatcacaaattcaatcaaaatgtcctgaaaacaaaacaatctagcctgatatactgtgcaatctattcttgaacacacctagaagcatttctatttacctggttgcgtgtcaagcctgtttgttttgctagcatttgcttatcaccatcggtaggatacctgcacgattggaatctgaaaatgtcactgatgcaaaattatagtgttttctaaaagaacaaagtaccagatatagcgcaaaatcaaataatcaagaaatttccgctattacaaaagacacttgtgatgtgcatgcttaacgatggtttacaggatcacaacaaatattttacatggcgaatatccaagcaaagatgtaggcaaacacatcttccaagtcgaaccttacaaaggatttgatcaatacgggaactaataacactaggaccaacatctgacaaataatggatttcagtgactttttttaaagatgatgactgatcctttttttaaagtaataaacagacagacaaaccccttactggatgaaaatggctagcactaaactactgtactaattatctcaaactgaatatctcgagcacatgtcaatcaacttgatgtaaccaccagtagggcttagctacagcctttagatcatatatataatgcaaaatgatcatactacaaaaactaaaaagaatatgccaaacaaactacattatgatgatgcttattatagcctaaggtatgtacttttaagatttagttcgaagtaatgcccatctggcaagttaattccagcattaacgtgttctaaaagccactctacttatgagaagccgggccaccacattcatacattacagccagaaacaacaaatccaggaagttaatacgtgattaagaatgcatcaaacaagcagcaggaatgccactatttagatcaccaagtcgaaagtatgatctctagtagtacagctcaacacacagttaggtacaggtttaaaagttatgttaatgatggattggaagccatgcctgcatgaggccatagccttctatcagacaggcagggtcgcttgctatcaccaaaccatcaacggatcaaccccacggttccagtgtcacgtactactgatcatatcaaaaaggaacaaccacactcaccacaaatgcttagggactactgttatcctcatctaaagcaagcaactgtagcatcatcatcattgtcttggaatgcgtgcagctaatgaacccagagttaaccataaagcaataagaagatcaaagggcttacgggtgcaggaagtgttcgaacagccacgcgcgtaaaacggacacagcgcgctcggggagccccctctgtgggcgccaaatattgtgcggctggccgaacgcgctcgcgctgttcgctcgctggaggccggcgccgccgctgctacccccggcgagcccgaacacggcgatctccttgtttagcccgtccttcacagcgaccttgttgctcgtgttgcgcagctggttcagaatcatgctcttcaagcacttgaagtgcttcgccatcgccctcagcgccaatgccgcgaacggcgcggcgttgctgaacccggcgacggtctcgaacgaggccatcacagcctgaacctgctggtagtactgccggtacctcttgcaaacctaaaaaaagatattgctgttgggttagaattcgatgagagataatctaccaacaaagaatgattagataaaaagatatccatgttaggaaaaggaagcagtgtgcttttgttttcatgtggatatgacacgaacaaagcaagcgtagctcccaattatgggagagagatgttattgaagaacacaggcaaacaaaattgccttacagagggttccaaaaatagaagctttctacattgtactcctacgtagatgctcatgtagtatactcctaattgccatgctccgacatcgtagaggagagcgcatttcaaagctcgaagcttttagcagcgccactattctcaccagaggacaccaacaagagagaattaatggcatctggcatcgcccatgggtcatgtctcaagactttgaaaggacggttagttctaatttcatgtggaggactatcttttcaagcactcacagtagtgctaaacagccgatcaaaatacaatctttggtgataagacgcggaggaacactactattcatcatgaacagtgcagaactgtacaagctcaaaccactcgaggaaaaagaagagagagaacaaatcaaaagatgtatcagcagcaaaggaaatcatcatcaaatcaaaagcacatgcaaccacagtaaataaaagcaatccgcaactgcatcggtgacatgaccactatgtgcaagattcttctccacccaggagtagcgataattgtaacgccgaaacaaggtgaaaaagatggtcgccacaagaaacctggaaggaggaattgaggcggctagcggagctcactcacctcttccatcatggagatgagcttcgtcttcttccactgctgctcggcccccgagatggggccagcgtcggccgctgcgcggtcagcgccgccgaggtcgtgatcaacgacgtcatgatcgacgccgtccatcggatccgcgtcgagcaggccctcgtcggagatggtgcggtcgacgtgcgaagcagcgccgccgacgtcgcagatctcctcgaacagcttctctgccgggccgaggaaacgggaccggccgagcacggcggcgtagccggtgaagggaccgaacggccccgtggcctgcgcgaggccgccgagctgcctcctcggctgcgcctgcggtggtggaggattcgacgacgcggaggagagcgacagcgagaagttctgcgtcgggatctgcgggagcggcggcgccagcccgtgcgccaccagctgcgcctgcgctagagtagggctgtgcggggagtacgacgacgacgaggacgcgtacgagtagaacgccgggggcggaggccacgacccgtgctgctgctgctgctgcggggcatgaccatgaccatgaccatgaggcggtggcgagtccccggcgtccggcgggaaccggagcttctcgcgccggctgtgctggggcacgtggtacatctgcccgcccgccgccgcggccgctgccgcaacggccgcgccggccacgtgctgcggatggtggtggagcaggaggtgaccggcgtgcccgtggtggtggtggtggtgctccgcgcctccaccctggccgccgccgtacccgccgcccccagcggcggacgacatggcgcgcacgcacgtacggtcgtgggtctcttctcctcggcgcgcgcgcgggtgggcacgtagtacgggtggtgcgtgcgaagaggcgcagcgcagtgagcacctggccctggagagagtggagatagaggggaaacggctccgcactttccgagcgcccgggcctggcttggctggcctggtctcactccctcatcactctcccgctctgcttctgctgctgctgtagtgtagcctccctctcccaccccgacccctcgcgtcctcttgttgttttcctcctctttttccccgtttcgcctttgtgctgggtgttgttgctgggttcgtggcgcctttctttctgcaaaggcgagacacggagggggagaaagaggggggtggcgggagggagagatgggaaggaaatggtaagccgtgaaactgtgaaagcgaaagcagaaaggccgagcgcgacgggggagaggagtggagactggagagcgcgcatcgcgtgtaaaaataggtgcagccgcgcttgtcatccgagtgggtgggtgggctgtttggctgccaggacgtgtccgggcctgcagcgtacttgcccttggcgcggcgcgatcagcccttggctggctcgttacgagggaaaaaaaaatgattttcatcttcccttgttttactgcggctgcccgcggttggtactcccacctgtgggggtttgaccattccaagctacgagtagaaaacattccatgtgcagtgcgattaagtcccccattataaatgttgtcctaactggctttcgtacaaacacccatctccctgctttcgaattccacctctgctgcagcaacaatttttgcgtgttaaccccagtactctgtacagggctgtcaaacgacaccaaaatacggtttttatcgcaagcgtgtccacatcactacatctacatgacccaatcccttggctgcttgtgtatagtgtagtactggggtagtacaatactggtcgacccgcactagtagaagcggcaaatcatacgcgccctttaatgcgctgccctccccagagcaagccctccattgggcgagtcctgacgcccgggcccacgactggtcaccacccgtaactgggcccgcaagtaagcaatcacccctctgggccccacccatgacaagacctaacatagcacaccctctggcccacggcccgtctcttcctccctccgctccgagtcccccacgcgcagctccacaccgtcgtcgacgcaccaccgacaagcgggacccacgtcccctacccggttttccatacagcggcgcgcaaccagggatacgggggagagaatcccacctctctttcgccgcggctgttggctgttgcgtcgcgtgggacgtcaccgggggacacgtgccggctcctccttgggcgcggcatgattagcaaagctacgctacggcggagcccgtgacgtggctgccgctgccattaacttcaaatccacccgtccattcatctagccgtagtgcacagagagagaataagtgagcaaaagatacgaggagtacgagcagagtactggggtgtgaaggaactacacctccgggcttatgcctttgttgttactgcagggaccccctctgtagactatagtgcagctaagcacggctaagctactgcctagtgacctctctctacatggatcaacagaacaggtgaaagtgattctcactcggtcagaacagtggcaggacagtgccgccctatcgccgcgggtcccacctcgcagtgtcgacgcgcactgctttgctcaacatttcgtgcatgtgagcacatgaacaggtgaaccgaggcagctgctaagctttggctacctatccccacgttaaatatcttcacgtttccaccgcttccgcctcttctgcaaacgcgatctcacagcgttgcatgcgaccgagcggggctcacgctaagccaacgtgtgcacagcgaacccacgaagcactgctagcacgtactactactacgctccgcccgcgcggtgtttgccacagaccgtcctataccactacacatattttcccgtcgccacagcgcgttggaaatcgtttcacgggggcagacgctgtgtattggcagcggcgcagcgctgtggcgctgtgctaatcaggcaggcagagacacagaacagaggcaggagtacgcacaccgtgccgatgacacgccgcatgcacgcgtgggcaagggccacgggcgcatgcacaccgcaacgtgtatcttctccccagctcgtgcattaggccgtcgcccaagctggatggaccagcttatcaacttgtttatccgagctttccgccttgccgcgagagtcgagacgaagctgcccttggcgccttggcccctcgccgtcctcaccttttcgcgtgtcgatggtacgcacaagtgtgcgaccggctggagtggctggaccggggacccgcctgtattttcgcgcagttcctgtttcgctggatcgcatgtggacacgccgcgttttccctgtttctcgcagcgcacgtgttggctgctgcctgccatggctgccgcacacgccaaaaacgtacgtgcgtttcgtttcgtgcgaccctgctgctagctcatgtgtcccgcccgggctcccgggtgcgttctaaagccaaaagcaattatttttgacgtaaaaagaaggggtagaaccagggaattacacggagcgaccttccagctgctgtaccatagcatatttacagtggagtgaaataaggagaccgaacttttaccagtgaactgtgtgaccttgagattctttagcattaatcaacaacggataacactacttaaaaaatcttcatagggaccggtattataagagccaatttatttaaaatcgacatctatgatctttttctcaccttcccacgatgaaaaaaatatagaaccggcatatttaagcactatagatatcgattctgtttaaaaaaaactcaatacatgcactatagatgcatatttttaatagaactgacatctataaaatgaatatggatgctgatttttttaaaaaaactgacacctgttaaaaaaaacttaatccgtatatgtttgaccacccacagcacccttatcttatctatccatcccgcttgccatccatgcatctctcgtccctcctctccctttgccttcctctctctggtggagcggcggcggccctctcctaacccgggggccctccccccttctctcctcctctagggcagcgtggcgatggagaaagccgaccgatcgggcagggtgcggccggtgcggtggctgacagatagatcttatcagccccgtcctcaagtgcggcgagatggcggtggtggtggaggaggcctggatcttgctagccctctctctcctaggggacctccccccttccccttctcctcctctagcatggcgtggggtggcggccgggtggcaaggtggcggcgtggtcatcagatctcgtcggctccctctcacccaagggacctccgcccccctcccccctccaccaatgcggcattgggtggcggccaccggcgtggaagccagcgttgcgttttttttaataaaccgacatgtataggattggagcaaacgtaccgaccatagctagttcataaccgttacttatggggttttctgtcttagtgtaaaaggctcgttttaccgtccagttctagctgggctatgccaaattttcaataaaactagaaagacttaattaaaaaaatattattaattaaattattactactaattacgtatcatcttgataattgaatatttaataattaattttaatagatactaaattaaaaaaactacttccttttacatttattctactccctctgtcccataatataaagaattttaggtggatgtgatacatcccaatacaataaatcttaacaaacggtctatcctggatttattgcatgtgtcacatccacctaaaatttcttatattataacggagggagtatataacgataatgtaaaagaaagttccttttacatttcaacatcataatgtcgaagcaagaaaaaaaagaaactggtttacttcctctatctcataaaataaccaatacttagatgtggcacattctattactatgaatctggacagagaatctatcactgtccagattcattgtactaaaatgtgtcacattcaatatggaacggaaggagtaccgcgaggtactgtagaacttgggagtatgtttgaatgacacttcgacagcatccgtgccaacgtatacgatgatgcgtatacacgaggtttttgcccttttggacatccatgatatactacgcgcctcgtagtccgcaagaaatgagtgcggagtagatcgctgatcgcgtcttcccgtcgaaattttttctcatcatacggccactcgacgaccagctgcagtaccaggtaccgaatcactctactcctactagcaacgacagtaaggtcaattcagagaagcctgcatgccaccgtttctttccctctctctatcttttctgactgatggatgcttgtcgttgtacgtatctgttcggttccttctctcttcaaagacgttggctaatcacgccctgcttaggggtgttttagatccacgggcgtaaagtggatactattaggatattgcatgaggtgttcggtactagaaaaaaactaattatataatccattagtaaatcatgagatgaatttattaagtctaattaatttatcattagcaaatatttactgtagcaccaaattgcctaaccatgaagcaattaggcttaaaagattcgtctcgaaaattagtcgcagtctatgcaattagttattttttagtatttatttaatactttatgcaggtgtttaaacattcgatgtgatatggtgtaaaattttagggtgggatctaaatacccctttaccacattccatcaaaaactttacaccctgtcacatcgaacgtttgaatacctgcattaagtattaaatataggctaaaaaaagaaattacataaattgtgactgtcgacgtttgatgtcgcgattgcggtatttgtatagtatgtggatcgttggtactaggatatacgcgagactgaggtaaaagagacggagacgaggattttatacaggttcgggcccttgaatcgtcaggtaataaccctacatcatgttggtcgaagccggtcgttacttttattcatcataatcacaccagtacaatatttggggtagcctatctaactgttatcgacatggcggtttgaaagtctgactcgtagtcgacaacagggtagtcttcctcctcgagttcgtgcccggcgagatcagagacagcactagatccctatggccggcctttgtaggtaccaaatagggctgatccaggcatatctctgatgtcgatatccggcggcttgtcttggcgtatgttggcttgtatgttgtgccttctattgttccgtgttgtctatcgtaggtgtcttccatggtgggtgtgtcccctctcctcctaggaggtcttctatttatactcataggtgtctccttgtccaagtagaaatagggaaaccaatatggatacaatccgagtagtcattgtcgttttcatatagaactctggttatctttccttatccggaactccttctgtatccgcaggttatttccgtatagaacatggtatatggtgagtcctgccgagatttagttaacaactattatgtatgtggtatccataaccctgacagtgactaatttgcgagacaaatcttatgagcttaggccctgtttaggctgtgtttagttcacactgaagtttagaagtttggttgaaattggtacgatgtgatagaaaagttgtgtatatgaaaggtttgatgtgatggaaagttgtaagtttgagaaaaaaagctttggaacaggtctccaaacttcaaccaatttcaattaaactttcaaacttcagtgtgaactaaacacaaccttaattgcttgctccatgatttgacagtgctacagtaaacatttgctaatgatggattaattagtcttaataaatttgtctcgtattttgctaacgaattctgtaattagtttttttattagtatacgtacactctatacgacaccctatataatattcgatattacacgctaaaactttacatatgaatttaaacacccctcagtctcatccatgttaagagtataggattaggaatttaggagtactccacgtacctgtatgtaattggagtgtactgtagtatctccggatacggtggatggcgtggctctcagtcagctgggactactggcattcaaagcacaaagcgactcccaagtctgaaccctctcagatcagagtatcagacgctagctgctcctacccctactcctagattacgtgaagtacttctacgtcggcctcctctggagctagccgacgcagcggtagtagtagtagcatctgattgacgtgcgtcagggagcaccagatagcttgggttaacgtggagtacaggctccaaaatctctttgcttactgcctcactccttccgcatcatccccttgtcattagaccagtgatttgacaccgccctgcatgaattctcgttctccctccgatttgaacaacatcggtttcagcaatcggtgcatacagatacaataggacacggcacatactgtaggggtacgcaattgcagtatccgaaacggatgcatatacaccgataccgcgatattatctccgtactaaaatgtattccctccgtcccacaatataagcgattttaagtttttcttacaacgtttgatcactcgtcttattcaaattccttttgcaaatataaaaaacgaaaagttatgcttaaagtgttgtagataataaagtaagtcacaaataaaataaataatatttttaaatttttttaataagacgagtgtgcaaccgttgcaagcaaaaactcaaaatcccttatattatgggacgaagggagtagctatttctagcacattactttgtcccaaaattaagctatttttctacctaccttctcctctcaaccaatcacaaccattctttttcacctactttctcttttcaaacaatcacacaccttcttcaatcattctcatctactttcttaatacccatgccaacataaaaaatgcttacattttgggacgaaggaagtatgtcatatttttagaatatgggatatgatacggacgtattgtcgacgagtgatactcgtgaaccggatgagttgagtactagggtatgttggtaggagggtctacgtaatacgacatcaagcagacaaaggacaacgattatactggtttaggccccttatcaggtaatagccatagtccagtttatatgggatttatgacgagaacatattacaaagagagtagtcgaaatagataataccgacgagaccgtagtcgaaggtttcgacgaaatctcccggcgacttggctccgcgtactccgacttcgtaaactatggtgggtgtgttggtgattgaattggatgatccttcagccctccctcaggggttccttttatatcgtggatcagctcaacttgacctccaagaaaggtttgagtatgttggatctggtacggaataacagaaactatatcccttccgagtaggattttgaaaataacttgactcgtagtcaaacaatgcaagcaaaattttaaaatcgacggagagagtattataaaaaattgaacatgtttttgccggtattttgatacgtcatccgtgtatgagtcagtttttaagttcgtttgtttttgaaaaatacaaatctgtatttgagtcgatttttaagatcgttaactttcggtaatacagaagcaatcatataaaaaatctgtttaaaaaaactcgcatgctaacttgagatgatcggactccaaactgcagctcatgattttctaaaaatatatatatctaagcgaacacccacagtgaatttcatcttaactaaactatataacaataataagattaaaatagacttcatccgttgtaacgtacgggcattttttctattaaaaataaaaggctgaggttttacatataaaggagactcggctactgatcaattcgatcaataagacgttagcatattatttccatagtaaaaataattttctcgctccatatcgaaataaagcaacctacagtatcggatgcgacatatcatagaacatatacgaattcgttctactaggatatgttatatccggtataggttcttatatcgtggggacgggccaggttagtccgtcataaaaatataaattatattagtttttgcatgatctactttgaaaatcttttttttcataatataacattaacaactacactctccgtttaaaaatatactaacctaaaaccggattaaacctaacctaatactaacgaatctagatatgtgatgtatctatacaatccatgtctagaatcgtggtactagatcagatctaatcttaatcctagatttctatattttgagtcgtgtgttgctgaggagtatattcatagtactagcatcacttgaaggtattttcgaatatgaatttatgccattacttgtgtctcattaaacaaatgctcttacattagcagctcaataattagtcaaaattacaaatattaattaatcgaaatacaaacctatgatagaatgtgatatattctagtaatacaaatttggacagatggccgtctaaattcgtataactaaaatatatcatatactattttaagtttttttagacgaaggaagtacatctcttctatatatactattataaaaattgagaatgtttttgtcggtattttcgtacgtcatccgtatttaagtcggttcgcttttgggaatatttattcgtgtttgagttggattttaagcttgtttacttttgaaaatacaaaaggagtctgacggagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacagagagctggagagcaagaaagttcaaactctagagaccctctcactcctcttttctccagtcccccctttttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcgatttgcaatggctgctgtccgaatgaccctccgatgggatgggtcataccaacctccactccgccggaagcaggtgcaacatggaagcacggttgtttgctgatgacgtgaccggcgtcagtccagtcacaaactggtcattcttgtctaccacgtgtcagtttagcatgccacacgtcagcccttcttcataaaatgacttccttgtaatggttgcgatgaagcctggtatgaatctagtcgggaccgacgtgctaactccaggagttcccacgccggctccgtctagggacgagtgcctagaggctctcatcattctgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaatcctcagggggtcggggcgccccagccctcggggacgaaacgggagcggcccgacccctcggggagatagagggaggggttccctttttacctttttaaaattgtattccttacttggactatccttttattttctaattttgttttattttatttttatttttattttgaattttgattattgggttcttatatggaaacttttttcaatattgcttatttttaatttcgaatttcagctattttaaaattgtatttttacttgggtctctttttttttttctaattttggattttattttatttttattttgaattttgattaatcttgtattgggttcttatatggaaacttctttcaatattgcttatttttaattccgaatttcagctatttttagattgtatttttacttggactctccttttatttttttttctttttctccgattaatgtgggaatttttagtctttacataaaacgttgtttcttttttcaaagctgtaatttattattaattaaattctattttttaaaaattaatatcatttggttatttattttaaatttaattttttttttattttgaatttttttgctttccatgaaaaaatttaaagtttaaagtttttttttttatgaaaccttctttaatttttaacacttcttttatttagtttttaccggtaaagatgttatttattaccacttccttataattttttggatcttttttcttttttttttattccaattttcaaaataatttgcctttttaaactttattttcttggttttccaattttttttgcacctccctttggtttgcattctttattaactttatttttcgattgcatcctttattggccctttctgggtttatataagatattt

SEQ ID NO: 4125 - DNA, 33388 bp, Oryza sativa
  unsure (1)..(33388): unsure at all n locations
natttcggggttataatagtccgggtcgaccagtattgttctacggcggtgctgctcaatacgcaagcatccgaggcattgggtcatgtagatgaagtgatgtggacacgcatgctataaaaaccgtatttgggtgtggtttgtcacccctgaccatagtcatggggttaacacacaaatattgttggttcagcataggtggaattcgaaagcagggatatgggtgtttgtacgaaacccagttaggacgacatttataatggggggtttaatcgccctgcacatggaatgttttctacttgtagcttggaatggtcaaccccccacaggtggtagtgccaaccgcggctagcttcagtgggtctaggttagatggttttcattttttttggggaggaaacgggagcgttttttttccccgacccctcggggagatagagggaggggcagcctcatcactctcgggcccgaccccccccgagggggtcaggccacgtgggtgaccgcggctgccccaaacctctagtcaagatatccccggtcccatgtcaccgacagagtcgtataagaatctatttaaaaaaagctcgcatgctaacttgagatgaagtacagactcctaattgaaactcatgattttataaaaaaaatatccaagcgaatttccacggtgaattttaccctacctaaaccctataacaataataaaattaatatagcatttacatgttacaatgtacgggcatttttctagtgatttaataaatttgtgctcacatggtgagaaacccgaccttttaaattcttaccaattctctctcaaaaagtccggtttcccaaacagtagtaaaccatctctgctgttgttttcttgatttaatttactccggtacccaagatagcacttaccccattttaaaatatagtaaattagtatcgatacggacataggagtattatactatcacgaatatggacggacaaggttaaggttatgtcaaattagtacaggttgctactcccttcaattagttccagaatttcactcatctcacacatactaaaacaaaaatagaaaaaagacaaatacatctagtgcatcaaatcctaaaaaaaatattctttattttacctatttcgaatgcaattattttctcattcacaaacttgatacaactattacttaaaaataaacttattataggataaatgagaagccagaaaacttgtcagaattgaatatttttttacatataaaggtatattttacttctttgtccgtcttaaaatataataacctttaaacggtaaaatacgttctaatattataaattttgatagatgttatattttgggatgaaaagagtatgagtgggcaagtgctccttccatcttattttaaacgcagtcacgagtttgtgtctaactttaatcgtccattttattttaaaaaataaaagttaaaaaagtaaaataatgtataaattaatataatattttatcatttaataagaaaaatatattaatcataattttttttaaataagacgataataaaaaataaacacagaaacacgttacctcttttaaaatgggagggagggagtatatataagtcaaggagtaattgctgttggtgacgttaacctacgcggtagtacgtgcgtgtgagcagctggagcattcaagtagttttggcttgtggcagcgcctctcgagcccatgcaacgcggagacagcaagctgccgcgcgacacggcacgccgagcgagaactcgagtctattcaatgcgctagctgcagcgtccgtcggttgcattggctacgagtaaaaatttacctctttccttgacttcgccaatagagagaaaggaaaaaaaaaaggcgagagatggtccgggagcggcgagctatcggcgcgcgctgtagcggcacagggcgagcagtagtcgtcgtatgcgcggtggtagtgatggccctgaatctgagcatgcttgttggtcgcgtcacgcacgctcgctcgctgcctacatacatgggctctcatcatgccgcacgcccccgatcaattggctacaggctcctactatacacagcgtcctcgtgacggctcgtcacacacgtacgctacgccaagcagcgcatgcacgtgccatgtttgacatgggcgcccgcatgcattttggtaccatatctagcggacggcgttgtgtccgcgctgctacagtcgtcggtgcaggagctgctttgcaatatgtgtagttttctagcgaatccgatcaatacatgcatggatgcgtacagatttagtggttcatctttttttttcttttcctctgctcgactcgaccatggctttactacatgtgataggctttttagttcgtgcatgtagcagcggtagcacactagcatgacatgtctggataaccaccggtcgggagtggcccaccgggttaggccgccggccggcatggggcgtacatgcatgcatggcttttctcgggaattataatcgtgtgatggtccgctgatcggatggatcgggccgtgcgcgcgtgagcctattatggttggattgggacgatgcgtactactactacgtacactacgtacgggtagggttcggcgatgatggtattgatgtatactggacatttcatgatacacgtaccaccaaatgctaaggatctttggacgagatggctagtgtttggtgcaaagatctagtgactgatccggccggtatttaggaccgtggatacttcaaagccgccaagtaacaggaggggcgcctatccgtgacaggagctgtctccacatttcgattgattattgcatggcgaaggcgtgatcagcagggattgacaggatgcgagtagcgcgtgctgtgccaggaaaggttacacaagttccccgcacaaaaaaaaaaaaaagaaagaaaaaaagagagaagggttacacaagttgtccgcgccgggtcctacacacatatggaaaaatgaaacagtatgtattgtttcacaaatgttcctggcttaagttagatatagtatataggaacaaattaatgtcgtgccccttaaaatacatgataaaaaaacacagagaatatgaaataaaccacataaatgaaagtaacatgtttttttaatccagtaatagttaaaagcacaggtaataggaatatactcgctccgtcccattttaagtgcaatcataaattttcacgtccaactttgatcatccgttttatttgaattttttttataattagtatttttattattatgagatgataatacatgaatagtactttatatgtaactcatgtttttaatttgttcagaaatttttcaaataaaacgaacaataaaaattgtgcacggaaaatcatggttgtacttcaaatgagacagagggggtatgttcttcgattgcaccataggacggaattgaccataggaatacaatcctataaaaattcacatccttttcataggaaaaatccgtgtccttttcaaatgaatcaaaggagcatatgagaaaaaaatattaagggaattgaattatcaaaaattatttgtcaatcctccattttaaagggaccctcattgtagagatgtgcatgtgttcaatatacacagggagcacatatatatagcctttcatagtctacttgcagatttatcgctcgtagccaaaatttaaattttggaaaataaattttagagttgatttcttttacccgtactctatattttaatttttcttttaaactgtaagtaaacatatataaataaattgtttctcctactttgtttgtttttctatggcatatcaactacttcgtacagctcaagcgacaagaggcataaagcaaattaaccataagtgtttcccacaatatacccctaatagacgacacgcatgataaaatttatgaaaaaatttatgatgatctctacggtaatataatcaatatatactaccaccaacaatcttaaactatctttcattgatagtataagtcataaatcaatgggttatattatttaactaataaatatcagtagatatcaccgtaaaaatacttttcagattttttttacgaattacacgtgtgtaaatacatgcgtgaattttaatgggtacaattacacaataaaaatatacaaattactgaatctgtctcagaaaaaaaaaacaagcacatcagagctactccctttatctcaaaataaactaacatatgaatggatttgacacaatctagtataacaatttagacaacaatcgtcttctaagttggtttattctgattcggatggagtacaacctttttgtcatgggaaaggccatgtttacccctccagctgaagttaattaaatatcatcccaaacattaaagagtaaaatacagttactcctatttgctagccattacaaattcatatgaatataatatcctgatatttattaaatgctggcccgttgacatgacagcgctttcacgaacagcggtttctcattggcgctgagaaacctttggctgatctaacgtgaactttcggtgaaaactattggcataagtaaattcacgctgtgtttagatgcaaagtttggatccaaacttcagtccttttccatcacatcaacctgtcatacacacacaactttttagtcacatcatctcaaatttcaaccaaaatctaaactttacgctgaactctcgtaccaaagttaatctacagggtgatcccaacagttttgggctaggtgggcctgagtccctgttccgttggctaaaccctttataaaatgttgagttaatagaggaaaaaagcactagtttgatagaagaaaaacgatgaataattgaaaggtaattacttttacttcttttttaaataggtagttgtataaaaatataataatgtttgtttttttcttatatttagtcttgtcatgttacgcactatattattctacgttcaccgtcactgttaatatatccccatgtagaaattaaggatgaaaaatatatactttttactatctttttaaaggaattataaccctggcctctaaactacaaatgcacatcattatttgaacttggagtaaacctctagaggaaaatttgcaaaaaataaatagaccaagactcgtattggttgagctatatatcctagaaataggaatggagcaacaataaataatttgtcagaaaaaccttttgtggtttaaaaaccaatgttgaaacaaatcaggatacccccccccctacaaaatttagtactccctccgtcctataatatatgtattttaataatttgcttacactgtttaagcactcgtcttattaaaaaaatctgtgcaaatataaaaaacaaaaatttgtgcttaaagtactttggataataaagtaagtcaaaaaaataataattctaaattttttttgaataagacaaatggttaaacagtgcaagtaaaatatcaaaatcccttatcaagagacggatggagtaggcaacaagcaaacaacaagacactaaaatatctatataacctaaaagcatagtaattaagtgcacaaccatcaccggttagtttgaaaatatagagaaaaccaagcgattatatatatactttataaaaccagtcgactttataaaaccggtcggttctgatcaatacttcatccccggtagtatgatgccgtgcagtctatccccagttgtaggagcgttaagtaccagcatgtcaacggtaaaaggaacaacgatacaaagagctcaagattttgagaaatagttgtttggtagctatgtttcctaagttctggtttttatttcatctcctagattctataactacaaattttaaatctggttaaaaatctactaaactgatggtagaatctaaggacccctttgaatcacgcgaatggaaaaacaaagcaatagaaaaaatataagattctgataggattgtaaatccaaaacgagaacgcaagaaaaacacatcaatgatcgtttgattggatcgtataaaaacgcaggattcatataagaaagatagactccaaggatattttccaagatgttagttcttattaaatttcctctaaaatctctataggatcgtttatttcatagaaatttcaaataatatgatatgatttaatctattatttcaaagaccttcataggaaatttttaaatagaattgaaatcctccaaagtttccatgtttttcttccaaaagttgttgctgatagaatctctctcgaacaggacatctcgcgaagtgtatactggcccactccacccgtttcggccctagttacatcaacgataggtacgtgctaataagatcagtacggaaaatagttgcggaggcaggtaatcttacatactgccctctattagttgaaaacggagaacatgtactaatggcacccaatcatcaaattcgctattagctgctcttatcctcttttgcctacctacaagtactccacaacaggaacaatctccccgctgttaccagctgtgttgcttttgttactactgctagttttttagagtagctagggagagtgcaggcagaggcagggcaggggtggtgaatcggtagaggtcggcagcgtggtaggccacggagcagctgctcatagtcacatctgcatttccaatccaaaagcaggaagcgtgaacgaccgtgcaaaaatgaatggagtcaggaggcttggcgtcccgtagatgcagaacgcctttgatggatggttgcagcgaaggtgcgtagtttgcactttgcaggtggttgatgggaggccatcagctgatgtgaagtccattagtatgacacggctggggcttcatgtatgccatgcatgtcaagcaacagagggctggggctcatgtatgccatgcatgtcaagcaagcaacagaggccgagccaaacagccaatggtagccaaacagccattttattgacaacaagggtactggagcgatcaataaaattggaacagaaggagcatggcactcaggctgatggagtcatgaatggatcagaaagcaaccaaccgaagaaaatttgtttggtgatagagtggaacggatgggctgtttcagagttcactgtaactccggaccagaatacaagaacggctcccatcaattatttcttcaccagacagaagaacactgcaaatatggttgttagttcccgctactaggagcaaagtcaataatatagcccgctgtcggctcttaaaaaatagccacatcatttatagcatagctcatgcttacaatagaactactataacacaattattttattatctttgtgggacccgccatcttgccttatctcattctctttcttcctcctaccccttctgtttctgtgttcgtcttgcctgtggcctgagcgtgcggtagttggagatgggcacttgggcttgggcagatggccatgcgacggatacggaactacgggagacgccggtggccgtgtagaacgagggcatcatgcgacggacgcgggagacgacgacggctcaacgaccgcggcggcgcggccacggtcgtggctggtgagggccacgaccaaggctgaagcaagtgatggtgacaacgtgatggcagtggccggatgatggtcacagctgcggcgaacgcagcgacgacgactgctgcggccgcgatggacgagagccacggttgaggatgcaagcgatggcaacggcgacggccggggtagacgagggccacagttgcggcggacgcggcgacgacgacggctgcggccgcggtggacgagagccacggcagaggatgcaagcgatggcggcggcacgacggcgacggaggcggccacagggggatgaggacgcctgcggacgcaggtgagggtggcggcgtcggcggacgcaggcggacgacagcggcggcgccgacggacgcaggtgagggcgacggcgccgagagatgcatttgacggtggcggcgccggcagatgtaggcggatgacagcggcgacgccgagagacgcaggcggacgacagtggcggcgtcggcggacgcaggtgaggcggcgacgtcgagagacgcaggtgagggcggcggcgccagcggacgacatcgacggacgcaggcaacagctgtggcaacgagggcggcatatcccgacggatgcggtcccacgaccttgggccgtgcgtagagccgggcgactaattagtcacccgttcgttctctctcttcccccctctctcctccacgtcaccgaaaaatccgacgtggacatcctatcgtcgtttattgtaccgctataagggcatccaaaatgtactacaaaatagtccatagggaataatctattccattcagccatctagtaatattgtgcaactagtccattaaaggaaatagcaaaagatatccatatgcatatggactacctatatgacataaataatattatccatctttacctctctctcttctcctaatgttacattgtatccatatacattgtgattgctatagttaaagtttatttatatgaatcctatctatatagaccatttttgccatatacattggtgatgcactaacaccggcaatgctgatatgttgcggcttgtagctagcctaggcttctagactacccatctaacagcacatctagactgtagtataaatgagtacaatgaatacagacgaaactagtgctgttccattcggacggaactggaaagcaaaattgtgctggaaagaatattttgttactaggaaagaatcagtgttacatagtacaatgctcttcaattcccccaaagtatacaagcggatgccatggtaagttaattcataaatacaaaatggaaatgttttgattcaggcaggttatagtgtacggtagaaatgttccttgtgataaggagtaccagtcatgggcttcggtatgagaagacagattatgtgaaaccagtattagcctatttggttctgcagttctgcaaaaacaaacgcttcgaaagatcttttcctttagaaaagtcttttttaactagaacagcaagaaccttttgtggcggctggagcttcagcaacgttgatcgtagttccttgcatggaacgcccatttgtagacgcggattcctgagctgcaagtgctttcttgcttacaatctggtgaatttcactcaatacagtatggaatgctttctccacattaatcgcttccagagcagacgtctcaaggaaggagagaccttctttctcagagaacgcatggccatcttcctcggggactgatcgtagatggtttaagtcagacttgtttccgaccatcatgacaacaatgttggcgtctgcatggtcccggagctcccgcagccacctctgaacattgtcgaaggtttgcctctttgttatgtcgaatacaagaagtgctccaactgcacccctgtaataagcactcgtgattgcacggtatctctcttgacctgccgtgtcccatatctgagccttgatagtcttcccttctatctgtctcaagacaatagtagacttttactgagatgaactgtagacacgtatggcttcagcataatcataaacagagaaaaatggatagcattccagatctatgattggcaataacaattatggtgactttaacatgatgaaaatgtcttcatgacaatatacaaacaaatcagtactaagaacaatatatttttttctttgattggacatgggaagatctatggttgaagggtatatatcaattgattaatcaacaaatatagttataccacactaacattggtggcaactacaaactgcactgcaatcccaattactgaatgctgattgaagaattgtgtcacaggcttacaagattctttaaaaatttgggttaaagtttaacccatgttattcttttccatttactgatgtatatgtattaaaagctgaaatgctgcaaaaagaaagtgatggcgtgctagaaacaaaaaaaaatcacttaaaatgtttgatcaaacaaaaagtaatagatataaccttctttgtctaattattgatactctcagaagaggatcaggaaggacaaaacagagcataatgacatggttgtgctcaaggaatgtaaggactgagaaaaaaaaaacaaaaaagacatttccagccttataataactgcacataaatggtatggaagtgatgaagtcatctgaatgcaattaattcagagacaatacaatgatcagtgctatgccaaccaaacggagaagatggtcatactagtcaatctatgttgcccacaacagctattatgcattaggattatgaatccggcagggattgacataacctctttgacgaaattgacgttggaaggccagcatattggtgcggtagcatttttcctccaatgtagtataaaagtatgatgaatctactcgtatttttggcatttcttaacataatgtacttttggcatataatctactctcgtatttgcattgctaggaaggaccaagagggaacaaaatgcctgcatgaataggattgctcgaaagaattgacaatctagtgttaacctagaaatgacacgtatatccgttctctaatctctatcatctccaacacaaggaactcgcgaaaacataaaagaaatatgcgcggcattaccaccggtaccatcaccgcgatatcatgcaaacaaacaaagtgccgtattgccattgtcagcccaatcacgcgaccataaaaatcctgtgggtgtccgagtctgcagtcatggatccgggatctcaattcctaacgcacaagaacccgacgcgacatcacgacgcgcgccaatcgcaaaattgtacaagcaagcaaggggatcagggggggggggggggcgggtgggcgtcgcgtacgcgggtacctgcagggtgcgggtggcgaactcgacgccgatggtggacttggactcgaggaagaactcgttgcgggtgaagcgggagaggatgttggacttgccgacgccggaatcgccgatgaggacgatcttgaacaggtagtcgtactcgttgtccacccggtgcgccatgatctccccctcccgcctcccctcacgtcccgaatctggaacgaacgaaaatctcccctccgatcctcgcctcctgaccctctcggttcgtgcgcctgggggaatggaggtttgaaacggtgggggcagagggcaggcagatccgagggggaggagagagagagagggggggggggacgaggctcgcgctcgctctgcgctggcgcggcttgttgttgttggtggtcgcgtctcggccagccaatcgacggctggcgcggcgttttgtccctggctggggcgggcttgccagatctggggaatgtggccatgtggtgtgcgtggtcgccgtggtcggtggccgcgtgtatcacctgcctcgtcggtttggttcgtgggcttgatgagttggttatgtgggcttatctatgggtcaccacctcggcctcgacggcctgctcgtgcggaaagtatggggtcggggcggcttcacggctcggcccaatgcaagcatttcacaccatgcagatatatacagtttcgtttttttcgatagatgaatactttctggaacacaatattttctttcccacatatgcaagcattcacacatactgacatgcaaacactattacactgtcaccactaacgttacatacacgtggccacgtgggtgcaacctagcagtagcaacacgtctaaacgtgagaggttagcctcatgcatgtagcaaatagcataggtaccctcttttttcactaacacgctaaaagaaatacacgtcaatataatagaagaagacggagtttagttacacaatgcaaaacgtctagaagggtgttgcaggggggacaggggaagaaaaaatcgaaaaaggaaaaaagtgacaaggggaaaggttacttaaaaacaaaaaactcctatagcgagggatggtagaggagtagccccactatattcctagaaagcccccaaaagcagtaccactagcagatgatcacagacggccttcctaaaagacagactccaacactactgaaaccaacgagagagagagagagagagagagagagagagagagagagagaaatcgaacaccccagagtttcactccttccacagctgccaagatatcgggagtacaagggagctgaaacccttatgaggtgctctgacaagcaggccctagtagtcggccaccagacctagagtgagcaaccacgggaggggacaaggtcaggctagccaggaggagacagaacatgatgccagacctggtgagcgaaaacacaatcaagtaggatgtgattcaccgtctccatttcttgggcacggaggggacagactgagtggctgtcaataccacgctttagaagaaggttggtcatccagcggcacttttggaacgcaagctacaggaaaagcttacacttagcagggcctttagcctgacaaagtagattggcgcaagcaaaggagtgttggccgaggaaaaatgtctggtaagccaagtaacaccaatcgcttgtccaacgctaagagctggacacaaaacaccgtgtcccagatcacgaggaattgggaaatgatagggaccgtgagaacgccacggatgtcccccacccataagttgttagagagagcagaggtgattgtgcgcgatgcccggagatgtggtggcacggcaaggaggaggccaggcaccaaggaggccaccgagcgaccctcaatccattggtttctctaaaagagagacgtgtcgttccctggcacgaagaagatgaacgacgcagacatatctctcgagggggccttcaggtcagcccaatagaggtggcctgagcgctgaagccagagctagcgaaggtgaagaatgaagccacaagtccacaatacccaaaccaccgatagctctggggcgacaaacactcgtccaagacataatgcatcgtcctccctgaactgcatccatacccgtccactggaaagcgcgacatttcttatctatggcattgacaacccagcctggcgaactaactgccatagacacatggaccggaatagaagatagcatggactgaatcagcacagaacgatcccgacccatctagggagaaagtcggtgagaaatggcatcacatatttaaaaattggagacagagcagagtaggggaaggaactctggaccagggaaatatgtgatgccatttgacgttttatagacgttcgattattcatcatattaaaagaattgtgaaaaatatgtaaaaacacgggttatgcttcagcatgtacctttactgataaaataaatcacaataaaataaatagtagacatatagtttttttaataaggtgatatgtccaatactcaatagcgtttgtattactacctccatttcatattacagttagttttgattttttttctaagtcataattctttacgttgaccatatttatagaaaaatataaaaatattatggacataaaacaaagaaactatcaaaatatattcattgttagatttagtaaaattaatttggtgctataaatattgttgcatttctactttcaaaaagtttgacttaaaaaaagtcacatcgacttataatatgaactcggaggaagtatgtatcaaaatgggcatgaatattgatttagcttcgaaccaacccaatgactattacttcctctgtctcaaaatgttgctatctaagataggatttgacctattctaggacaatgaatctggacataacctctgtctagatttgttgttttaggatatgtcaaattccatccaagatagaacatttttggatggaggaagtactattcaaactgtcaatggattgataattttttatcaatccaaaacagtcattaatccccttaaaacttcacatccttatcccatctacactcctggtcatgtttaaagataacacttatcagcctctccttctaaattatcttttcgtccggataattcagcccatccagatagaccgtcgctctcagacagactcaatctaagcctagctagaaaaactaggcagagccctcagcctgctattgattaccacttaccagcccgatttgggccaacaacgccccgaatcggttcgaacaggtggcacctttccacgacaccttgctgctgcttatccagttatcccaaacccagattagacgggccgaaaaagaggtttctaccccattcatccaacacgccgcacatcgaacttcttatctagctttccgagtacttccaagttccaagtccaaccccttctatcatgctccatgccgcgcgcatgcatcatgcacgctggacgcaaactacgtgtcgaccatggatgcgacgcgacgcgacgcgaggcttgcgtatgtgctcctcctccctctccgcggtgaaagtgaaaccgatcgatccctgcaaataattcaccgcgcgcgcactcctcctcgggcgccgatgggtggatacgtccacgacgcgttggttactttcgcggagtgcaaatctccggcttggctttccccccgtgcgagccccgcggacagggacggggtttcggccccgcgcccttggcggcatcgtcatccgcatcgccttttccgtctcgtcgccaccgagccgtccccgtccacggcaaacaggatagaaagcgggagcgagcgaggcagcagcgcccgcgcgcatcgggcgtgcgtggacctaccagcccgccgtcgcgcgtcccgccggccactggactgcggccgcgatcgagagcgctagccaacgccttccggatcacgcgctgacacttgtagaccctaagacccggacggccggatcgatctccgcgaattattgagcggaccggctatatacgtcctagttaccagtaaaggcatcgatctttcgggtgggtctcgtcgtatcgtcgcgtgcgggaggaggagagaaaaatcgggagagcgaatcgggggccgtgtggatgtgcgcgcgggggctgccggtttcacgtcgattctcggcgtcggcggccccgccgccgtgccctggccttccggtgcgtggctaatttcggcccggccggagcagatcggtcgatatccgcggccgaatcctgaggaggctatcgagataaggatgaaccgcgcgagccaggactgcaggagcacatcaatgttctggctggtgttctcgctcgcgccaaaaaaggcgggcatctttttcgacgaacccaaatccacttcagataatatctccactactcgctcgccgctctgatatggcacgggcatatttagccgtgacatgatggcgtgcatggtgacctgttacggtgtttttctctgggcccctgttacagtgaaccttggcttgatcgcttcatcatcagctcgacccctgtggaccgatggagttgacgacgactttgcatctctcgacgtacgtacaaccagccaatggcggcacgacaggatcggcatggaggatgggcaaaaaaacgcatgtcgcgtcgcgtgagccgccacgccagtgacggccgagaagcaagaacagttcagccaacttccttggaacgggctgactaacacgcacgcagaggttcctttcccatcataacctgaatcagtctcggtcattctggaccagctcgatcgctcggggccaatcaagttcggccgtgtgcattgccgcattcgggcagtttgtgccgtcgcaaactgcaactctgaaaagtacacgcccgatttaagcaagtgatagtgatccactgatcctgggttaaatccagtcgaaaaccgcaactaactctggaaagcgacgccgcccgatctaataccgggatcctttggttaaatccaatactccgtatacgtcgcaaacacacagccgttctgacaactgttgactcgtgcactgcagaaagctgatggaatcgtggagattaagaaacaaagaagctggaggtgcgtgcagggggagtagtggatattccgggtggcaaatggcctggggtaggaggcgaccagcgagaggaaaagaagaggcgacgataaggccatggctcaacatcgtccttgggacagggaatggaatcatcctcgtaggaggtgaggtcaaagtgtgagaggttggaggtatatgctacggccccatcgattcctcccgagtgcaaagtcaaataggatgcagtgcattatgctatccagaatctatctatctatctgctggtcagttcctgcacagagccggggacctccctgcgagtacacttgttgatcctctgtaaaataaaaaacgagaacgaattcaggggatcgaaatgaacaccccctatcagattggttctcgcacaaggtacaggccgctaaaacaaggctttgcacgtggtaaattttcaagtgccaatcactttcggtgaattcgatcattatagcttaaagcctgaaacctgttttttggggacggcgaactaccgtgtgtgttctagtaatcgccctgaatgcgaggttatccgcatatgatatctcctgttgattcgagagaggagaatgaaagattacatctttgactggctcaacagctgaagcacgaaacgaccttgttgtgtttgttgttcccttggattgatttgctaagatcttcacagttggcttatcatttcactaccacttgcacacgtgttgcctttgacaagacagattgttctaaggtcccaacgtggatgctatgggccccaacatgcaccatcttatccaaagcataccatatcaatttcgcatatactcctacagtcctacgttgatcagttagtcgtacaagctagcctgcatcagactgatatataagtcaccaagggttatacttcctccatctaaaattctcacccgtattacgttttctaatttttctatataaattgtatgcattcgtaatctacatgtatgcaagccttaaatgaacagcgtgatcgttcgtttagcgcgcggcgctggattaaattgatcttgtgtcccgagcagccatcgtcccactcttttttttttatttagaaacaccaaggggtttttcggctagcttcacaaggtggtgggctatacgacctggattcgaagcctcatcatttttaattatttaatattaggttcttccttaatattcgtgtctttttttagcagagacgatgaactcatgcattacgcagccaaccaaaccaacgtgcatatgaatcgatgcggatgtttaattgaatgaacgagtatttcgattcttgttggtttcagtgataaaatatgttgtagaaaacttttggacgaaggaagtaatactaacgtaacatagcacaaagggtatataaccaacacaataggtatttaatactctcatcgattcagatataaataataagagacacaagtctaattgtcaaatccatttcatataacggttttcaagatatattgatactcctataaatttatacaaatgaattgatacacttggatagtcagtcttagcatgcaccttactattattgtctctaagctccatgtgttgttgatggctaccttttgtctgggttatggataccacatacctaatagtcatcgactaagttcagcggggtccaccatatactaagtcttatacggaatcatattttttatatagaaagagttccgaataaggaaggacaagaagtgttttatatggaaactataaagactgctcggattatatttatattggtcgttctacttggacaatgagacttctatgggtataaatacaagccccctaggaggagaggagacacaacacacaagtcaagacaagctaaacatcgatattggagatagcctagatggactcaatccggtgcctgcggaggctgacaagagagatctagtgctatctctgatctcgccaagtacgtattcgacgaggaggactactctgtcgtcgactacatgttgatgatctattctgccaagtcgatgacagctagataggttatcccaattattatacttgtgtgatccatataaataaagaataacaccggccttcggccaacaggagtagggtcgttaccttcctgtgaaggggcctaaacctgtataaaaatccttctctctatcttttttaccttgatctcgcatacaccctggtaccaacgatctccataccatgtaaataccatagtcatgacctcaaacgtcgacacctatcaagggttagggatttcgtaccggtgaacaattacggacaatataagtggcaacaataaccaccatacgcacaattcttaattggcactagcattaattagggatgtagcgtccaatttctatccctaagtagaataaagtcaccatgtggtatctaacatgtaggatcgaacacaagtaaccaagcctaccaggggggtgaatggtagggaaaactaaaaacccaaaaaattttagcggaaataaaagttaccctcaaattgatggaaatctcgacgtagtcctgtcgccgccggtcggaccgctcgcacgccgccggttagatcgcctccctgtcgcctgaactcgaagaaacacaaattgaagaactctcaaagtagatgacaactttattgcttctctctatatttacaaagtgcaacaacaacactccttacaaaaatctcgactaaactcgaaaccctaactaaactatcaacttaattgctctcaaagcgatatcgggaggcctcaccctccctctctatttataccacaaaaaccccctactcaaagtaggtgtagaactcctattcataataggactcaatcccataatttcctttttctccaaaactacagccgcacagaagtcggactcctcctgccgtcgctgctgctgcttgctgcctgagccgactcggcttgcctctgcatggatcaagcctgccatcactgaagctgcttgaccacgcaacaaagccaaagtcagtcaccaccatgcatacatacatgcatcacacatgcatgcacgtactgcatgtataccacacatatatgcacgctgcacaccagcacgcatacatatatgcacgctacagtacaccacagtactgtagcaccatacataagcctcttccaatttcttccaattccctttgcgaacaccgatgcttgcacgcacacctcgtgaagcccgttgcgaagatctctcccacacggtatccatccaccgtatgccatctcgtatccaacttcgtcacccggtatccttgacagtctggacctcaactccttcctgagtctagtcctgatctccaccgttgaccgaagttgacctccaagaattctaactctagtcaccttctcacatggtatcccgaccgcactagacctctgtttttctctgaacatagtcccggtcctcgccattgaccaaggctgacctcaagtcacctacacacaatcagacaaaacaaccgtttctgggcacagatatcacaacctgacccacattagtcacacgcactcacatcaacatccacacatcttttcaaaccaattcattgattaaattatttgcatagccaattgttcatcacaaatattaatcatgacaatgatttcacataacatacctcatccgttcctcaatacaatgactcatatgtatcgtcatccatcgcttcccggtcccacactctatcaacctccggtctttcttttaaaaccctcacacaagtacaccgaagctagtatgtcgtccccatgaagctagtttggttgcgcataagttttctatgccaccgcctatcgttgccattacatccaaaaagaagtcgtcatcctactattctaacaatgtgccaaccgcttctacccatggtcagcaatctcttagcaacccgacaacatggactattctacttgcataactatgtttagtcatgtgggacaagttaacgagtgtttgtgcaactccttgttggagacacaccattgttttactatgtcttatacaacaacccgtataacttttttagatgttctgattaaaaatcctagttttttacattattagaaatgaattaaatgcagatacacaaaatcaaataaattccatgctttcaataaatgcatttgttctatatatatatacaccatatatacatttatggaagcagatttattgaataagatattcagctggaagttattaaataaagatatctttaggctgcacattttttcatatatgccctttaagcaatatgaaattaccatttatagtcttcatcatgtgcctttaaatactgccaagttggagacacttatcagtcaagtgttcttgagaatcctcatctccaccctcaccatagaaacaggactagagtcctttcacgtgtcctagatttgggcacctttcttttgatcaccgaaatggaacgcaagaatccgctccctcagcaagagtctgagcctcacgtcgaaggcaacaagtcccctgctcccaccagcatcgtcgacgacgccactaacactaccgaggacgactccgcgttgagggacctcctctacccgcaatctctcgaggtaccattcaatatcttttgtaagcatgccgttattcttttaattacgttatttgtgttcgatgcgttcttatttatttattaacttaaaaatattcacctataaatttatttttatcgattacatagaaaaccttatgtctaacatgagttttcacttgattccatggcttcaaattttatattacttttatataaatgaataaaaattataactatgcaccaagacaagaatatgtctagatgcaattgtattctagaatgtactggatgtacaaggggcaagtgggtccgtgtttcagtagtaacccacttgtccccgtttgaccgcttcgtctcgtactagtactaccgtctacagcgtcccgctgatgctccatcaaaccggtggacgtagacgatcggaggatctcgccgtgcatcgcgtgctttttcggccatgcacctctcgtcgtcttcctgatttcgccgccacttgtagcatctgcccgtggggtccatcggtcgatcgatccccgtagccagcacatgttgtcgtctagctcaagatttgttggctcgccttcccttcttttcggttcactcttgctagcgatcgagacgacttgagaacaaccaacggagatagctagccgtctcgtcaaagctgtgtcatcagccgaccagcgaaggcaaactcgcagaagccatcgtgtcataggtgtggtgtgtggagaagcggtggaccgaccgacgacggcggcaacccgcacggcgaggcgaggcgaggccgacggcggcggcgcgcgtccacgaaaagcgggggggtatctacctgtttttcgtataagcccctcaagatctaggaaatcgcggggcgtggtcctcggcccggggcctttaaatgcgggggcacccatgtaggccggagcagagcgccacgaggcgagttgttgggtgttccctagactagccgtctcttcctcctctccctctcctcctcctcccgccgccgcctgcaaccgcttcacgtggcctgatcctcctccggagctctccctttcgaccccaacaaatggagcccaagaggtcccctgcgctgccgcagcccaacgtggagaccaagaagtcccctccccgcgctgccgccggaggaggcggcggcggcacagctgccgtcggtggcgagtcgccgttgagcagcctgttccaccagccgtcgcatggggtactgattcctgacgccttttgcatgtttgatgttatgcctgtgttcaggcccgacgtgaatctttcctccgaacaagacgaaattcgagggtgttctttcgttgtttgtttgttttttttgttttatttttttttgttacggtgacgcggatgacacgggatgagtccccctccgtctgcgaggcgttgatacatgctgaatttgcctttcattccatcgctgttgcacacgcataaatttagtatgcttttaatgtagatatgcccccccccctcctctttctatttgcgaaaattagtaattttcaatgtacaggcgcctgtctttccaagtggatacgcgatagtttgtagaatacttttggaaatcaaccttagagattgtttatatagtttgatggtgatggtatttatccaatcccaaagtattgttttgccggcgctttgtttacacttagtgaattcctttacatttttccattttcaggcaaaaggcaaagaagacatatactccattttctacaaagggcagaacgggactgcacaagctgggactgcaggtagttgtggtcttgtggattgacccaatctcttccttgctcttatgtaggaaggacattcttattccttggtgccattaaagacactgttgcgaaaatggaacataataataagcacaactatatataaacgaattcaaataaacccaaagaataccagttccatataaagcttgaaaattagtagcctccttttcatctgtatttactatttgcctcctttcttctgtaattaccatttgcatctgttggatatctctagagttaaccaacgagaaattactttccatctgttactcttgtctgcaccatcatgttttttttttcttttgtggagtgtcgttgactgttattcatctttgtgatcatcttactcggttcagactttagagcactgagatgtttcacgatagcaaactaactgcatataaacattgatttgtatgccagatggtaaatcccagtggactcctcctaaaagtcgcaccgtgtacaccaaggataacaaacagtcaaatcagtatgattcggttgatacgtcctgttttggttcttctgtgaactatggtggtcgagactattatggaatctctggacacaagcaatccacagaatccaatgatgtaagaaattgccaaacccaaaactgcaaattatgtttgcaattactttttttaaaaaaagtatcatgaactggtctatacaactataccacaacaaagctttgaatatacttttgctttattgctttcagtataaggcggacaaaaaggacccttccacagattctcatggtgactggtggcaaggtatatttacttatttagatatgcatttatctctgaattcaagctccatattgttgaaatgttgattatttatttctatcaggttcgttttactactaagcgaacttggtggcctctcccttggtggaaaaggtaaaaggcacatcttaactgtttttatggtttgctgctattgtctgtttgtgcacatgattatatgctattcaacttacatttgcggcgcaatggaatatcttcttttccatctgacagttcatagatattggtgttagctcactcgacctattttatcaattatttgatactcatgttcttttttatacggaagagaacatattctcttttgttttgttttccaaaattcagaacagttatactagaattcaaactactaagcctttggaaattattggtgatgatgtgcccaaccaacgtttcaatacaaaaaagagccaaaaaaaactatttatatgaggaactgttactttcagctgcacatcccaaatgcttctaagctctgcatattccctccccctcaaacacaaacacatgcaaagtttatctattcatgtgtcaatatcaaagttccgtgcctccatttaactttttttttcctgcacgataagctgtatggttgtaaaatttgacgaggttcagtgggcgggaaaagggtttaactgtcctggagtgaaaattttagttagctcctggctttatatgtctccatcactgtattagttacaccactatccctataatttattgacctagtgtatgctacaaattcacttcgaggaagcagaacaaaattgcaatgaatcttgtgctgatgttccattaagctgtattacttgcataccgtgctgtgtcaattttgttctggtgaaacatgaatcctccataagaggattaggcccaggtcccatctggtaatgtagtttcataaaattcaggttattcataatataaggtagagattgattttctaaaggctgtttttaagaaaaacaacttaaccctaagttcaactacaaaaccaaagaggtttaacgatgaccgtctgtacgagaaacaatccgttaatcctaactccagctacattattttcactgtatatttgtgttattttatcgaatctaaccattatattgggctttttgtgccagggaatggaatgggaggggttggagctggttttgcttcactgttgctatgctggccgtatcagttacctaaatcatactagtgtgacatcgtccatcagtggtggcagtatttggatcatcacacctgggcagatgtagtgtgtctttaccttttcatttcgtagcttgtgctttagatgtgaaatgaatcgaacttacaagcacagtaagttttaggtcgcaggttgcataaatggtccctatccattctgccaaatctggtcagtaaccagattggatcagtttggtctggctctcttagatcgaagtatatgttccttgtactctcggatcttcgctccggagccaagaaggctggagaagtggagatcacttgcattgtaaacatgtactcgtttaatttcaaagaacttagcaaactgttcttataaatagtagtacttttattccaacagaatcatcaactgcattattcagaaagatccaggagaagtcacatccttgaatttcacagaacttatcaaactgttctcttatagatagcaccactattcgatagtcataaaggtactttatttcaacagagtcattacaactgcgttatttagaaagatttatgaaaagtttcacgtgacaaaggtaacatcagtttatatatatatatatcggatagtcaaagtgttcgagtgcccttccagttccatccctttgctcctcatggcagggtgtatgctgcacagttgaaaaagaaaaacagatgacttgatgcgattcatattttcgaaacagactgaaggaaaaaaaaaaagcagcaggagcagaaacttacggccacatttgtaaccgatggggcggttggcgatggcgcagcgcttggggatggtcatggccacggcgggcttgacgccggcgctccgcgcggtgttcgacagcatgacggcgcacaggcacttggggttccgcccgatgctgcgcacctgcgcgcagcagttgggcggcaccgcggcgcgcgggttctgcgtggccgccgcgcacggcgccagcttaagcgccacctggtccacggggacgcggccgcactcccccgcgccgcgcacggtctccaccccggcggccaccaccaccgcaaccaccaggagaaaccacacgcacctcaccttgctctccatcccgtgcccgccgctttccttttcttcttcgtcttctcggcgtcgtctgcaactctgagccgtgctgcgatcgatgatcctccaggcgtctcacggggcgagtatttatgcagcgcgccggagcacggagcgtggctcgaagccatcattggggggccgcttgagaattcccgcgggtcgcacggtgtgaaagcctcggaagtggaggtcgcactggcgagctctttctgttgctcgcactgagctctgttctgtccaatttggaagtgtcacctactgcactccactatgctgaggggcatgcttagcgtccataaaattctctccgaagagcctgaagatctgccacgtaaatggcccgtgacggaaagatttcgctcgccgatcggttcacaatcatcaccggtgtgtcggcggcctgcttttagatcagtgacacggccggagttcttgaaaacgcgagaaggaatccacactgcctttcccggaccgtcacagacctctccagtacaaagctgcagtaagaacttgcagccgtaaaatctgctggtgccagtctgccagaggcaagaaccgcagtgagttaagttcctcggagttcattggcttgattcctttgatgcactatacggacagtggagctttaattaaccgtgtaatcatgattttatacacttgttatacttgatcacgagcaaataggagcacacaccacacagagcttaacaccaggaatttcaggcgatacagtaagaacatgaatgcactcaaatggcacaagtatacacaaagactagtagtccttaacaaattttatgagtaaaacctagattaccctacattacagctctgtggtcgtcgagacatcgatcatcttaccaccgctgattatcacccccattacttcaggattaactagatcaattgccaaggctttctttgcgccaaaccccctgttgctgtaagaccgtctccctgcacccagtgggctcctctctttctttgatgggcttgcaagctgcgccggcgagaagctgggcgtcgcatatgcggtcacaaacggtgtgcctgaggcaggcacttggtacggtggaacagcagccttgttgcaagcaatcctgcaatctgcatcaccctgtggaaaatgctctgcatgcctgttcagttcatcgatgttcagtaggtcgtcgatgcgagcgacaatgttggacgccagactctccagcacccttgaataactctccagtattgatttacccacatcctagaaatggttcaagacataataatgacaggtgcatcagtaactagcatggcaatgtggataaaacaaacataggaagattcagagagatactgcacaaaccctgttatactgaattttgctcatgtccaagcttgtctgcgtcagtccaggaaacctttgcttcaaacatatcagtaggccctctgctcgttcggcaagcagctccctcttctccgtgtctattatcatgtctttcaccatgccccaggatgatctgccactggtggcacggcctaagacacttgctggttttgcagcaatcctccggcgccacacatacactgatgcctcgacacggttggcgatttccagtgcttggtactccgttgacaggtccaggcagtcgagaaggcactcaggagagaaatgatcagacgttatgtagcggtatatgatgtcacccaaagttgcccttccattctacatccaagatgaaggtaacaagctgagatcaactaaattacacatgaaatggcagatgaggttaggtcagggtagagaggcatggtacctttggtagggattctagatacgattcagggacctccatttcagctagagcattgctgttgatggccaaggcagccttcaagatttgattagcacagtcacgtttgtgctgcagttgcttcctcgctttgtcacgcaggcctccgggaggaacacgaggcaccggcaaccaccatttctcatcacggcggtggaaagctgctctgaaggaagctgagccatcacaatccggtgcgcatatcccttgttcaacgtaccagaactcagggtctctgaagctgtccaggatttcctgagaaatattgctctgagaaattactaaatgtccgtgttaaggttggattgtattgaattcaccgacgtgaaaaactcacaatgagcatatggtctagcttccgaagtgctggcagattgatgtataaatcagatcgtggtctgcttgtcatgacctgaaatgttgcaacaggaaaaaaattgtagcagtacattttttagtgaggaaaggcaaacttaatagaaaaactgtacagcatttgtcagttcgaaaattacacgaaatcaagaacacggaacacgtatttcactcatgtatatgcagcactaattacacgcactactgctcattgccaatggattcagtactaataggtggttagtaatcaatattctgcaatatttggcagccgcataacatgtactagagatttggtttggtttcactatttcagtacccacgaccaagggctgcttatcatcttcctacgttgtcctccgtttcatattataagtcgccttgatttttttaaaagtcaaaaattgtttaaaaaatattaacatttatagcatcaaattagttttattaaatttaacattaaatatattttaatagttttttattttatgttgaaaatattgatatgtttttctataaacttggttaaagataaagaagttcgacgtttattttaaaaaaatcaaagcgacttgtaatataaaacggaggtggtattcaaattttcaaattgcgttgtttaattagatgtatgtaaaacatgttatgcgtgcatgggtttttctattgatcccatttaaccaaggatgatactccctccgtttcaaaatgtttgacaccgttgactttttagtacgtgtttaaccattcgtcttattcaaaaaatttaagtaattatttattcttttcatatcatttgattcattgctaaatatactttcatgtacacatatagttttacatatttcacaaaattttttgaataagacgaacggtcaaacatatgctaaaaagtcaacggtgtcaaatattttgaaacggagggagtatattgatatgggcatctgttgtcatgttagcatgtccttccatgacattacattcgtttggttacagtttaggactaagttcagatacggaaaacatgtttagttaacaggtttctcctttctgtggctacagttctcgcactaaatataacaaaagctgcgtatgtacacggggtacgtgcactgtttcagtatctacggcctacggctgtttatcgtcctgctctgctgtatattcaaattttctggttgcgtcgtttaattagctctgtatgtaaaacatagcatgcgtgcacggcctttttattgggtacagatgcgaaaatatacaacagttacagtgatacagtaacatttttgtctttcttctccatgaagctgaattcagataggtaaaaacagtttgctaacaacggttcgatcccattttctagtggtccttgtgcaactaaagtcaccattatgaacctttcccgtgcagtgccatggtatcaagttctatggaaagccagcagttgcacttgtacttatatagagcaaccgctttaatagcctccaatttcagaattgaaccaacaaatcctatcgccagacagcgcagaggtgttgaataatcaaattgaaataatgggagttaaccggacaagcaagacacttgatgaaccgttttgaatttgcagctcctgaattgagccagcctacacgggttgatctgtctgtgaccgtacgctttgagtagaaaaaatggcgcggtagccgctcagggcctggagtttactaaaagaaaattttttcggtgtttggatgtttgacaggacgttggaaggggttttcggacatgaatgaaaaaactaatttcataactcgtctggaaaccgcgagacgatttttttttgagcctaattaatccgctattagcatatgtgggttactgtatcatttatggctaatcatagactaattaagctcaaaagatttgtcttaccatttctttctaattgtgcaattagtttttttaaaattttatatttaatgctccatgcattgatatttttggaattttttttaaaaaaaactaaaccaggcctaagtgataattgcagccagatcgagctgctatgctagtgcgtacctcgagcctggttccgtcggggaacgattgccaggtggggaccagttcgacgatgtggtcgctgacgcagagcagccagcccatctcgcgccgccacatggccttcttctccggcgggagtggctccagcctccacagctgcccgaagatggtggctgcaagagacgcagtagaggtgcgttagtgctagtacactgtacacctaagtagagctccacattgatcaaacggaatcatgaggtggggagaattctcaccgcagaggttggtaatggcgttggcaatggcgagcgccgtgcacacgcccttgccgctcccggacatgtcctccccgagcagcagcttcgcgaacctctccttcatcatctccatctctgctcatcaccatgcacaagtatcatcagtacgctgcacaacctgaccaaggagaagaagagcgcgcgcattgctcggtagtgccggtacctgagctgggagctctgcgcttctgcgcgtgcggcttgctgctgtccaccacctccgcgccggggacgcggccgcacgccgccgtcttcctgggcggcgccgccagcgtcacgggccactcgtcggccgaggccgcgtcggagctggagctgctcccgtcggcggagtccgtgaacgccgcctcgctccgcgcctccctctcctcctccccgctccccatccgatcggtcccaaccacgcgcgcgtgacggggtctatctaactagttacacctctccgtacgtgcgcgcttgctttcgcgggcgcgggtgtagtacgcgcttcgctgctccgttcctcggccggcgcggccgagttcagctccgcgtgcgcgacgagacgcgcgcgggcggggcgtggcgtggtgatttgcgcggcgttttggcgtttcggtctcggtcgtggcgcggtgcggtgggcgaacggaaggctaggcgcttaaaaaagttgggcttggctggtcgatggggaagagtgaccgttgggttttgagttgtctgggaggccttggcgagtttactttttagaggcggagagagagaaggagagaggttttccctttgtttttcttttgatcggggagggtgggatggaaatggaatcatggaatggaacgggcggggcggcagcggcgcgcagtaacggttagcgagtgaggtggaaggcgtgcagataataaagaggctggatcggcgtgatggaaacgctccctccttgctgctcctgcggtgctgccgttctcgttctctcgccttccccttgttggcgactttccgttgcacgctttgtgtcgctataagcacagaaagaaagtaaggaaaaggtaatggatcaggaaaaggagtattgatcaatagcacgaccgatccgtccctaacaatcataattaaggtccagtttgcatagcttagattgtgagaagtgaaaatctagagaagctgacaagccattttctagattctacatctacagttttttaaaatcttggtgaaaatctggactgcttaggagagcttctgttatcttttcaaaatgtgtttatagctggcttagagcagatacaatagcaaactataagccagcttaaacacatatcgaggagataaaagaagagagagaaaagcaacgggctacagatttgtagctaggtgtatcatggactccaagacacaatgtatatatgacaggtgagaccatgtattaatagtctagtatatatttataggtaattattgtactcaatccgtcccaaaatataagaatctaagactggatgtactagtaaatgtctcatccggttataggttcttatattttgggacagatggagtatgaattagttattagggcaacaacaatatatatggctaaagtagtacatatagatgggacccacatatatggattttaactattgtaaccttcacaatgtatatagatagtaaatagcattaagaggagaaaaaaagtagagacacataatatattttatcctctatgggcagcccatatgtttgtgggtagcttttgttatttctttgttatgaactagttccataatgttactaggtggttgaatggaatactatattgcttatgtaccagtttaggactacattgtggatgcccttaagttgactataaataatttagagttagtagttggttatattgttaaacttgctcttatttgctcttactgtaggacactgtcaagttaaggtcatggagagcaagccgttaaatatggaaagaaaacacggtggcagccagtactgtttgaatgtcagccttgtttactccatgtgagagaaccccaacgttagactgtctccaacagccttcacccaaattcattcgtttgggtcacgcgggatgtccgggtcacgcacccaattctttcgttctccaacaatggacccaaacgagcgttgagcgccgcccgcttccctccccgccgagcaccgcgcctccctccctccccgccgcggacctgcctcgctacgccggtcgctccccgttgcgggcccgactcaccgtcatcgtccgagggctcgcctcgccgcgccggcgtctaaacccgactcgtctcgtcgtccgcttccgcgtccccgactcacgcgggagctcagccacaagtccggcagcgagaccgtgcagtggcgggctgatgcagcacccgcacgagaaggatgaccgcgagcacgcggtggcggcgagcggcgagcctggatgaggcggttgcggggcgggcggcaccgatttgggtcgaggagagagacggacgcatttttgcgttctcactcgactccgacgcaaattgcgtctccggtttgggtactctgttggcctccgattttttcatcggatgacccatatgtgggtttaggtaccgtgatgggcaaactgttggagacattcttagggacccaatgtcaaagggtgcatcaattttctactcctatcttcactcactgggcatccccacaaacacataaagaacgttccaagtccgacacaacacggtcccatacggagtactgtattctgctccgataagccaaaaaagcctgtgttgatactgtgcagcagacgctctgagggccaaactccgaaggaagctacgcttgtcgcggcgtgcctgtccgtccacgcttccccactgggctgcacacaactaacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 4126 - DNA, 1177 bp, Oryza sativa
  unsure (1)..(1177): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcccgatttgggccaacaacgccccgaatcggttcgaacaggtggcacctttccacgacaccttgctgctgcttatccagttatcccaaacccagattagacgggccgaaaaagaggtttctaccccattcatccaacacgccgcacatcgaacttcttatctagctttccgagtacttccaagttccaagtccaaccccttctatcatgctccatgccgcgcgcatgcatcatgcacgctggacgcaaactacgtgtcgaccatggatgcgacgcgacgcgacgcgaggcttgcgtatgtgctcctcctccctctccgcggtgaaagtgaaaccgatcgatccctgcaaataattcaccgcgcgcgcactcctcctcgggcgccgatgggtggatacgtccacgacgcgttggttactttcgcggagtgcaaatctccggcttggctttccccccgtgcgagccccgcggacagggacggggtttcggccccgcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4127 - DNA, 1062 bp, Oryza sativa
  unsure (1)..(1062): unsure at all n locations
tatggtgctcacatgccggaaaatgttgaagaaaaccagtgcggcgtcgaccactgngaaggtgggacccggcggcgatagggcgggccattttcctgccattggtcctgaccgagtgagaattcactttccacttgttntggttgatccaagttagaaaaaggtcatctagcagttagcttaagccgtgcttagcttgcactatagtctcacagagggggtccctgcaagttacaaccaaaggcataagcccgaaggtgtagttctttcacaccccagtactctgctcgtactcctcgtatcttttgctcacttattctctctctgtgcactacggctagatgaatggacgggtggatttaaagttaatggcagcggcagccacgtcacgggctccgccgtagcgtagctttgctaatcatgccgcgcccaaggaggagccggcacgtgtcccccggtgacgtcccacgcgacgcaacagccaacagccgcggcgaaagagaggtgggattctctcccccgtatccctggttgcgcgccgctgtatggaaaaccgggtaggggacgtgggtcccgcttgtcggtggtgcgtcgacgacggtgtggagctgcgcgtgggggactcggagcggagggaggaagagacgggccgtgggccagagggtgtgctatgttaggtcttgtcatgggtggggcccagaggggtgattgcttacttgcgggcccagttacgggtggtgaccagtcgtgggcccgggcgtcaggactcgcccaatggagggcttgctctggggagggcagcgcattaaagggcgcgtatgatttgccgcttctactagtgcgggtcgaccagtaaataatgactccacccgtccattggcattccttgcaatgccgaatttactattttcattctcattcgccactcgagtcgatggtaaatgagaataaatagatcacagaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4128 - DNA, 1450 bp, Oryza sativa
  unsure (1)..(1450): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccagagacggtatctgtcagccgggtgatgcccaactggccagccagcgcgcaaaagaaaacccgcgcataggcgggttcaagcatcagcggctcattaaaggccatactggcaatatgcggaagattacgcagctcgtgcgccatcttgctcctcctcgtttgattttttcactccggcctcaaaagctgcagcggcccatgccggtggtttcagacccgcagcacgacgctccatggtttcccggacctgctgggcaaaaatctcctgataatcatcaccgcgtttggcgcactctttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgtatcacgatcngggtacgcagaagacatgtagcaaagcagcaaggcagaacgtaaaagccggtgtgcgttttctagctcgcccctgcagatcaaattg

SEQ ID NO: 4129 - DNA, 1688 bp, Oryza sativa
  unsure (1)..(1688): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggagatggcgagtcggcggcgacgcttctagatggttcgaaaccgacgaggaaagggcgtgaggaggggcaagtggttcgtggaagagctgttcggattcggcgacgtgtggcttggtcggatcggaaccgatcggacaggcgcagttggcacttgggacgaagggttggtacatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgggaaaggaccatgtggccccaaaaaggccccccaaaaggccccgcaaccgccaaaaagggccccgtttgctgggggtttttttccttagggtccggccccccctgggggagcgttttcaaaaaatcggacggtcaaaccaagaagtggggcgaaaccccccccgggcgctttaaagaagcccagcgccgttttccccccggagaatacaccctgtgggccccttccggtccgacaccttggggtgttc

SEQ ID NO: 4130 - DNA, 847 bp, Oryza sativa
  unsure (1)..(847): unsure at all n locations
ttgcgctgncgganggaattcgacagtcgcttgcancgnccgnntaanggttgagattactccaagatctgtgctaccctttataattctaatccttactttttttcacttcttccgaccaaccacatgggtgtcgttgccttctacatctttcgccccctaacttattccttctttttccctagctagatacatagtagctcgtctacttccactaccccctccatccaaaaaaaaccatcctaagtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgact

SEQ ID NO: 4131 - DNA, 1185 bp, Oryza sativa
  unsure (1)..(1185): unsure at all n locations
tgcctggcnnnatgagatcatatcccctggcaggnngcagcgcacgtgcttccctgaacaggtctaataagggataaaataatgtttctatgagtatcctggtcttgacgtttcaaaccaagtactccctatgtcccaaaatataagggattttggaccacagggccttctcgcttcacagcgcaaatgcttggaaacgcttgagtatcacctccccctccgacacaagctcctgcgggggatgtttcttcacgacacaatactcctattgcgaggcatgatttaagagtagtcccactgtattactagaaagcccgcagaagcaattccactagcacatgatcacagacagcctttctaactgacctactccgacactactgaaacccacctgagtgagagagagagcgtcactgagttagagacaccgatatatctatcaccccatagcctcactccttccacaactgtcactatatcgggagtacacgggagctgaaacccttatgaggtgctttgacaagcaggccctattattcggtcaccagacctagagtgagcaaccacgggaggcgacaaggcctcgctagccaggatgagaccgaacatcatgccagaacctgggagcgaaaacacaatcaattcgatgtgaatcaccgccttcatttttgggcaccgggggacagactgactggctgtcctaccacgctttataaaaagatggtgcatcaccgtcctcttttgaacccaagctacaggaaaaagttccacttagcagggccttttacctcacaaaatatattggcgcccacccaagactacccgcccaagtaaaaatgtttgggccagccaataaacaccaaatggcttgccaacgttataaagctgacacaaataaccctggtcccaaatacgaaggaatttggcaatggtagggcacccggcaaacactcgcggtgatttcccaccccttaatctttgaaagagcaaaggggtttttcccctatccccgcaaatttgggcctcgcccggggggagctccgccctcagaggcccccgcggaccctctaaccttggtgtttttaccaaaacattttttcctgtgcccaaacaaaaccaccccaccctatctccgggggcctacgaacccccaatagagtccgtgacccaaccacacttacgaag

SEQ ID NO: 4132 - DNA, 961 bp, Oryza sativa
  unsure (1)..(961): unsure at all n locations
tgatctgccaggttatcctcttcngatcgatatgcaccattataaatatctggattgcatctctgatcgcactgtgcaacttcatcccaaccatgcatgtgcatagatctctgcacgatctgcgcgccgaagacctagacagcaatcggggcatgcatttccttgctcttatgtaggaaggacattcttattccttggtgccattaaagacactgatgcgaaaatggaacataataataagcacaactatatataaacgaattcaaataaacccaaagaataccagttccatataaagcttgaaaattagtagcctccttttcatctgtatttactatttgcctactttcttctgtaattaccatttgcatctgttggatatctctagagttaaccaacgagaaattactttccatctgttactcttgtctgcaccatcatgttttttttttctttagtggagtgtcgttgactgttattcatctttgtgatcatcttactcggttcagactttagagcactgagatgtttcacgatagcaaactaactgcatataaacattgatttgtatgccagatggtaaatcccagtggactcctcctaaaagtcgcaccgtgtacaccaaggataacaaacagtcaaatcagtatgattcggttgatacgtcctgttttggctcttctgtgaactatggtggtcgagactattatggcatctctggacacatgcaatccacagcatccactgatgtaagacatcgccaaacccaaaactgcaaattattgttgcaattactttttttaaaaaaaagttcatgaactggtctatacaactatcccacaacaaacttttgatatacttttggtttaatggctttaaggatagggccgacaaaaagaacccttccaaagatcttcatggggactggtggcaaagtattattacctatattagaatgcat

SEQ ID NO: 4133 - DNA, 1077 bp, Oryza sativa
  unsure (1)..(1077): unsure at all n locations
tgtgaaagctggtttttttggggccttaaaagccagttttaaccatataattttggacatgagattggatagttttaagccagccttttaaaggcttaaggctttgatgtgattggatgaaatttcatgtaagttgttgatagtttcccagttttccggctcctaggtgtgcatattggacttttcttcttactaggaccttagcaagtacaagccaagcttcttcancggattttataccatggcactttaaagcaagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctggcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagnnnnnnnnnnnnnnnnnnnnnnnnnnnnnnnnnnnnnnnnnnnnnnnnnnnnnnnnnnagatgacttcatcacttccataccatttatgtgcagttattataaggctggaaatgaaaaatttgttttttttttctcagtccttacattccttgagcannnnnnnnnnnnnnnnnnnnnnnnnnnnnnnnnnnnnnnnnnnnnngcntagtcattcacaaanncaagc

SEQ ID NO: 4134 - DNA, 1010 bp, Oryza sativa
  unsure (1)..(1010): unsure at all n locations
gaggnncnntttgtgactctgagaccctgtcttagggtctacaagtgtcagcgcgtgatccggaaggcgttggctagcgctctcgatcgcggccgcagtccagtggccggcgggacgcgcgacggcgggctggtaggtccacgcacgcccgatgcgcgcgggcgctgctgcctcgctcgctcccgctttctatcctgtttgccgtggacggggacggctcggtggcgacgagacggaaaaggcgatgcggatgacgatgccgccaagggcgcggggccgaaaccccgtccctgtccgcggggctcgcacggggggaaagccaagccggagatttgcactccgcgaaagtaaccaacgcgtcgtggaaactcatgattttataaaaaaaatatccaagcgaatttccacggtgaattttaccctacctaaaccctataacaataataaaattaatatagcatttacatgttacaatgtacgggcatttttctagtgatttaataaatttgtgctcacatggtgagaaacccgaccttttaaattcttaccaattctctctcaaaaagttcggtttcccaaacagtagtaaaccatctctgctggtggtttcttgatttaatttactccggtacccaagatagcaccaaccccattttaaaatatatataattagtatcgataccgacattggagatttatactattaccaataggaccgacaagggtaaaggtatgtcaattagaacacggtggtctccccttcattaggttcagaattcacttatttttcacattcttaaacacaaattggaaaaagacacattctctcgtggcatcaaaaactaaaaaaatattatttattttacccattttgcatagcaaatatttttttcatttaccaaacttggtacaactatttctttataaaaaaccttttatagggaggattgagaaaccgcaaaacatgtcggaaagggaaaatttttttcatattaaggggtatttttcct

SEQ ID NO: 4135 - DNA, 1597 bp, Oryza sativa
  unsure (1)..(1597): unsure at all n locations
cttttacaatttttaagaggaaatttttaaaaattaatcttaagatttcaaataaccgttgatccaccaatttattgatccccaagaattcgtataaaaaaaatattgaggccttaaggtttaggaatagttgaaatgaataatttaaatatttaatgtaaaaaggttttgaagggttataaacaattaattggcttctaaaaagttataatgttgtttaaagaagacaccatttagaaacttggaaagcgtgcaaaaaaaatccaaaatatggaatcgggaaaaaaagagagggccttaaactccctttatcacccttgtcgtactaagagttctattgatattcgtcaatattgcactcacatttataacataatgattcctttcacctgtacggataaatagtacaaaatccaaatacgacataacacaaatacattataattattatgtaatcaactctcggtttcaacttaaacagagctaattagtgttgagaaaaacacaacccatggtgcttaattattctctcgctgcatcacctttaattttatttttatgttattaacaaaattaatcatcttcatatatgatttgatatgtggcaaagcggtagcgctacagcggttgtgatcaccttagatgtcttagacactacgctttgtcacacgtgcgaaaggccaaggtgcagacgtgcgttgtgcagcaggcaaaaagagaatttcggacgctttatttattagcaaacaatagatccaatgattataataatatgtccaccagttctactgtaagtgtaaattagttaatatagattttaaattgttaatataatggatacacaatataatggtgtagaccttattttgaaacagtgcattacctgagaataatagaccaatgtaaaaaagtagatccgataatttatataatggggccatcagtttaagtgcacgtataaatttgttaatatgatattgtttatttgataggtacacaatataattttgtaaaatttattttaaaatagtgcattatttgaaaataatagtacaaagtaaagagtacaccggtttaaattatatgatggtagattctttggttgtaaaattattattatttaaaaaatatatccattatatatataaattgaaaaaagaagaaaaaaggaaaaaaaggggaggaagcatacgtacagtacgtacgtatatacttcaactgcccatgcgncgggagaagataggtggaacccatggtatttagtttggtttaaggatcaaaatattttttttttaaaaaaaaaaacccctctctacgtgtgtaatattggacccaccaattaatttgaaatcaaagggatagaagttttggtttttttcttagaattctaagattttctctattttattaaaacccccaannnnnnggattgcaggaactttttaagaaaatttcatgggccttttttttttttaatggaaatttgatatttttccaaccctgtattttttgatccgggatttgtaaccaaaaacgaattttaaatttttaatgggggcttcttttaccacattttacaaatctaatctgggttttt

SEQ ID NO: 4136 - DNA, 1291 bp, Oryza sativa
  unsure (1)..(1291): unsure at all n locations
taacgtttgggggtccagctatagggtttttacatggtatggagttgttggggcccaggggggacccaggatcaggttaaaaaaagtaggaaaggaggnatttttaagagggttccggcccctttccagggaggggaacgaccctactccggtgtgcttaatgnnngnttttattctttattaaaatggatcacacaagtataatattgggattacccatcctagctgtcatcgattgggcagattagatcatcaacatgtagtcgacgacaaagtggggtttttcccccctttttttcccccttttgggtcgaaatacgtacttggcgagatcagagatagcactagatctttcttgtcagcctccgcaggcaccggattgagtccatctaggctatctccaatatcgatgtttagcttgtcttgacttgtgtgttgtgtctcctctcctcctagggggcttgtatttatacccatagaagtctcattgtccaagtagaacgaccaatataaatataatccgagcagtctttatagtttccatataaaacacttcttgtccttccttattcggaactctttctatataaaaaatatgattccgtataagacttagtatatggtggaccccgctgaacttagtcgatgactattaggtatgtggtatccataacccagacaaaaggtagccatcaacaacacatggagcttagagacaataatagtaaggtgcatgctaagactgactatccaagtgtatcaattcatttgtataaatttataggagtatcaatatatcttgaaaaccgttatatgaaatggatttgacaattagacttgtgtctcttattatttatatctgaatcgatgagagtattaaatacctattgtgttggttatataccctttgtgctatgttacgttagtattacttccttcgtccaaaagttttctacaacatattttatcactgaaaccaacaagaatcgaaatactcgttcattcaattaaacatccgcatcgattcatatgcacgttggtttggttggctgcgtaatgcatgagttcatcgtctctgctaaaaaaagacacgaatattaaggaagaacctaatattaaataattaaaaatgatgaggcttcgaatccaggtcgtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4137 - DNA, 1030 bp, Oryza sativa
  unsure (1)..(1030): unsure at all n locations
tgggccctnnnttgaattgcactgccgtcgcgtgatggatagactgagtggctgtcaataccacgctttagaagaaggttggtcatccagcggcacttttggaacgcaagctacaggaaaagcttacacttagcagggcctttagcctgacaaagtagattggcgcaagcaaaggagtgttggccgaggaaaaatgtctggtaagccaagtaacaccaatcgcttgtccaacgctaagagctggacacaaaacaccgtgtcccagatcacgaggaattgggaaatgatagggaccgtgagaacgccacggatgtcccccacccataagttgttagagagagcagaggtgattgtgcgcgatgcccggagatgtggtggcacggcaaggaggaggccatgcaccaaggaggccaccgagcgaccctcaatccattggtttctctaaaagagagacgtgtcgttccctggcacgaagaagatgaacgacgcagacatatctctcgagggggcctttaagtcagcccaatagaggtggcctgagcgctgaagccagagctagcgaaggtgaagaatgaagccacaagtccacaatacccaaaccaccgatagctctggggcgacaaacactcgtccaagacataatggatcgtncttccttggaatggattcatacccgtncactggaaagcgcgacattttcttattctatggcattttgaaaccaaaaaaaaaacccccccccccccaaaactggcggactaactgccatagacacattgacccgaatagaagattacatggactgaatttagcacagaacgattccgaccatactagggagaaaagtcggtgagaaaatggcctttccatttttaaaaatttgagaccaaacaaagttggggaaaggactcttgggcccgggtaactatgtgatggcctattgacgtttattatgccatcgatttttcatcttatttaaaagaattgtgaaaaatttgtaaaaaacaccgggttagctttttaacatttt

SEQ ID NO: 4138 - DNA, 977 bp, Oryza sativa
  unsure (1)..(977): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgccgatcgcgcgagctttgcctgaatcgtacagctgctccatcgctcgccaggtgctgggtatgtcaggcttgacgaagttctctggactgagctccgtgcctttcttgatctgaaacggccaatgaatctgcagagattgcaccgttgggcacctgtcagaagcagagcaaaatggcaaacctttcactgtctacgtttacgctgatcatgatgagcttaccagatacagatcaacgtaatccagctgcagatctttcagtgtactatccattgcgagtgggacatcttcaggtgcgaggtcgctgcacctgcagagtttgggacgtcttcaagaggaagggatagaacataattcgaaatagcagaataaacttgcactactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggg

SEQ ID NO: 4139 - DNA, 684 bp, Oryza sativa
  unsure (1)..(684): unsure at all n locations
ggggcaacttgcctcgggctaattgactcactgtgactgcttcatgacaaaaatacacctatatagtacnngtggtttatttttttttataaaataagctatggtatcccaattcaataagctctccagatagtatggcctcttctgagttctcaccctgccactgtagaaagcttcggtacacaggccttctgcttgcttccttctccaggtacatgcctgttgaaagcaaagcttcaattttgtttctaactttacttttttcttgtgaggatgggcacagggggcacatgagcaaaagttgaggcagtggactactagagacctttccttaatctaatctgtgatgatggattctcgttaagcatatgttctttccactctaagatacggctgatttgatccctcattggatttggaacgcttttcaaaatgcttgttttttcgacttggtgatctaaatagtggcattcctgctgcttgtttgatgcattcttaatcacgtattaacttcctggatttgttgtttctggctgtaatgtataaatgtggtggcccggcttctcataagtagagtggcttttagaacacgttaatgctggaattaacttgccagatgnnnnnnnnnnnnnnnnnnnnnnnnnnnnnnnnnnnnnnnaaggaccgtcatcaatntntccaggc

SEQ ID NO: 4140 - DNA, 992 bp, Oryza sativa
  unsure (1)..(992): unsure at all n locations
acannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgccaagcttctctgcaatcgagataatgatgggttccttaaggacattgccgttcataaatgttgaaccaggtgaacctagcggcgagtatgcctaaaaaaggaggaagaaaaggatcagtaggtttcagaaaaggaaaaaccacaggtgtcatttgttcattactaatatcagtcagaggattgactcagttttttagtatgtagacttacagaaagatgaatgcccgttgactggcaaaagttatgcagcttcatctgctgccaaccaggatggcactccacctggtcaacagctggaggtacacgggctgcagcaagcaggtcacccaattttttcgatgagaagttactcacaccaatggcacgacttttgccagaatcatataacttctccattgctgcccaggtagatgggatgtcaggtggtaagtagctttcaggtttgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4141 - DNA, 743 bp, Oryza sativa
  unsure (1)..(743): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggtgccttcaattgaatccaaacttacctgtcattgagaaatgcaatgctgaggcctgttgaaaaagctgcaaggatggaaactggtttccggagaaagcccatccctgcaaaaagagagacacaagatgactatatgaaagtcaaaaaaatagtagggatgggggggttgggggagtacagcacatagaggtctctctgcctaccaagaatgaacatgatcaagatgaagtagttcgtcctgtagctgcaaaccagcaaaaacgttggaaattaactttgttgaaagatgtaacatggtacaaaacaaatatgtatttacaatataagttctaatgtaaaatggtagaggaacttccaggttctattcctaaataatatcgatatgctgccttcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 4142 - DNA, 706 bp, Oryza sativa
  unsure (1)..(706): unsure at all n locations
naagattttttttgagagccgattccggacagcagcgggcagcatgtgtcgctggccttggtgccgactaccgtgtgcaccagcccgttcagcatgttcacttacgccagctgttgtatttgtcttttacacaagtcatgtacgaggctactaattttcaagctttatatggaactggtattctttgggtttatttgaattcgtttatatatagttgtgcttattattatgttccattttcgcaacagtgtctttaatggcaccaaggaataagaatgtccttcctacataagagcaaggaagagattgggtcaatccacaagaccacaactacctgcagtcccagcttgtgcagtcccgttctgccctttgtagaaaatggagtatatgtcttctttgccttttgcctgaaaatggaaaaatgtaaaggaattcactaagtgtaaacaaagcgccggcaaaacaatactttgggattggataaataccatcaccatcaaactatataaacaatctctaaggttgatttccaaaagtattctacaaactatcgcgtatccacttggaaagacaggcgcctgtacattgaaaattactaattttcgcaaatagaaagaggaggggggggggcatatctacattaaaagcatactaaatttatgcgtgtgcaacagcgatgggatgaaaggcanattcagcatgtatt

SEQ ID NO: 4143 - DNA, 819 bp, Oryza sativa
  unsure (1)..(819): unsure at all n locations
cctcatttctgcctctgtaatccgcatcaccctgtggaaaatgctctgcatgcctgttcagttcatcgatgttcagtaggtcgtcgatgcgagcgacaatgttggacgccagactctccagcacccttgaataactctccagtattgatttacccacatcctagaaatggttcaagacataataatgacaggtgcatcagtaactagcatggcaatgtggataaaacaaacataggaagattcagagagatactgcacaaaccctgttatactgaattttgctcatgtccaagcttgtctgcgtcagtccaggaaacctttgcttcaaacatatcagtaggccctctgctcgttcggcaagcagctccctcttctccgtgtctattatcatgtctttcaccatgccccaggatgatctgccactggtggcacggcctaagacacttgctggttttgcagcaatccttcggcgccacacatacactgatgcctcgacacggttggcgatttccagtgcttggtactccgttgacaggtccaggcagtcgagaaggcactcaggagagaaatgatcagacgttatgtaaaggtattatgtacttaactaactgatttagtagtaatgataaatgaagcaatagtaggcttcagtaataccaacatgctgtcttttattatgtcattactggtgcaatttcagattgttgtggtaaaaaactcatctgcctagtgaaaaacaagatgaaantgtgatttgctaaggngagtatgtaaangattctttggtgataaattagaattaatctataccagagtctt

SEQ ID NO: 4144 - DNA, 999 bp, Oryza sativa
  unsure (1)..(999): unsure at all n locations
gaaatatgttccttatgaggaaaataatctttactggttttattatggttaaaaacagtcttcatagggtttttaatttcggatttttaaagtttagagcgcatattgtccttaataatcattaccagaacatgtaacaaaatatgttcttttcctagttagaccggccggcacctgttaccctcncctttatattagttattttttggcggaaactagataccttctggacagcagcgtactccatcctgcaatcctgctgttacgccttgccatgcataatcaatgaaatgtgaagcaactcctgttcggatagcgcccctcctgttattagcggctttaagtatcccggtcctaaatacgggccggatcagtcactagatctttgcaccaaacactagccatctcgtccaaagatccttagcatttggtggtacgtgtatcatgaaatgtccagtatacatcaataccatcatcgccgaaccctacccgtacgtagtgtacgtagtagtagtacgcatcgtcccaatccaaccataataggctcacgcgcgcacggcccgatccatccgatcagcggaccatcacacgattataattcccgagaaaagccatgcatgcatgtacgccccatgccggccggcggcctaacccggtgggccactcccgaccggtggttatccagacatgtcatgctagtgtgctaccgctgctacatgcacgaacagtgctgatatgagcccttaagctaaaatatgaaatgcagatgtctcccaatctatatccattgataataataacagcagatgcttagcagattcaaaatcaaacaacatttatgtgttggaaggaatgcgacatgcgaaataggggttaatgtcacatttgcaggttaaaggaagaacagcttgtaaagtgcaaaatatctttcttcccaagagcactaacggtgccttcaatatccatcacacaacggccgtcgaaanaaaaagggctctc

SEQ ID NO: 4145 - DNA, 750 bp, Oryza sativa
  unsure (1)..(750): unsure at all n locations
gagggagaaaagaggaagggaagaagaaaaaagaagagggggaaagaagggagaaaaaaaagagaggagagggagganaagggaggagaggaggagaagaaggggggaaagaaaagaagagaaaggaaggagaaaaaagaggaaaggaaggggaaggaggggaaaaaanaannggnnnnannnnnannnanannnngnnnnnnntnnnaannannnnnnngnnnnnnnnnnnnnnnnnnngnnnnnggngtcatctattaaaaaacggaggtagtatttaataaaactaaaatatgaaaaaaagtttaactcttttgatggagggagtatataagatcaggtgaactaacgttgaggagcaaagttgattgtggtaaaagaaaggcagaaagcgttattagactccctaaagacgaacgataagcccttcgcaaagacgacggcatgcatatggtatgatattagattataaacagttctagtggcgcacagcctcgttgtcacccgtcgcgcggcgcggtgacgaagcagagtgcgagaacaagccagcaaagaaccgcgggaaggaaaaaacaaatcgtaatgacggcatacaccgtaatgatgaataacacccacatcgtgaggagcatctcatgggagttggccaagacgaaggtggcannnnnnnnnnnnnnnnnnnnnnnnnnnnnnnnnnnnnnnnnnnnnnnnnnnnnnnnnnnnnnnnnnnnggagtagcattcaaggccg

SEQ ID NO: 4146 - DNA, 741 bp, Oryza sativa
  unsure (1)..(741): unsure at all n locations
cgtgagttacaccacnnnnnnnnnnnnnnnnnnnnnnnnnnnnnnnnnnnnnnnnnnnnnnnnnnnnnnnnnnnnnnnnnctcactgagcagatggggtagcaggagacaagaatcaagggcgtacaagacatggcgatttggaacataacaatggccttggccggaacaccatcgggtacagccactgcaaggggtactgagatgaggaatactaacactggggacagcaccagcgagcaccaggggaggcagttaagcgtactttttttgacagcgctgcaaaatatagaattggaacttatgcaatagaaaacatatgattgcggatatgatagaggtgttcgtgctatatactatgcaaaaggctacagttcaacagtgaaacggtaagtactaaccttgagagaaaatatcacactgaactcgtattgcaataaaggagcggtgagcgcctgacagacctgagatatgtactatggctctgttaccaaatgtaccgaggctatgcatcttcagggacagaggcgcggngcacgttaaatcactgaaggtgaatgatgcataggatgcatactcatatgcggagactggagatgagatgcacatgtgagagaaagcgcaactattgctgacagtttcaattgcacaaacagagattggggcaatggcagcgcattcatgtgtgaatgaatggtaatagataaggtagagtttatggctatataatatctatttgaan

SEQ ID NO: 4147 - DNA, 756 bp, Oryza sativa
  unsure (1)..(756): unsure at all n locations
ccgcattgtctgcaactcccnnnnnnnnnnnnnnnnnnnnnnnnnnnnnnnnnnnnnnnnnnnnnnnnnnnnnnnnnnnnnnnnnnnaatttctcctgtgatatttttgcaaagtcgtcttcaaaggttttgatgactccctggagctttccaatttcagcctcaagagcagatatatcatgcagatacttctccgaaagtacctcaagctcctgtttgcacttatcaatttcagtatcacgatgcgcaagttcaacttcaaactgcttggctgccgataccattgattccttcagcctatcaatttcatctttgttcaccaatacaacagcttccaatgcttccttttcacttttgacttcatcaagatccttctgaaggctactggtttccacatctgaaacctgttgcttttcctcatgttcagacagttctgagttagcaccaaaattacaatggcaacgcatgttcttttcctcggaagcatcaagtttaccccttacttcatgaagctcatcctcaagctcaataattttttgacttagggcataaaaaatgctattgccattttcttctttagcctcatcaagctctaaatcagattctgaagatgatgaagacccatcacttcccttcttggatacgtcagaactcataccagagccaatagaaacatcaaagcaatctgatcgcggtttttgcttttgtgacatcttctcttgcagtcacgctcttgtgatgaaggagactgtgcct

SEQ ID NO: 4148 - DNA, 23269 bp, Oryza sativa
  unsure (1)..(23269): unsure at all n locations
cgtgaatggtccacatgctnnnnnnnnnnnnnnnnnnnnnnnnnnnnnnnnnnnnnnnnnnnnnnnnnnnnnnnnnnnnnntgcgctaataaatcgcttcgttttatgtatcggagggattagtttcatccccaagaccacaaccaacgaacacagccttacttagcccactccctttcaaagaaaaagctgcgcgatcactcgtccagtcctatcatttgttttatgcttttataagctaaacttttaaatttatacagttaactttgtgagattttattgaagtttattttacaacatttaattttgaatcataaataattttttttgaacgacctgcacgagacggtgttagattctattgatagagcaagaaaaaaattacaagattacaaccctggagggtcgtaaccaggaaaaggaaaaaaaatataccaccacccccacactgacagtgccaatacacaactccgggagaaggctaacaccggaccggccgctgctaagcgtgaccgactgccgctagactaacaaaggagcacaaacgagatcgcccaaagtcgagaggctttggctagaggataccaaaaacgacgtcttcaagaagataagcgacggaaaaaccgtcatcgccgtccgtcggggctcaaaggagctaagatagggctttcgcccggcaaccacccttgagtgctgagacagcacgacaacgccctcaggagggataattaaccatcgttgtcggtccggccaaggccggactgggttttcacccgctactcaccacccgcgaatccacggttgatgcaccgatgctccaccatcactcaacctctgccgacatgtgggaccactgcaacagtgcccccctcccccctccccggcgcggccagccttcgtgcgccgaagaccgcaccacatccgccgacagctcctcctcgcaccgaggtcgccttctccaccgccggtcgcgcctctcgtgccaagccagcctcctccattggacgcgcctctcgcgctaatccggcctccctccatcggccgcgcctctcgtgccaagccggcctccatctccgccgcctacgcctctcgcgccgagccggcctccgctgccatcggctgcgcctctctgcgccaagccggtctctgacccctcctccaaacgctgctgcgcggccagatgcagccgtctgccacaccctcggatagccgtccgaggccgtcatgcctcctcccacctcagccacggtcgtcaccaccgtgccccctcccaccgcaatcacagccgccaccgccacgacgagctccgcgcctgcaacgacgctactgcgacggcctctgccaccacaccgtcagcgtcaccgtcgcagcgccctgccgccgagcagtcggccgcgcctccatcggagaggccgctccactgcccttggccggccaccacgtcacgcggccgccacgctgctgctcggaccctcgcgctgccgcacttctgctcggctgccgcgccgtcgccacgcctagggtgccgttgtcgcgaaaatagacaaggtgtatataaaagttatattcataaattatttttagttggtaaacatttgtataagcgaaatggaccccgtcatctccgaggtctcaccggtttgcggctgccgctttgcatcgatcgacctgccgcccgcacgttagatttgcaaattgcaagcaatcgtgtttggtggagaaaagggtcggtggggtgggagaatccgcgacatgaacagacgaacagcccaacaccaagaaggcaaaaaattaaaaagaattctgatggaagaaaagagtttgcgttgcatcagcacggaaagggacacgtttcttcaggaaaacactacctgcatgtgatgtgcatactagtaccttccagttttgaagtagcccagatcgcaattctcacagaaaaaaaaggggggtaaaatggtgttgcatctggagcaagaaacaaaacacatgctagtttgccatacaagaatactgcttcaagccttcaatagatgatagaccactcaaaggaacaagcagtgtacagtttcatctctgtaagggtgtgtttagttcacgtcaaaattgaaagtttggttgaaattagaacgatgcgatggaaaagttaaaaatttatgtgtgtaggaaatttttgatgtgatggaaaagttggaagtttgaagaaaattttttgaactaaacacggtctaagtatcctgaagctgcacagaagaacaagtttgtcgaacactggtggaatcttgtgctcctcagtaacactcaccaaccactcagaactctagtgatcctggtatttgggaagtatggtacggacgtaatgtaagaattttctgttacaaagcagcaattaacggtggcatcaatcctagctaagatcaaggaggaaacgagagcatgggtgaaagtaggagtatatatttagactctaggagttcggaattttgggagaaacttattacctaaggactcctttgtacatacgagacaaagggtgtgtttagttcacgctaaaactggaagtttgattaaaattaaaacgatgtgacggaaaagttggaagtttatgtgtgtagaaaagttttgatgtgatggaaaagttgaaagtctgaagaaaaagttgggaactaaaccaggccaaaccttatatcctccctttaaaaaaaagcctgtgtaggtaaagtagagctgtagaacagtagaaaacaatgtggatcagtggatggggaggtaaacgctaaactacttaaagcaacccatatcgacatcacccttttgctggtgcattttgtatgtcatgactgttgtgactgacaaaaacaggccaacgccaaaggggacagaataatgcagaaaaccacaccagcaaagaatgagacttgcttccagaaaaaaaaaaaggtgaaataaaaattcagggattttgttatgtcattaactcaggaagacaactgagtactgaataaagcaccatctgaacttaagttccaactgccataataagaggagtgttcagaagttcctaatgacgaaaatgctcaagttgcctaacaatgcatttcaccagagaatagatccatcaacaatacatatggacactgaattgtgtgtgaagtattgttcaagctacccaacgatatagcatttgaaaggacacgctcacctagcaagatgcaggcagacaggcagagcgttgcaacctgtcattttcgcaagtaagcagaaacacttgcaattaataatggtttacaggcttacagcaacgattagaatgacataaattgaacgtgcctacatatggaagtactccctccgtcccaaaataagtgcagccatggttttccgcgctcaactttgactgttcgtcttatttgaatttttttgaaaaaaaattaaaaacataagtcacgagtaaattactattcatgttttatcatctcataacaacaaaaatgctaattataaaaaaatttcaaataagacggacaaccaaagttgggcgcggaaacttatggctgcacttattttgggacggaggtaatacttcctacgtttcacaatgcaagtcattctagcatttctcacatgcatattgatgttaataaatctagatagatatatatgtctagattcattaacatcaatatgaatatgaaaaatgctagaattacttacgttgtgaaacgaatagagtactgaactactaagaactaatcggatcggcggcggcgcgtcctcctgtcgagaggaaacagaattgggaatggggaggggagaagttaaggtaaattcgattttgggcccttttttaaggctattgggtcgttgggcctgaaataatgagggaggaggccttttgagtgggatttctttagatgaatgggcctcctttttttttctatatacatatgaaatagggaaatgttacaagatggtatcccattcgaacgagacgatacctcagagatatcgcctgatacctggtaggtccgttcggacgagaggtatcatcttgtccaaatgggataccatgcgcacgcactggcaagattcgacctcggcgtgcgtgggttgtcgcccgccgccaccaatccggcctccattccccacgtgcaggctaaggtgaagagaaagggggagagaaagagagagaagggagagagagggaggaggaagaagggaaggagagagaatgatatgtgggccctataatatttttttgtgtgaatgacaaatgagtctcacatatatttttttaattctaataccacgccaacgtcacgtgaagcgaagactaaatcaacaccgctgtgtcaacggaaccgccctctaaaaccatcgaagaagtcaagttgcaccgattttaatagtttatgggtcgagatatccggtattatggtttagggatatgaataagattcgatcactagttaaaagagtccaaatgaacttaccaataaagcctctcattttgtttgggccatcttgatcagtccagagaaatccatcatcagtgcataaacacaatcaacttgctctcgttctttctctacttttacggtggttgcatctatcgatagtttttttttctttttcttctctctgcttactctcgtcgctctttccactattttgatagatctggtaagcgcgcagctgcatcattaaaaagaaaatgtagtcccaaaagtttatatatgcgtttgtccgaactgcaagctaaagtgagcaggagaagtgtattactctctctgtgctatagtataaggcatacacacattccaaaattcaactttaaaaacatttaaccaacaataataataatataagttaaattttatttgctaaaattaatataattgaattgacatttaaatttactttaagatggttataattttgttgcaataaactttatagtatatgagaaattataattcaaagattagttttgaagattgtgccaagtttgaccatgccttatattatgggatggagggaatattgaattagaactgcagccgcctcgtcgaggtcttccctggcattggtagcctcgcggctagcgccctagccatgccggctcgggctcgtcgctagagatgttcgcgcagcacaggtgtcgggtacaaccgacgtcgtcctcgacgctgacggtggggatgaacatcttcggtgaaaagatgggagagggggtgaataagaagatgggcaatttgatccaaaaaatctattaagtgtacagaagggtcaagaagtggcatataactatgaaacaacagtgacatgattttaagtgcttaacgatttgccactaggcccacatgtcatagacacatgaggacccacatgttatagatagggtgtggcaaatcgttaattgccatgtcacaagagtggcaaatagttaaatttccctgattttaaatagttaaatagtaatggtgtatttcaaaaccatgaaaattgtagtggtatagatccaattaaccatttttacatacttacctctattcagattcgtgtataaatataagaaacttattttaggacttcattttactctgatggttacatcctctgatagatatgaaatgttgagccatcgtctgtacaccagtcatgaaaacccgcgagacataaaggataatcggttcatgcggcattcgattcactcagccaaaaatattgttttgaacatgggaaattacatgattgaagagaacaattgttccatgttattgcattgaaaacttgttggaaaagaacccctctttgcacttggtcctaaatatacaaaagctccatcactgggtccaaagtaaacataaacttacagtcacaaacttgaaccttgcagatctctagttctctggatctttggtacaaaagaatgaagtctatctgtggatctatgttcccataggaagttacagtgagaaagatgtggagcatatccagatacaatcatacaatatctgttgtctaagtttcaaggcagatctgctatcttgaaggtaaaatcctcccaagaacccttttactgctagtagatactagatagtaatgttaaataaacccaaaaatgtaactggaatgttcattacaatctgggttggcttccaaccctactatccgcctaccaaattgaatcctgtataatgccgccttctaaaaggaaggtattttcacgcccttgagtactttgagctccacatcggtaccttgagaggctcatcatcaaccactccacctccattctcaactttgctcagagagtctgagatcaaaggagccgaatcgccttctttcgcctgtaatatatggcgttttgaagagctgataagatatgtgggaacaattgaaacgattccagaactaatggtgaaccatttgcaagcaataaaattcagactggaagctacctgttgtggggagacttcggcgtttttttgctggccctccaatgtgcagaagtatgagtataagaccattccaactactgcaattaggatgccgagtatgtttctccagctaaatgggtcatgaagcaaaacataaccaaaggtcagtactaggcatgttttaagatggcccaggacttggtaagtgacaggagaagtctttccgatcacaaggaaagtgctgaagttcactgagacagatatcaagcacgataatacaatgaaaaactgcataagaaacaagggcaaaatcagaatcagataaaacaaggtcaaagtaagtcttcgaaagttgtttcactgcttaccacaacttgggatgtgtagtcgaatgcaaatacattttggttagtcaaaaatccatcaaggaatggaccaataaggaagagggtcagtgattgataggggcaagattggtataataattgggttgaagaaaccttgaacttcttctggatagtgtttgtcatctaatagctggttaaggatgacagaaaccaacaacaaaatagagtactacaaaattgtgatccataatagtgatcaaaaggaaagcaaaaaaatagttacactagtagcttctgtttatttagaaagggagcgacatcgcaaaagatactgttggcaaatatcgagttatctaacattgcaaatgtaaacaagatgtattgcctacttgaatactcaaaccagaatcaagtgtgactgaccaaagatgataataaaagcctgaccgtgtatgaaaattctactttctcactacagggtgattatgcataaaatttcattttttgggaagaggaaaataagggctgaagttgaaggatacaatttgcgcgatgcaggttgtaataattgccagcaaggacaatacggatcccacagcattgagttgcagatcagtcactgttgcaacaccgacaccaaagaggagcactgaaagggacagttggatactccggctacagtgtcaatccagacaagggttagctcaagacatcatcacacgggcgcacaaaggtataaaacacaaacctgaacttcttcctgaagaaaagagtctccaaaataacagtgcatgggatgatagccagctttgtcatctagacataaaggacatttcggcataagttaggtggattgattagtgtggaagaaagggcacatcaattgaaataaatgcttgcaataaaatgttgtgctgtaataaaagccttctgtaataagtttattgtacaaacagcaatagataaaactgcaacacatcaacaagaagatatttactttacctgtacctctagctatcattgtaccaagggtcaaaaataagtatcactactagtttactactgtaccagacacccaataagcacaggactgcagtgaattaactaggaaattctggccggtacaagaatcaacgtaaagaagatcgcaaaccttgtacctggtaaaatccaacagaattaaaaccaagactcaagttgaggaggccaatgaagatgccattgagcactccaaatcccatgacagttctcgagtcgaaaggcttgtgctcgaagaacttcatccataatgctacatggagggagcaaaatgtgacaagaagatgccaactcgtcaaggtagtggctgcaaaatacaattccatgtatggaaaaacagttggtgtcatttatattcatgtaaattctacaaacactaatacattgcaatgcatttgagaaaagaagtaacagaaaatggtaggtgaaaaaggaggctacaatcaacacaagtcaacctatgttccgcacaaaaaaggcacaagtcaagcttgacaataagttccacatacagtgcatgagttcataattcaaattgcagcaccagatcaaacaaggatattactcccctgcgtcaagcaacctggtagatgtgctactaaagcttgttcactgcactagtataaacaagtgaatctaatccacaccatcaaaaccatcaaagtttcatattcactactcctcttagcaaattttttttgttcaaaagcttcaccagaactgcatgagttcgagaaacattttatcctaccactatctctacaatgatgctctccccatctctaaattaaataccacggccaaattcacaaaaatcaaacactacaaaaaaaaatctaacaattgatctaagcacataaatcaataagcaatcctcgctgaaaacaacccctacgaaattcgcagagcatcacagatctacgcgaatcacaagcgaccaatcaagaagcttggggggaagcaaaggaaaaaaaagagcccagatctcccaacacccaccaaagttgaagccgagggagctcatgagcgccttgttgcagatgacaatggagacggatgacaccacggagaggctcagcgcccccaccgtccccagctggaacttctccccgccgacacccatctcctcctcctccgccgcccgccggccgcccaccgcaaaaagggtacgaagatcaaagcttcccgatcgagggcgccccagccacgccgccggatgcacctgcacgcgggaagagatcccatttcgatcatcggagaggcaagaagcccaagaaacccaagaaatcgagcgaggccttacccggctgtggatctgggcgaatctggcgggggcgtggagggtgggcaatggcgccgaggcggagatctgcgggtggtggtgggattcgcggtggcgaatcgggggatgggagggaaggggggaggggaggagacaaaggtggagtttttatacgggggaaggtcgtccctcttctcgcgtcgtcggtgatgagatggattggaaatggagagagatgaatgaatggagagatggatagaaagatagagagaggctttcagatttgggagctattgattgactcagagtaaatgcatgctattttcttatggttttgtgaggcctgctttagttcttaaagtttttttcctaaaaacatcacatcgaatctttggacacatgcatagagtattaaatatagataaaatgaataactaattgtacagtttgtatggaaatcgcgagatgaatcttttgagcctaattagtccatgattagacataagtgctacagtaaccaacatatgctaatgacggattaattaggcttaataaattcatctcacggtttccaggcgagttatgagattagatttttcattcgtgtccgaaaaccccttccaacatctggtcaaacgttcgatgtaatacccaaaatatttcttttcgcgaactaaacaaggcctgaggttcatgctattttcttatgatttgatgagcttcttttcttcttctcgttaaaaaattttccttccattgagtattttctctctaagataaattttggagggttttttttatgttcagatgatggtttgttttcatgttgtgatgtttcttctttaatatgtaacagaagggtcaaagttaaccgctgaaacggtaatatacatctcgacggctttatgtatactcatttgtcggttttgtcataattaataaagtacttgccgctaacaatgatgtgttactttgactcctttttagcttctagcgacataacttgaggcttgcttcttctaacaaagaatggtgccagagatagaggggctttcacatgtgggagctattgactctgagagtaaatgtctgccattttcttatggttttgtgaggtttcatttcaagggttgggctggtggacctgctcaaccttattttttcttctcaccaaaaatagtcccctccttttgagacttttatctccaaaattttggaagttttttctttaatgtttggggtgatggtttgttttttactgtggtgtttgccttcaatatgtagcaggagagtcaaagttaatcaacgggatgaatatatttcttgaacggttttctgtttcacttatttgatgttttatcatgattaattaataaagtgcataccatttatggtgatttgtaacttagactttactttgaccaaaaatacatcttgtcgatttgctacatttaattatgacttgtttcatactctcgttgataaaaccatgatgtagatccgtggatttgagttaagcgtacttcttttaacattttttttatttatagaatttgaatttatccaatcgaaaacattttattgctttcatgttgcggtgtttgtcctttaatatatagcagaagggtacatttaaatgttgaaacggtaatatatatctcgatggctttctattccactcatttgtctattttattaaataaagtatgtgccactcacaaacaacaatatggtactttgacttctttttagcttctagcgacataatgcatcttatggatttgaacgtatagctacattaaatcattatatatttatattagatttattccatactcttatcggtaaatttgtgatgagatatatttggttgagctaggcgttacttcttctgacaatttttaattgaattatttgaatttatggttttggcattgatatttattgttgatagatatgtaaataaattagtataatagttttattactatatcaatatataattttataggattttggagacttttttatagggtgatgatttgttttcgtgttgcggtgtttgcctttaatatgtaacaggagggtcaaagttaaccgttgagacgaaatcaaagttaaccgttgagacgaaaatatatcttgaacagttttctgtttcactcgtttatcggttttatcatgattaataaagtttgtgtcatttttgtcgtttatggttatgtgttacttacactttactttgactagaaatatgtcttgtctatttgctataatagaatcattctggacttatttcatacccttattgacaaaacaaccacatagatctagcattgcttcttttaacattttttcattgatagtatttgaactcattctactaataactttttattggctttagcgttgacattaaatgttgctagatctgtcactaaaaatcattatagtataataattttattactatatatcaatataatattataaaattcctggggaaaaataaaatgttgtaaaaggttaaatcaaaggcagcaacagttttataaacatgccaacgatgggatggtcctattatcaatactaaaccatattctattcatgttttaggatccttaaaattatgtgaggtcattatcttggcctaaattaaaaatagagccttagtgggctatgaacacatgcaaagaaatgtatagtgtcagtttataaaccagcctggattccctgatgtcagtttgtgcagcctcttccttgaaaagaaaaatgcagtgttccaatctccaccagaacaagcaggaactcagatcagggtgttagtattccctgtaaataaaatagtccaattcaaaaccagtgaactatcataaacactggccaaatcaattgtgaattctcttttctttgggatgaacatgcaaatattgtttagaattgtgcttagccccaaactatgatcatctgatgcaactctggactattatgggactttgaccagagtagtttgcttgaaagctgggtctaattatagaggagcacaagacaacaaatatgttggtaggtagcccccattggttagttcacttcattttagtttttcttcttggggtcatttccatgggaggaagacaggggaacagccaactagaagaaatcaaaagaccatgtggatcagttgaccctgcctaaattttagaacatttaaagctagattaaaaaaaaagacatggctatccatacatgaagaacacttctgaccgttagatcggcataatctatatcatcggatggtgaggtagtttagtttttcataatcactgtcttatcaaatgagaggcttctctagtgaagttatggggttctgggcatagatccaatgccactctttgttttaggcttgtttggtgatagtaccggagcagatcatgtgcctcataaacaatgttttggtgaggtaactgcagttcatttttatacttggggagttaatcaaagtacaaccatcattattagcattgtaaccacaatgtgatggcaaagctttatagatgcaaaggatcaattattttgctaattctattcctttgctttgctaaatgtgctgtttggtggtcctttttattatgcaagaaaagtggtttggcctatcaagaggaaaagaattggggtttggtatagtgtgaatggttgtcttctcataagccctagctttttggccctttgacatgtgagcaattttgcattgataccctgtccagctaggaaaaaggacacctttccatgtgctgcaagcaaaaacttgttgatgctagttaccttttccgattgttttttcataccaaaagcttcagtttttgggactatatatttggatctgttcaataattgagttcaaattacaatttttcattcgttggtgaaaataacaagtggccttaacgcgttatgaaacatattccgttagatttcatgaatgttttttagataatggattggtaaaaaccagacctctatattagatttcatgaatatgattaatccataatagcggaaataatataatacttcagcttaggtccaaaatgatatgccgattcttttgttcttggtcaaacaatggttgtgcatgaggtattgaggcagtagtgtctaactaactagcccaatcatactgacaatggtccacagatgtcaactgttagtttcttcttttgtgtcctcgcataattaagttggactgcaactacttaggcttcgttctatcctctaacttcaaattacaacttccttgtcttcgttttccgttagaacaattatcaaactacaaactatgcatttttacaaaaaagaaaatatagaatttccttaaaaaataaatattttttttaagtttgtaataattgcttgtacttgattaattatacgttgatgcctgtttcatattgtgtgcccctaaaactaacctagaatttcatccctcgaatgcagctgtagaagttactcttatactttaatcaattaatatatgagtaaattgcataaatctccggtattatgatccaacttgcataaaactatagggaatttgatatttgcatataaccccaagtattatggcattagtatttcacaaaacaacaatattaacaaattttatttaaatctgaacatgcataaaactcttaaatgttgacataactacagtggataagagaacttgtgtagaccgcacaagtcggattttcgttaaattggtcaaattgtgtggtttagtgaaagcatcatagtaaccggggctatatgctacgtgacaaaactcctatgattttgtacaacttgaatcactatacccatggttttgtgtaatttattcttaatatatgaggacacgggcacctaattgtgcacttcctaaataataacatagtcatgcatttgctgaatctgattttaattctagcatgcaaacaagtttcatgtgacacatgggcagatctcaagtacttgccaacaacagtaagtttgatagatggcagagagtatgaaaaaagcgatcatttttccagggtggaaagcaagtcaaggcatatgttcagaagttctctacctgcacgatatcaaccttcttgcttcatgtagggtgtacataggacttcctctagtcaaataaaaagatttggagaaactcttggaactttagtttggccattaatttaatatcagaatgactttaaaatatactaaattaatggtattatgacaatatttttcaaggaaatctacttatatctttttttttctaaactaagaaatcattgatggtcaaacttttaaaagtatgataaaatacagtcctaaacatcattgatggcaatttattatcgtaaatgactatgtaagttagaaaatcgcattgttgtcataatcttactgattatgcaggttgaaaatcgcacggtcaacctcacattggattggatgctactattatcttctaaaacaataatctagtttgcccaagattagaattgagggccaggaagaaactgccaaaaatttgacaatttgactattttgaaaaacttatttgaacaataaaccgtgcaaaaaaacttattacaaaatgaatcgcaaccttagtgccaacccaaattgcaatgagctataacgtctcagcgccaaaaccgttggcgcggagatcgtgtccggggtgacacgagttcgtcaatgacaatggcgttgagctctgtatgacttcaaatagattaatagtagtagcatatttcaaaagtatgaaaattataatgacatggatctaattaaccctaaatttaaatgcatcccttgatggcaaagaaaaaagatgttttcttactacaagattgagttatgcaccgctagtggtggaaataggagtagggcaactagggctgcaatcctactcctaagccagatatccattacaaattacattttaaaacccccaaaatgtataagataaaggcaaaattatgtaaattactctaattgagccctaggcttgagaaaattttgactacacccctgtgcactgctaagaacaaatatgagttattagagtgaaagaatgccctcagactggtgcagattgttagtgaaaaggtccaatgccatccttctgataatttatccttattgacatttaaaatcccaaaatcaaatttatatgctgcgtattgtgtactactactacacaatacacagcataaagtctcaaaatcaaaattatttaattgtattggttagtttatgttatgagaatgatgttagtctataaaatagcataaatgtttctgtaatccaaacgttgtgagttgtgaccatgccattttgtttatccaaagtctggctgctgctaagattgttgcctacaacaattggattagcactttgcagtgatcaaactgataaccttttgttatctttttttccaaaaaaaaaaagaaatttcctttcaaaaaaatttatatttcaataagtaggagtaaaaaccctagacaatatagatggtcatatggcccgaggcccggctcaaggcatgccattttggcccggcccaagcacggcacggcccgactcagggtcgtgcccgtgccggcctggcccgacagccgggctgtgcctgggttgcaccctcggcacggtgggccggcccggcacggcacgaccgaataaaaaaagtagagggacgcaaaatagacttaatgaaccatatcagacagggcctaaagagaagaggaatataaaatagacttattttcagtcatatggacccagcccacagagttgagggatgaaaaatagacttattctgtggaataacacgatgggccctcgtgccttcgggccggcccggcatagcccaagtcatgttgggccgtgcctaggccgtgtgtgcggcccgtgggctagcacgcacggcccgtattgtaggtcgggccgtgtcgacccgactaacctcgagccaggcacggccgggcctgggccatgccgcccgtttggccatctatactagacaacaaacgccaccacggctggctagacaaagtcatagcacacacaactacaacccaacaccagccacgaggccactaacttcagaccatcaacaggacccaaacacatgtcgtcgttgtcgagcttgtgcattaatgacataacatcttcgacttcgcggtgaatgcatgtcatctttactaaacgtgtgttatctcgttattcaacctgctaaaacgatatagcagctctgactccacaacgatgggcctcagcctttgactctgcagcatcacatccccgcaaaggccaacaccaacgccgagcaaatcaacacggacgacgtacattaccttcctgcacgacactacaaggttttctcaagaaagaatcgtgcaaaatagagaaaaggtcttcattccaattccctttgacagtacgattaccacttcttatattgtcgccactctcaattcctattccccaacaaactcgatctaactcaatcctgatttattaaaattttaaatacctggcttatctctaagatgataacaagacaacctactccacgatcgctctcgaggtcgtgttcctacgacgaggtcggcggtactgcagctctcccacatgacatgaattctgtgtttcgaaaaaaaaaagaaagggtattggcctaaacgattatgcaagttagaaaatctcattttttgtaattgtcttactgattgtgcaaattgaaaattcccatcgtttttaacctcgcatcggattatatgctactattatcttctaaaacaacaatttagtgcgtgaaagattaaaatcgagggcagggaaagaaacagacaacacatcccaaaaaacaacatacacacacatatcttagagcccatgatgacataattgtccattgggcacgtcctaccttttcagttgattttgctcaactatacaagagaaacattcccaaatgaacaacgtaccagaagcaaattacaggttaaaagaagcaaatcagagaacaaagttcctgctgtcaaactcatcattgattggattggaaagcacaaggataatccacacatttgacaaagttgacagctgatatgcatatcatctttcaaagatcaagcatagattgatagacatcactatgcccattacctgacgacagttataagagtacacaagaaacgatattgattatcccatcacattgcaagacacaacacagaattcttagtagccggagaagcaacagtgcacaagttatagagcagcagcaagctactggtagaagagagagagagagagacacaggaaagcatgcattgccattgacagaaaacatccacaaagcatccgagaaggatggcatcaggatcactagctttggttcatgttgccatcaccagtggtctcttctggtcatgcagcagctgccgcagctcctggtagccgctgcggtagtgctcgagtgagaagcacagttgcctgatcgcctcgcgcttcccctcggcgctctcagagatcacaagcttctgcatctctacctctttctcgagctcgcatacccgagcatgcagttctgacagggacttgcgggcaagatcggcctgtgccattagcttggaatgctcaagctgaagctgattcagttgatcatccatctgcttcatcttttcatcgcgagttgtgatgtcggttagtagagtggttactttgttgtccaccagggatttctcggataacagcaattccagatcggttttgacattggccagttcttgattcagcctggagatttccttctcgctgttgagggattcattagccttttcgtcgtaaacttgtttgagctctgcctccacggatgccaacttggcttcaagagaagcattggcttcagataattttgaaagctcagcactcagagaggacttctccagtgaatggttctgcaatgaatcatggacagcctgctccagctccttaatcctgtcctggagtactgatttctcctgtagtgttccctctatctgggctcccaagttcttgatggtttctggtagctttgcaacctccatgcctgaattctcaaagtcccccaaaagttgctcaaattcaagaacacgttctctgagcacttctttctcctgtgaaaccttttctaattctgcttgtgtatccttcattagttcttgcagattaaccatctcagaaaccgaataatttgagctgttaactgactgctcaagctcttcaacccgagattcgagcatcaatttctcctgtgatatttttgcaaagtcgtcttcaaaggttttgatgactccctggagctttccaatttcagcctcaagagcagatatatcatgcagatacttctccgaaagtacctcaagctcctgtttgcacttatcaatttcagtatcacgatgcgcaagttcaacttcaaactgcttggctgccgataccattgattccttcagcctatcaatttcatctttgttcaccaatacaacagcttccaatgcttccttttcacttttgacttcatcaagatccttctgaaggctactggtttccacatctgaaacctgttgcttttcctcatgttcagacagttctgagttagcaccaaaattacaatggcaacgcatgttcttttcctcggaagcatcaagtttaccccttacttcatgaagctcatcctcaagctcaataattttttgacttagggcataaaaaatgctattgccattttcttctttagcctcatcaagctctaaatcagattctgaagatgatgaagacccatcactccccttcttggatacgtcagaactcataccagagccaatagaaacatcaaagcaatctgatcgcggtttttgcttttgtgacatcttctcttgcaagtcacgctctggtgatgaaggagactgtgcctcagaatctgattctgagatgccaaaggagacagatgattgcagagatgatgggatatttttgcgcaattctccagtcacattgccatatcgcttggcaagaacacgatacatctgctgaaagttctgtacgtgagtaataagaaccccagccttttctgcagagggttctccttcctcaataagctccagcgtttcttttatctgtgtctccatcactgttcatttaaaagaataattatgttcagggaataaataactagcatactagttaaattggagactaatattgaaaccatcatgaccaagatcttacaaatctcatggctagcaaacgaagtatgttcttattccagcatgtaagacaagaaaaagattatggtctcattccttaccttctaagttatcggagagccacttagaactttttggactaatatggctatcccaccaccatgagctggatttccttgattgcgtcttttgcattttctccattttgataagataatgaaaacaattccctcaagggtgaagacctgactgcatttccaagaacaagtgagaaaatgagaaaaatgcacatacactagtaatacacttgagaataagaaagaaacagcaggaacattatctgtagtacaaacttaaagcagacttcagtgacccaaaatttcaagttaatcattgattcatctcaacattcatggaaaatgtaatctagtactacctccttttttaatatatgacgtcgttgatttttttgacaaacatttgactattcgtgttattcaaaagtgttgtgcaaatataaaaatatttgagtcatacttaaataacatttgatgataaatcaagtcacattaaaataaatgataattaaataaattatttaaataagacgaatgaacaaacgtatctaaaaaaaataaacggtgtcatatattaaaaaacaaagagagtacagaaagggcaatagtcagtagtaaatgatcttgaaacttgaaagccagaaatgtaaactgctaataaaacaatgttcttatattcagctcccattaagcgacttgctcatacaaaggggaaaacaaaattatccaatggtctaagacaacagaagagtaggtcttgcacactttgtaaaatagaatgctaaattctatcaaagaaggccaacatataacttactaatgaagatgtccaatatgcaaaattagacaaatcagatgcagaaacgcagggaccagaccattgacagctatggaggaggcaaaagtatcatatcatccatgatcttatcagtttcactgtcggaaagcccataataacatgtactagcgaacgatagtgatgtttcttcttttagaaatagaaagaacatactacttcgagaatatcactatattagaaattgaataatatataagaaacgtctttcaaactgaccaataatagatttatagtaaagtaaattgccagtgtactgtacgactattttctgaaaaaaaaatacattttacataaggagtgtaaaaataacacagcatccgtaacaaacaaatcatgtgcttctataacccagtcttctcaagtcaatatagataagaaaatataaggtttgtatttgcatactccaaaaactggaggagtcaaagttggtcaaatcttgcaactacaaaatcgtcaaaaacttatttgcacaataaaattggctggcacttggttatctatcacatatcacacgtccaactgcaaaagacacagcaactacaggcctgttgctgatatgtaggtcaggcaacaggataactccctccagacaagaagaatgggcaacacaaattctgccccacatcgatcaaaactctgtgcttcaagcaagatgtcacaagcttgcaaccaaaaaaatgttcttgtcgatgtctatccaccaaagaagtgataaacaggaccggccagttctatattattgaaggccggggatccacaacacatgcattgatcagtgcttacacctagatagacgcatcacgaggtgacgagtgatgaaaagtgtcaccaccctattatctgccaactttattgggacaacaattgattaaatggtctacggcggaagagaaaatcttgatcaaacatatattgctcatttgcacttcaggttcagagattcctaagtctcaacatacatataaacccatatacgtgatacgaatactgaattgcttgctcttttcttttccattttttaatccaagaacaaataaatctatctgctctaaacaagccgaaaaaataaacattgaattcaagaaactgagatcacattcattactaggtgacatgcgtaataagaacaacagatgaatgaatcgatgccattcaaatcatataaattatacagaaaaatggttgaaaagagtcaactagtaactttttactggatttatacgcacaacatagcatcaatctctgtacgacccccaatcgcaggtctccctaaagaataaagtttttttaaaaaaaaaagaaaagaaagaaagagtcactgcaacacaagcacaaaccgccactcattctcctcgcgaatcatagatcgaacacccaacaggcaacaacagacgaccgcaagaagcacgaactcgcggccggggacgagaaaaaaaatcttggcgaaacgggacgagaaacccgcagatcaggtacagtaacacacaacccatcatccccgctcccaacaatcaaaaaggtaagtagcagtagactagtagactatagcagcaggcaccaagaaccaaaccggagatcacacacgcacacacgaagaaagaaaaaaaaagaaaaagaaaaagagagagagagagagagatcattaccccgacgtggagagagatcaatcagagcagcatatcccgcgtggcttgtggaatctggagagatggagaagaggaggaggaggaggaagaggagagatcgatttcgatccggggaggagcagcaggaggcaggcaggcaggcaggaatggaggctgggggctcacacgagcagaggcggagcagcagtggagcagaggaggagagagccagttacgaaaaaggagcagcacaaaaacccaaaacccatcaaagcgtcggtttcttctactgcctcgccctctaattttaaatatagctacgagattttacgtttaatgtttaatagtccatcttatttaaaaaaatttaaaaaaaactcatatttcttctgttctataaaaaatcaataaatctgaatatacctctgtctaaattattcattatagtaaaatatgtactccctccgtcccacagtataagggattttgagtttttgcttgtaacgtttgaccacttgttttattcaaattttttttgtaaatataaaaaataaaaagttgtgcttaaaatactgtggataataaagcaaatcacaaataaaataaataataatttcaaaaaaaatgaatgaaacgagtggtcgaacgttgcaagtaaaaactctaaatctcttatattatgggacgaagggagtaacatctaatactatattctctttttatataaaaaaatacataaagtactccctccgtttcaaaatgtttgcggcctagggctacaccacgcttggacaggcccaaaccaccacatgcactaatcatgtccgatagggagagactaatctcggtgaatctggttgaccgcccataactgcgggcgcggctatttaaatagttttactctgatcagaggggtttaactgtacccacaatacacaaccccacgacacattcctgtgcacccggatgccaccacgatataccggaaagaggtcgtgacagcacccttacgataagcccctccaaccaaacacaccaaaccttacgtttcacccccactcctacgcaggaagcgggccatcccctcttctgcttaggtgaatccggaagctaccaatgccgttgtagggccattcccgcttcatcacgcccacccttgcattgatgcctcagctagaggaaagttatccttcaagccaagccggttgccaatgctggctttatggaaggacggaggaatctttcaaaggtttcccgcgaaccgacctttaattgccaatgggtgcgaaccatcacaaccattccaccaccg

SEQ ID NO: 4149 - DNA, 9838 bp, Oryza sativa
  unsure (1)..(9838): unsure at all n locations
agcgccatgaattgcaatcnatnnnnnnnnnnnnnnnnnnnnnnnnnnnnnnnnnnnnnnnnnnnnnnnnnnnnnnnnnaaatttgtgaaatatgtaaaactatatgtgtacatgaaagtttatttaacaatgaatcaaatgatatgaaaagaataaataattacttaaattttttgaataagacgaatggtcaaacacgtactaaaaagtcaacggtgtcaaacattttgaaacggagggagtactatttatgttttatcattttttttatttatgttttatataaaaggattttaagtaaaacgaacgattaaatgttggacatagagatctataactgtatttaaaatgagatagagggagtatcactggtcgtctcgttaattgattttttttatttacagagatggccccctagtcgtggttgggattcgagacgacaattctctcgcggcttgggatttcgaaacatttttggaacggctggtgctgagctggacacgcccgtttattaagcgcactgtgagtgccaggtgggattaacgctgggtgattaaggtctaattaattgatttaagcacagggtttagtgatggctggtggtggggcccggatggccgtggcgcgtgcggcgtgtttcctggggcgccggtaggccggagtggggggcgaaacggccgtgcgttgcggcgtaggccggcagccggtcattggatccctcatttttcgaagtctccaattggataatgccatccaagtagtagcacacaactaggagaggcatctggttttaaatttgaaacttcatttttttttctttggttccaaatgctttccaatttaaaacttcaatttttgttcccaggtgtatgtttttataagatagcatatatatatcgaattccagaaattaaaacctttgagctccacgtttgaaaatcagaaagattttctgtcatttttcggaacgtttccaaaaaaacgaatccgaatttgcagcaaaacaaaactgcaaaaggaggctgcatctgccagaggaaccaattttggtggaccattcgacgcgtacgtcgtgcacacgcgccgcctgccctgccctgcgaggcgagcgagcgtgttccccttcttctctccaccacacatgcttcaagtagctagaagggcatcctcccttttaaggaggtctccctctcctagaataagcaagatggtactaaactacacatgcatgccataccataaggtgggcttttgtgattttctaaagaattaatcttcgagtgggctaaggcccattcactccgaggtccgaacgtcgaggtccgttcgtcaggaaaaaactgaaattcatgggaattttatgacaaatagttcggttctagtagaaggaatcattaaagagtcactttcaaaacccactcatttattggcacaacttcatagctcaaaatacaaccatatcactgtcttttaaaactactctagtacattactcttatgttacagctctgaacacatcacaacttcttagttcacagattgcatatgtgtgtggccagacacatgggcaaaattcagaaagaaaaagaaacatggtttgaacagagacaccaaaactatacactagaagctgcaagggagcacacggacacaaacttggccggacagacatgccaaattcgtttcagttctagccgttgcgctataataaggttcagctgccatcagcaagtgcctgaaccttcttttcgagctcaggtttgttggcgcccacaagcttgtcgacctgcttctcgttttttatgaagaaaaaggtcggcgttgcgcggatatcccatgatgagctgaaatcctgcagagaatacaagagagttgttaaatcggaagaacattacaacatgcaccctgacctatagatatgctaagtgagaagctactctaatgtcaggacttcagttaactttaggacaatttgcatgcaatcactacatctgtttacttaattctagaagtgttgagaagctctttataatgctataatgctaacagtgcaggcgcaacatgtgtttagcctttatatgataatttccaatatataagaagctttaccaaaaaaatacagagacaccaaacaaacttattttttttcaaagttctcatggtatgtcgacagcaattactccataagtaggatgataggtcatgctttgggtatgatatccctcagcaaataattcaacacatctggaactcagtacacaatctattcttgattataaaccttaatcgatggcatttagtgaggatgcacaatcagttatacaggattacagataaatgatactattgataaaatgaccgccatcagatgtataaggggtttcttggttcatacaaaactgaaattaatcatttttcaatagcaaatttgaccaaacaaacggttagaattaccattaggtcatcaacatctattgtcaagaacatgagttgaggataagtctttgacatctcagcataaataggtgcaataacacgacatggtccacaccaggaagcactgaaatttgccacaacctacaaaacaaaacagtgagtacgtcaaaggtactagtttgcatcaagaattttcataactttatcttgttacgagatttcagccaacaacagaatggccatctaaagtggatgagtcgtaaatgttgtgtgtgtattgccaaaaaacaagcaggcatcctaaaaataagcaaaacaaatcctgaggaaaaaaaaaaggaaataccaagtggatgagcatgcaagtgctattcagaataactgggagtatggcataatgttgtttaacttgttttggatgagaaataaaaccaacataaaacagacctaagtaatttacaaatgaggtttgaatcttttagaaacaaactagaacaatggaaaaagcagttctacacgtcagcataactagaaatgatttattccacacaaggatcttgcattgactaaaggcagaaagctatataaatcagggaatactaagaaatggcaactttttgcacagggtactagctagaatatctgaatgcagttttcatgaattatttctgactttataactggaatatctgatttttttttcactctcatgcagatttcagtctgttctcaatcccattagataattacacttctttttttttaaaaaaaaaaagaaaggaaaggaaaggaccatgtgataagtagtgcatagatatcaacttcgtaaagttgtatagtgtgaagcaaactgatagatcaccaaccaatgcacaacataagaaccaaaagatgtatttgtaatccattgagcaaattgctagcttgcttacaattttcccatccttgtttgcttcttcaatcttcctatcccagtcctctttgcttgttatgacatgaacatttccacctttgaaatcaagcttgtcttcctcaatatgtcgtcgtccctgaacaaatgaacataaataaaagaaacatcacaaatcaatatatgtggtaaattgaacagccatgatgaaccgctaaatatcaattatggttttggaagactcaccttgcccacacaacctcccattgtgaacttgagccaacaaagctagcacagcactgagcaaaatgtcctctaaacaatgataaaagcatgtcatggtctatcagaaaaagagcaactaaaactacgaaagcactgcaagaaaactaaaatctaggaaggcatggttgaagtctgagttaggcataacaatagatcataagcgataatggacaccaaatgcataggacaagatatcatatattcaagtgaacaaactcgcagacattctagcataggatgatcctatcagaataaagactaggaaggcaaatcatccctattgataattcaccgaaaaaaagaaaggacagataccgaattctgcctctcttaagagcacgaggaatgcccagaactgctctattatctctgctagtaattcttgttccacaaactatcaccgatacgataattcactaagacaaagcataatgacagtactacttctcccaactaccacaatttaaggatcgaaatcccaacgccatggaacccaatggaatggaaggcaaagtagggtacacatgaagaaccatatctccccattcccccaacccccaagaacagtagaacaccccctcccatgaacgtcgcaaaccaagaaagcacgccgaatcgacagccgaagcagaagaaggccacggatcaggaggaatctaccttgggctcacagagcgagcgagcgagcgagcgggcggggcgtggatcgattccgacgcccgcacgagagggggaggaggagacgaaacaatcgaaccccggatctccccgcggtcgaagagagagagaggatttgattaaacgcagcaaaaaatcccaccaaatgagggtttgatccgccgccgccgccgcgttttggaaagtagagttgatttgtgcgggggcagtggagaagaagatgaggaggaggaggagacggttcgtggaattctccgctcggctcgtgcgtttctggagacgacgacggcgacgcggagacgcagccgcggccgcgtgtggctcgaccagacccgaccccgcttcggtcggagcggaccactcgcggttggacgaccggctcctccgcctccagaaattgttttttttttcttttttggcgcgtgtgcacagcggaatttgtggagtgcgcgcgcctctacgccaaagtatcgcgacttcgcgagattggccacgaatccacgagggcagtgacgcacacatccacatccaatccaatatagtgagaccaaaatacctgatgactatacaccgttgattatacctgtaacagttttcttgcgtaaaaattcttcttttcgtgtttttatacgccgggcgaccggcgcgggcgagtcggatcaggtgctcccctccctgacgcgtagccgcaccatatactccattgcaataaatcacccacatattttgaaaaccctctattaaaggaatttggtttattttttttgttccacaaaaaaatatcatctagtgcactcacaatgttttactatgtatagatctaatgttgcagtgaactgaaatattccattgcaacaaatcacccatatattttgaaaaccctctattaagggaattcgttttatttttttgttccacaaaaaatgtttcacctagtgtactcacaatgtttcactatgtacatatctaatgttgcagtgaactgaaacattctttctctgtttgctgaaacattgttttaatataaggtgaaacaacacccgatttaaacgaatgaaacattttcaatctacttagtgaaacaattccgatatacctggtgaaacatcatgtaacatttaaaaataattcaatgataagctaaaatttttcagtcggaatatatctatgtgtggtcttgttttgaagatttaattgcaacgaatttaatggtgcaatcggatcatgatttggataagtaatttaagagaaaaaacagtttaaaatagttttgcacgtgagtcgagcgctgacgttatgctgatatcagcgtccgattttaacctcctaccattgaacgcccgaaccagagagtccctttaagtcagaaccttctattcccatcgagatgtcaacattttttgctacgaaataagtgtacaaaccgaagctatgctgcacttaattttgttcattaacattactctccttttatttttttcaaaacttgttccggattcgtctgagattttgagtaacttaatccaatacatcctccggtctaaggccatgtttagatctaggagtgtaaatttttaatcacatcgggtattatgtaggatgtcgtatagggtgttcaggcactaataaaaaactaattaaagaatccatcagtaaacagcgagacaaatttattaagcctaattaatccataattagcaaatgtttactatagcaccatattgtcaaatcatggagcaattaagcttaaaatattcgtcttgtaaattaggactggtttagttcccaactttttattcaaacttccaacttttccatcacatcaaaactttcatacacatataaacttccaacttttctgtcacatcgttccaatttcaatcaaactttcaattttagcgtgaactaaacacactcttagtcgcaatctgtgcaattagttttttagatatatttaatacttcatgcaggtgttcaaacgttcgatgtgacagggtgtaaaatttctgtgtgggaactaaacagggcctagctactagaaggagctcctctgacttcatgtgccattgataggtggggcccactcgcatacaactctctaactttaactaactttataaaaataaattaacacctactataccaaataaatacactaacaaaaagagaaactaatttgatgtggtatgtgttagtttatttttcatcaaaatttaggccccgtttgattcagcttaggattattataatctggattattacgagtaagctgaaacaaacagatagcttattatgatagattattataatctataagtcagataactataatctggtaagctattctaaaggtgctttttttagattattgggtagctaacaactaacaaacagataataatctagagaaataaactagtagcttattatatgtcggtttattataatccagcttatagtaatctagttatataatctagattataataatcttaaactgaaacaaacagggccttagagagctttgacttaaaagacaactaaaacacttcgatgatcgaaaccttgaattaaatatatatgttctaaacagacatatattagaaggtatataatgcacattaataaataaataaaacttgaataacccatatatatatttttaaaaaattaacatattactgtcaactgatgacttggctgtattagaaggtatgagttgggaaccataccctgatattcaaaatgataggatgaatcagcgtataattaattaaatattatattaaaaaactctaaaaatgatcatatagatttttaaagtaatttatctataaaatattttaaaacacaccgaaatgtaggcacgaaaaaacagaaatgagttggaaacatgagaacacacccgagtggactctgaccagcaatatccactcccataaaaaacgaaaagaaaaaaaaataatgacaggaagaggtggcccaattgcaatgggcttccatgggctcctcaagcccaacacgcaatcaccaccatcggtcacgcgtgacgcaaaccccacagcccccctcccctctatataagcctctgcgccgcgctcctccgaaccctagccgcacatccccgcctcttcccgccgccgtccgccgcgcgcacgccgccgccgccatggggaggagtaagtctaaccatttcctgctctaccgctcgttgtcttgctgtttgttccacggttgcgctggatcggtcgccgcggctccctgatttcaggcgcgttttgggcgtttggtttagatccatagtagctgggcgctgctggattgttgctgttcccggtgttgatctgtgttttgctttgatgaatttaggtgtagatagattttgtagttgtttcgttgcatatctcgttagtttgcttactcaacctgaaggagtcatgttggacttaataggatgtgaatattgttgggggaactgtaccgatctttgattttcacagataatggtagtatgatatgattagtggttctctgtgaatctaaatgatttattctgatgtagctagcagatgtagatgcatttatcctagctagaaatggcttgtttgtggtggttttgttgtttgaagcgaatccctgtaatggatttagttacttcatggctatttctatatccactattttcttgttcatcgatcaattatgattatttagattaatgtaatggatttagtttctttcatgactttgtatattcactatttgcgtgttcatcgatcagttatgaatagtattcagattaacagtgatggggctgtaggtgctttagggtgtttctgagtaactaacttgactttgtggcttgctttggttaggacctgcaaggtgctatcgccagatcaagaacaagccgtaccccaagtcaaggtactgccgtggtgtccctgaccccaagatcaggatctacgatgtcgggatgaagaagaagggtgtggatgagttctcccactgtgtgcatctcgtctcttgggagaaggagaatgtcaccagtgaggctcttgaggctgcgcgtatcgcgtgcaacaagtacatgaccaagtctgcaggaaaggatgccttccacctcagggttcgggttcacccgttccatgtgctccgtatcaacaagatgctttcgtgtgccggggcagataggctccagactggaatgaggggtgcttttgggaagccacagggaacctgtgctagggtggatattggccaggtcctcctttctgtgcggtgcaagcccaacaatgctgtccatgccagcgaagccctccgtcgtgccaagttcaagttccctggtcgccaaaagatcattgagagtagaaagtggtaagtatcaaacagggtgatgcatacgagtacatctaaatttctgatgtgctctgagtaccataagctcatgttccgttcctaacttgcactttcttgttcaggggtttcaccaagttcagccgcgatgaatacgtcaggcttaagagcgagggtagaatcatgcctgatggtgtcaatgctaaggtaaacacgctgtttctaaactaatgcttatcttgggtcctatcaggatgagtaacttattttgttaaaatcctttttcgctttgcttttatgacctgtcaattgctattgtaattgttctcgtatgcatcgttgcggataatctaatctttgtcaatactgtctctatggtgcagctacttggttgccatggtcgcctctctgctcgtgcccccgggaaggccttcctctcagccgcttagatatatctatccttatcatctgtgggaaacgaaatatcggacctttttgtttgtttgtagactcgatcatatatcactttgttgaaccctgaatcaccaagtgtctggtgctatattgcctggtctgaagctatcttgtgttgaacatctttatctgaaatatatatcagatgactttcgtgtcgctaatccgttgctgcttatttcatctatgcatacatactcttaaatatcggatgcatcgtgtatatctgatcagcaatgttcatcttcccgtttttcattctacttacttattcagaagccatgtactcctgtaattaacctgccgaattgtttgtgtgctattgtttcgcctatccttacgcgtataaaccaaaatttaaattttaaatctgattttgtgaatttttacagcatttagttttgaattattaagaatatgtatataaaagatttatctacaaattgtttgtttctgctaacaagtggtacggaaccaggtaaacatacttggtttcaacgcaaaaaaaaagaactacggtcacgaccaaggtttataatccagatagtagatcaaaattcactcatgaaaatcatgaaatccattgattaaccgataaaattcaatgaaatctgcataannnnnnnnnnnnnnnnnnnnnnnnnnnnnnnnnnnnnnnnnnnnnnnnnnnnnnttctagctgntgtacccaaggcgcg

SEQ ID NO: 4150 - DNA, 1826 bp, Oryza sativa
  unsure (1)..(1826): unsure at all n locations
tgtgagtgagaccacnnnnnnnnnnnnnnnnnnnnnnnnnnnnnnnnnnnnnnnnnnnnnnnnnnnnnnnnnnnnnnnnnctggataggggttttaatgcacattctgcttgaaattctattcgggaatttctaggcgtgacattgcgcgtgctgtgcaccgacaacggcggtaaattcacggcggctgaattctcgtcatactacgctgatgagggcattcagcgccactactgtgcgccgtacagcatacagcagaacggagtcgtcgagcagcgcaaccagacggttgtggggatggctcgggctctcctcaagcagagggggatgccggccatcttctggggggaggcggtggtgacagctgtctacatcctcaaccgctcgcctaccaaggccctcgacggtaggacatcgtacgaggcttggcatgggcgcaagctggcggtcccccacctacgggtcttcgactgcctcgcgttcgccaaggagctcggctacattggcaagctcaatgacaggaacaccctaggggtgttcatcggttacgcggagggctcgaaggcctaccgcattcttgacctagagacacagcatgtgcgcacggcgcgcgacgtagtgttcgacgaagggtgagggtgggcatgagacaaggcggtggacgacagctattcgacgtacgacgacttcactgtcgagtacgtgcacttcgagggagctgggggagtaggcagctcctcttcatcgagggtgcctaccccagtccccaagcctccaccgaccccagtagcgacacactctcgagctacgacttcggcaacaacgagttcttcaccgacaccaccacagtcggtgaccccacgcacttcagagccaacagccacctcgatctccggacacctccactctgacgcatctaagggcttttctaagagcaggtacaatagcaggctataagccagctataaacatattttaaagagataaatgaagagagagaagagcagcaggctacatatctgtagccagctgcaacacagacttcaagacgtaatgtgtgtatgacaggtgggaccaggtattaatagtataacaagcaactattatataaattggttattacattggctatagatgatttggagttagtagagcaggtacaatagtaggctataagccagctgcaaacataatttgaggagataaataaggagagagaaaagcagtgggtacagatttgtagccagctgtagcatagactccaagacgcagtgtgtgtatgacaggtgggaccaggtattaatagtgtagtatgtaactattgtatggataaactattagattggctatagataaattcaagctagtagttagagcatgtacaataacaggctataagctggctgcaaccatattttaagaagttaaacagggagagagaagagcagcgggctacagatttgtagccagttgtagcacggactccaagacacagtgtgagtatgataggtgggaccaggtattaatagagtagtatataactattgtatgaatgagctattagattggctatagatgaattggagctggtagttggctttactattaaacttgctcttagctatactactccctcagtccatagtataagggattttgagtttttaactggcaacggttgaccactcgtcttatttaaaaatttttcgcaaaatttaaaaacgaaaaggtatgcttaaagtactgtagattataaaaggagcaacacatataattaattagtattcaaaaaagaaattgattagacaagtgtgcaaaccttttaat

SEQ ID NO: 4151 - DNA, 2678 bp, Oryza sativa
  unsure (1)..(2678): unsure at all n locations
gactgtcaagattacgaaatgtatattgtatgtcctatnncttcctcctaccacgacatttattatatttttcaattagtttccttcttacttattcaaacacacctacccacccgcgggttaggtgcaactctctatatacggcgaanaccagctcggcacccaattgaataagacaagtggccaaacgttgtaagtaaaaacttaaaatcccttatattatgggtcatagggagtattaaacttgctcgtagtggtctgaactattgaccttgctgtaaagaaattgtacggacgtgcgtggcaatccatgcatgccctgaccgcccgtgaccagttgcatagaccgtacacgagaggacagtaaatactgtagtactatgaccgttgatacagcttgctgccagtctctcgggtccaatcgaagagctctgtaccaataaagacaacgtgggagctattccgaggagaaaaaaaaacagtgatatgatcgttggtacagcttgatactggagtaccagtctgtggtcaaattgaggagctctctaagagcagctataggctataagccagctgcaaacatattttaagtaggtaaataagaagagagaagggcagcgggctataaatttatagccagctgcagcacggactccaagacacagtgtgtatgacaggtgggaccaggtattaatagtgtagtatataactattatatgaatgagctattagattggctataaatgaattggagctagtagttggctatactattgaacttgctctgatactcccttcattttataaataattcgttttataatataagatattttgatattttccttctactgtttcaccactcatcttatttaaaaagtttatacaaatataaaaaatgacaaattgtgcttaaagtgctttcgataataaagtaaataaaaaaatataaataataattttaaatttttttaataagataattggtcaaactgtgcaaacaaaatattaaaattttttatattagaaaacagagggagtaatgaaaacaacgtggcacagctattccgaggagaatttttttttcaaaaaacagagtagtactagtactacttaccagtacaccggtttgattataatattccttgctccagtccaaaagcgaacggtctccgagtatctcctccctccgttccataataaatgcagttttacactattcatattcaacgtttgaccgttcgtcttatttgaaattttttaatgattagtatttttattgctattagatgataaaatataaatagtattttatgtgtgactaaatattttcaaaatttttacaaatttttcaaataagacggacggtcaaacgttgggcacagatatctacggctgcacttattttgggacggaggtagtaattaaggtgtgtttagattcaaaatttggatccaaacttcagtccttttccaacacatcaacatgtcatatacacacaacttttcagtcacatcatctccaatttcaaccaaaatccaaactttggatccgactaaacacagcctaactttggttagtctatataagcagcggcagcagcctaagaatggagggctataagaagtctgaatgccgatgtggatgagagaggagaggagagagatgagaagcgggctgtaagtttacagctggcttaggcacaagaatcaagaaaatctatgagacaaacaggtggaccatatatttatagtgaaaagttaactattatatgagtaagctgatagatagactacgagtaagcagcttgctgtattattatccttgctgtaattaagatagaacaactgcagctagcgcttgtgtctgaaactctgaatatacctacagaaattgaaaacacccgaaataaagagaagagccctttgattataccacagaataccctcaacaaaagaaagtttcacaagaggtctaacctcttgtttatttttctatggaattgatcatatgaatgcaatcctatggaagttttcctatcatcttcctatgaattaaagggctctatagaaaaaattcttaggaaaataaatcctctaaaatttctttgctaatcctccatttcaaagcggcccgtacagccaactccacaccgcgttctgcagccacgtccgccggcatgagcaatagaacaaggatggtacctttctaaaccatgtacctttattacagtctctcgaatcaacatgcgctacagcctaattaatccataatctaaaccgggtcttagggaaacagtgatatgaccgttgatacagcttgctgccagtttctctggtccaatcgaggagctctataccaataaagacaacgtggcaactatttcaaggagcaaaaaaattttcaaaaaacagagaaaaagccctcactgggaccatggagtactactccctccgtcccataatataagggattttgagtttttgcttgcaacgtttgaccactcgtcttattcaatttttttttgtaaatataaaaaacgaaaagttgtacttaaagtactgtagataataaagtaagtcacatataaaataaataataatttcaaaaaatttttaataagacgagtgggtgccgagctgtgttcgctcgttagtgaggagtcgatccaatcacgg

SEQ ID NO: 4152 - DNA, 13488 bp, Oryza sativa
  unsure (1)..(13488): unsure at all n locations
gatggcccccccgtgtggacccacccttcgttttggaaggaaggaaccaacttagcagaagtgtggagcactcatttcccgtgagccccaagatggccttctacacataaaatacgggccggaaaagggcaggagattttaagtccataaacggggggcgcccaagagcggaggcccaaaagagctcgtccacccttcgtatagatgggtggggccatggtnanngngnnnnccnnnnnctcccttatattatgggacggagggagtacttctttagggaaacagtgatatgaccgttgatatactagcttgctgccagtttcttgtccaatcgaggagctctgtaccaataaagacaacgtggcagctattccgaggagaaaaaaatttcagaaaacagagaaaaaggtaatggtaggagggttattgattaatgatatagcaaagaatcatagtagtacttaccagtacaccggtttgattaatattccttgctccagtccaaagagaacggtctccaagcatctaattaactttggttagtctatataagcagcggcagcagcctgattaagatagaacaactgcagctagcgcttctatctgaaactctgaatatacacggatatttagggagtagaggagtgcagcaagcgcgcacgggcagaccatggatcagccgcatgaaccagccggcagcgagcctagcgaaaatgttcaggttctgtttgcaatctagtagtatcattttttctgcttgattggtctaaatgttaagaagattccctcaaaaaaaatgttgacaagaatttttttttgtttcgagaatgtgcggaagttttagtctttgtcagcagtgatagtttaaaaattatgatgtcgtcaccaatggtcgatatagatggcttgtttttgttggtagtgccctcttttaaactcaattacctgtatataattagaaattgtgatatcttcctacctacagctcttcaagggctgccgtgagaaaaaaaaaacttgtttgagattgtgttcagtttgaagtagtataaaaatgaattaaagaataaatttcactaaactagtactttgataaaattaacacaaaactacatatttaaaccatagtatcatacaactacagatatagaaataattttatcataaagctttacatttaaatcattgtatctcaaagcatagatttagtatcgtctttttcaaaacaaattttagatgtgctatccctacacctcttaccattgtaaaattttaaaatgtgtagttttgcgtaaaaaaaaaaacgatgatccatctgtagttttgtgaaggaaaaaacatgacactcaatttctaaagtatgttattttctaattaagatgctgattttacctcggttttcgttagcacgtttttcaaattgctaaacgatatacttcgtgcgaaactttctatataaaagttgctttaaaatattaaatatatttgttttttaaatttataataattaaaactcgattaatcaagcgttaaatgctttctcgattggcgtaccctaactttatcttcatcttaatctatctcaaatactaaatttgtagtcttgtgatactatgacttaaataattaagtactatatataccaaatttcatgtttttttaaatataattctctcaaacattccttggtttggtgcgaagaacatcgaggaagacaatgagtacctgaacaacaagcgcgggtggctgatggcggtggccacgctgttcgtgggcatggcattccaggcggcgatacagttgcctgcctggttccccgatgactggcctcaggcgtttagctcccacaacatgaagcatagcggtataatattccgagccacggtcgcctctgctccttccccgataagtcctcaacaacacgccgccaccaccctcaccgagggccaaatgagggggatacggtggtatatcatgttcaacacggtgaccttcacgattgccctggcgcttctgatcacgctggtggcggtagggaggtccttggctagtcattccatgagactcatgaatgccatattgttcacggtgatcattagcaccagttgcacctttgtcttggccatctcgagtgattggactgtcatcaggtggatgttacctgtgcttttggtccttggctcctataccctctttatcagcttagtatggcccaagatcatcgagtatcggaaggaaaagaaaagacagcgagaggctcaatcgaacacagcatcgccgccaccttaatttattttcaatgttcaggatctcttaatatcctaggtagtgttagtgttacaaactcatcactatcaaggtttatccctttgagaactgatgtacgtaacatgggatggtactagcccggagatcgagccttcagccttggatatgaatttgatcaagatgtgttgtcttacaaataacaggaaattcgcatggatgtgcatgatgcaaatgtagtgaatttatacttgatttgaacgtttgatgtcggcgatggttttgacagtgtttgagagagcactgacagtattctaccagaggtcaccggtcagaccaagagcatgtactacagagtttctgtgaattggagtattggaccaatcatgcaacaactttgtaaccgagaaacagggattgaggccatgggccattgcgttggatgatgattcaggagcctacagattggctctagactccacctctctctgaatccgccgccggtcgatgatatgcaaaccttggatgattgaatacagtttggtacaccttctcattctgccaaactcaaactcaccatgtacttcacctgctctgcgattgtaacttgttctcgacttcatgtgacagtctagctagttcagctagatatgatattgcagttttggcaaggaataccaaactagtaacagcagaataattataaaataggtgaagatttggtgaagtaggataacaaactcaggtggctgcctgaaaataagcaaaatgtgtttttattgagcacataaaatgggaaacagagctagagaccacattagtcattagtcattgctgcttcctctgattaccttcacccaagtgtttgtttaggtgtttgtaatttgattaggaactcagcctaaccctctactctcaaaccgtccctaaattaacattgactgttgtaggatcgaatcacaagaactaagccaatcagaggggggtgaatggttgatatacccaaaaaccgaaaacttttagcggaaataaaagttaccctcgaaatcgatggagattggtctgaccgaagttaccttgccggtctgaccgctcggatgccgtcggtctgaccggtatagatcaaccggtctgaccgctgaagctgctcgccgcgcttgtcgccgccgccggtctgaccgccgtgctcccgccggtctgacagccgcaatgccgccagtttgaccgccggtgagttgccggttagaccgccgaaacctggtaaacgcaaatcgaagaactcttaaattagatgacaactttattgcttctctttgtgtttacaaagtgcaccaacagcactccttacaaaaatctcaactaaactcgaaaccctaactaaactagcaactcaattactctcaaaagcgatacaaaagcgataccgggaagcctcacgctccccctttatttatatatgaggtaggcagcctaaagccacgaaccaaactcatactaggagtcctaaacaccttaggaaacccactagtacaataaagaaactttacataaccaatcgtactaaatttggactccttccaaattcgactccgcatcccatacgcacacaatacctccatcgtatgccatatagaatctccatcaaccacgtgcatcaactctagccttagtattccgcatgatatctgaccaccacggacatcgtcttaccaccaagccgactcccggtccatcaccgcaaatactctcccgaggcatcgagtcacctacacatgaaacaaacaaagaaaccatattccgagaccaagctatccccaacttaactcattagtagcaaacaacagtattacatacgtatagtatttatctagaagccataaccatgaaacaatcacggatatccaaagaaaacaacccgaaaccgaaaccgacacagcgtcggccggtcagaccgcgggccggccggtctgaccgctcaacacaagccggtctgaccggcaaccaccgcccggtctgaccgatcccgacaaaacagcaaaccctgttcatcacctgaaaatcaattatctccaaaactacttcgacagtaatctccaaatatcaaaaccaataattacagatgccaattgttcatcacagaataagaatcaaaacacactttgatcttacaactgtcaacaataggattgtggtatcgacagaactctgctcaacccttgttgtgtcttttagtttctttctatatgatagcatggcagcatactagctgcacaaacacacgcaaaaaaaaaaacatatttcagaagcatgaccatgtcttgttcggtagactggtatttatcaagaataaatgggcaatgaaccactgtcagcttaaaacaacagcagcgctgcagcagcatagttgtagcacttctcttcatgtaaaccgtccatacaacagttgcataaaacagccctctagaatggaagtaagcaaatgtagacccccgattttagaaatcggaaatcttctgtctttatccgtatcaatccctaaatcagtagttggtacacacatacatagttggatcacaacatatcacgaaagaattcaggctaaaagagttaaatacttacattaggtccaggtaggccaacaactatcagagaacaacagcggaagacaaaataatataaaggcccggttaacttgccacaggcagtcgactagggaacgagacctagaacaagaccgcactccgatcatcttgttggatacgcaagcataccgacaagggcttctcttcaacactctcctaaaagatatataaatagcaagggtgagtaccaaccgtactcagcaaaccaccacaacaacaatacatatgatagagggtatttcaaggaagggctccggttcttttgcgtaaagcaagctttgcaattcttttcacaagcctaagacctagcatagactgattaagttttaataccagtgttcacattaaacaacgacggttctgtccaccatccattgtgatcccaaggatagcttcccgccattgagtcgtcatggttttctgaggacatccaccttccctcctcttaggaagtggctccatcagcataaaaatcatcatgcagtatcccatcccacacaagttaagaattttgagtctagccaagtgtaatacacgtcccggtactcaataaccgcgagcacggctattcgaatagatttagtttactcacactgcagtggatgtacactttacccgcactccgcgactgcccaacacatgagcctcgtcccaacacatgagacgcgtcacggcaaagcttttcgataacctcgccttggcagtacccgctccatgaacttaaatcctcatgcactctagacgtccatgtttctagcagtgagaggagttctggcgctcccgggaaagagaagtctcacactctcattaagttagtttctctctcacacactcatggcagccctaccaatggtgacactgatgtagggcacgcttctcggccctacctcaacggctgtcccaccgtagcgcacctgcctcactcaggggtgaaccatctatgcagggatactgcctccgcacggctatctaatccgctaggtctatacccatacgagaagtgcggttgtatgggggtcgtttcatgcttaacttcatggctcggtccttaattgaccggggacggtactagccttttccagataccacccaaatcctccgtccgccccagtcgaaaacagttgttttcactttattttcctttcacaaatcatgtcatcaatttcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaaacatggttacgaaggaataaggggtaaacaataatcaaggcatggcataatcacaagtaggatgttcatcattgcatgtaattttatttgtaaacaaaataatttcgcaattgggaccaacatgttcaaggaatagtgatgacttgcctgcttaggataatttgatcaaccttcacctcctggaagttgcagacgttgcctcacgactaaccgatacacaaggtctataatacgcgagaaaaaccaatattcaaacaacaagcaaatatgcacaagcaaaagataattgttggggtcgatcctggggttgctcatactattcgtgtttgctaatggatttcaatcatgctagggctaaggcttcttaatctttctattgtcatcgtggtctatttaggagttaaccaacatagcatttatgggatacatatatatttggctaatcggcgatttattctatcaaatggctatggaaggattatggctatatatgcatctatctaaatagcacggttacataccaaaggttctgttgttagatggatttgggatcaagcaattaatcgcagggaaccatttgtattattattttattgatggaggctttgctttaattatgaaaatattttacttgtcacaataaattagaaaaggttaataattatccatgctttgtatgttagagttgtttaggttaatcatattatggttacagattatcccatcacataattttacaatgaataatcctaatttacaattgaactataattatatgagatcaagatttataactagtatttatctaatattcatgtctgtcatatagtccctccaatttaatgtatgcaacaagcaaattaatactataccgtataactataatagaatgtacagtataggtgtgtgcacaatatcttaatactgaatcatttatttgaataattactatttactacgagctacacagtacatgtgattttaagtggatttatgagtgagttaccgtctatacaacttaagggtcgatttccaacctaaacatatactactgtataggaaatgccgttaattaatttcatgcgggtgattttagtcacactagctctgttattatctctcataaacaagttaaagactcatctacgtgtgttcaacttttagtcacaaagtatgaggctaaacattatttatacaatttggacgtcatgagtataattatatattgacatatattaataagtggcactagtatttcctatgctttaattaatttgaaacaatgctcctaattagtttacataggttttacagtgaggaagcatgttaagggcaattatttgacatctactttacagtacaatatcaattttatttattagcacatttttaactattatgcattatcttagtattaattatttaataattataaatgtattttatcaaatagtggattatataccattggaaagcttatgaatttagataaatttaggttcaagtttcactctaatccgagttaaaatgagagagttatgctagtttaaagtttcaaatttgaataaatccgagaaattgtaaaaaggtactgttcctaatccattatttttattcctaaactttatccaaaactccaagtgactgacatgtggggtttaggattgtatttgctttcctaccggattatttttctaaagcaaatcctatgaaccattgacaggtgggcccactctaacctctcttctctattctcttttctctctcactctttctctgttttcctcttctctccctctcacgaccgagcagcacagcgcgactaccagcgacgaaggaaggagggagggcttaccggaccggcggcgacggcggcggggacacggcggtgaggtgcggcgtggcggcggcgaggcgccggggcacggcagcggcggcgtggtggcggaatgtggcgtcggtggtggggaagaaaggggaaaaggggagaagaaggggcaatggcgtggggagggaagggaaaagggagggggtacttatacggctcgggggaggggtggccggctttaaacgacgacgggacggcgcggcggcgcggggctcggggcgatggcgacgcgcggcgatgggacggcgcggagcagcgttgggatggcgagcgcgacggcgactgtgcgcggcgcaggcggggcacgaggcggtgatggcgccggcggttgacgcaatgggcaagccacggcgcggggctcaagggcgacggcgtcgcgatggaacgcggcgcggcgacaggacggcgcgtggtgcggcagaggagtcgacggcgacgggacgacaagtgacgcaacggcgacagcgcgcgccggctcagggcgcgagacagacggcgacggtcaagcggcgcggcagcgacagggcgcggggctcgaaggcgcagaagcgcgacggcgacggctcgcggcgcgcggcgatggcgacgcgacggcgacggcgcgcggcgtggcagcggggacgggacgcgacggcgacggcgcacggcgcggcagcggcgacgggacgtgatggcaacggtggcgcggggcgcgaggcggctaggcgcggtgtggcagaggagtgggaagggctaggggaccacatcgaacacctaggggctaatgaatagtgactttttcctattttgcctatttgattgatttccttttcagatcttgttctataaaccctaattttcacacaaatggagtttacccaatatatgttttaatttagatgaaagtttacccaattttaatattacccatattttattcttatatatatttttctattgtattatttaaatgaggtctaattctaaaattaacctagataattttggaggctttgagggttctaaaattaattaaaatatcctaatgtggccactattattataatagcacattgaatgaacttatttgtataacaatgcattttatgtgggtctattcattctataaatataaattgagactcagtacaacattaatctaattgttcaattaaacactcacatattcttatttatatataaagcttaatttatttatatgaccattattttatatgagtgattttcatgtcatgaggaactcggcgtaatgttctaagtatcaatctatatattctggtgaattacttatttataaacacgatcattatagtggtgatcatcatttcatgtgttcttatatttcatgttagatatgattcaaatgaattagatttgattttactatttctttagctaattgtgacatcaagctatcaatcatggttcgaatatttaatatctgatctgtgatttataatagaaattaatatttgacttgctttcttgtgcactaatatttttagggttaataataaataacatattctcataaattatatctattgcttaaatttagatcttttctttactttctttgtgatcatttacggtttggcaagcaatagcaatcataacaaccagcatgatgtaaaagttttaaaaagtttgaaattttagtgatttttgttatcggaaattttcaggatgttacagcaaacaaatcatctaacatcagagctaggttatctaaccaacatggaattcttctttttttttttttgcggtggtaagaatccattaccattaccagaccttgctagttaaaagaaaaaaatatcatataaataaaagaggagttggggcaggatagagccatggcttgtctgttgaggcaatctatcaccacaattgggttgggttaaaatgccatccacaatcctcctaggccgaagtccaacgcagcatagtaccaaaaagaaaaaaattccattttccttccttcaactataggttgagtttaatttgcttccctcaaccataaaaccggatataagactccctcaactattaaaaccaatgcaaattaactctctcgatggtttttactagggatggcaacggggcgggttcgacatgaacatccccgccttgctcctccgcgggtttccgcgaccccagccccagagggatgaacggggcgaaatcgatcaatgctcatccacggccccgcactgagtcaaatcttccttgaatcaacaaacacaatgagcaatagtaacacaacaaactaggataaacaatacatattttgaaactagggaaagagccagatctaattacaaatacaagctagaaaaccccatctcacaatgaaatcaattgagcaccaaaatatgttcaacacaataaaaaatagaacaccacatcaggggctgcaaagttggctaggggctggatggcggctggtagtgcggtgtctaggcgactcagtgatgaggaggcgaggcggcgccgcgaagagtcggcggccgacaaggaggcacgccgttgagtcaacgaccaacgataaggcatggcggcatgacaaataggaggcaaggcgtcgtggtgaagagtcaaaattggtgtcaaggggatccagcgcagaggagcaactgcggccagccttctagccgcagctgagtggtggcggccacgcctcgccgggtgagggagagggtgaggggatttaggaggttttatatggggaagttagaataggccagaggggcctattctcttgaaatgggatattttaaagaggtagctcccaacacatggccctgtcggatcacccgtgggttacttttaatccctgttcccatctggaatgttacgaggtccctatctcgctcacccgcgggtaagagtactaccccgtcccggctccataggggcgggtcctcggacccaacggggaaattgccacccccagtttttacaacaatttcggatgaggtagatattgacctagtacatagtgttgacttgtcgatctacgtggcatctacctagaaatttttttaaaaaaaactcgttggccgcacctatcaagctccactctccacaacattccccattctatctctgttgtcccagacgccagtggaggaagagctccagcaagtgttggccatggccatccatcagcacctcagattcgatagggagggagcgggcagtgaactgagggacgcgagctatagcgtggcgtggtgtgggtagtcggagcaaggcataggctctagaggctagagggtactctgccgaaccacggcggaggtgagcgagcacactgtaactgaggagcgaggaagcggtggtggcgaactcggctactcgatgagtgagtcacaagcacaagctcaaccatagtggcaaatctggagggagggaggaagaggtaggtgagaggtcgctactatcaaggagaaatctattgtgcggtggggcgccggtggcatcagtgacagcggttgtcgagaagcataggcggctgctgatctagggcccgagcttggtaggtgagatgccgacctagtggtgtcgcaggggcgatgacatgggtgggctcgatgcaggagctcggactcgaggtcgtaaagaggaacaacagtggaacccgcacgagagtggccagcatccgtcatgtcggggctgacctgggacagcatgggggaagacctcggaaggctgtcgagcctcgactttttcccgacatcgagcaccgcctccgattcctcctccacctagcacggccaccatgcacatcgccgaaaagcttcgccttcgtctccgttctgcctctatggtccatgcttgcatcaagagatcacatagagaccgtggaagcaaggcaggtagggaagagagcaccctgacatgtgggtcccacataaatgttgttttagtttctttctaactttggccaatcctccttgaaagataaattgatccgattttaatagttagctgtctttataccgggttttaatcaaactcacctcgcagttaagggaggtaaatgtagttttattttttttttctaactggccaaacctccttgtcacctcatggctatgggaagtaaatgttgttttaatttaaaggtaaactgatctgaaatttagcaacatttaaactatcaaattagtttcattcaatctaacattgaatatattttgataatatatttgttttatgttgaaaataatactatatttttctataaacttggtcaaacataataaatttggattaggaaaagaatcaaacgaattataatataaaacggttaataagaaggtaaaaataatactacgttttttctataaacttggtcaaacataataaatttggattaggaaaaaaatcaaacgacttataatataaaacagttaataagaaggtaaaatggcatttgtgcttaaaaaacagttaataagcatttgtgcttaaaaaaaaaagaggagttggcagcatagggcagttgggtttctctcttgagcaggaagtcacctagatgtcatagtcagcggcacgagggccgtcaaaatggcatttgtgcttaaaaaaacagttaataagcatttgtgctttaaaaaaaagaggagttggcagcatagggcacgagggccgtcaaaatggcatttgtgcttaaaaaaacagttaataagcatttgtgctttaaaaaaaaaaagaggagttagcagcatagacagtagggcttctctcgtgagcgggaagtcacctagacatcataatctaacggcacgagggccgtccagcctagaacgtaactcaattgagaagtcacctagacatcataatctaacggcacgagggccgtccagcctagaacggtaactcaattgagaagtcacctagacattgtaatctaacgacacgagggctatccagcctagaacgtagggacctcaaccagtggcaactcaactcaattgagaccggatgtaacatcatgatagcatcccccggggagagagatatctcctataccctcgatccccacaacaacggccaaacactgccaactcctaccccccacggctggggtgacaagctcgcgccaccgagctcggcgggagcaactcgttcgtctcctcttttatatgggtttaaaccgctgtagattttccgtatggtacaaaacttcgtttctgtctatacgaattgcgtctccgatatggcttaaaggcaggcccggcccgcagcgctgcctcgaacgccatggcggcgaacagcatnnnnnnnnnnnnnnnnnnnnnnnnnnnnnnnnnnnnnnnnnnnnnnnnnnnnnnnnnnnnnnnnnnnnnnnnnncactcacct

SEQ ID NO: 4153 - DNA, 3765 bp, Oryza sativa
  unsure (1)..(3765): unsure at all n locations
aagagggagttgttttatagaagagtttagagaggaaagataaaaagtgaggggagtttatttaaaaagagaaaannntnnannaannnannaanngnncaacgacgtcatctattaaaaaacggaagtagtaattaagaaggaaaacagagtacaaacagatccttgattaaaaaaatagagacacaacttaaggaggcttaaacgtccagctacacaagtctaagaagagagagattaaccgacctggacagaatcggcaggagttcatctgctctacaattctaagttgttcactagaattggcaagtctagagaagcagagtagctgactaatacccagccaccaaactgctaacagcagaataattaagacaagagactctctagtaaagaattagtgaggtttagcgagttgtgaaattaacaagagacccgggagctgcctcgatccgcagctgcgtcagaatattattcaggtagctgaaaattatcaccattgatgttttggttgagcacaaaataaggggcagagatagagatcactatgattattactgcttcctctgactcccttagcctaaagtgtttgattaggaatttctatgccaccaacttttcttggtcctgtgcaccccataaattatattgttgatattaaaaatagacaccatcccaatcccgtcacactctcgtcaacacggtgcaggcagcagcctcctcctaccctcaatggcgggccatggcgttggtcgtgggggatgtgagtgtgacacgctcctcttgtagcgcaaggtggcgaagatcgccgaccagctcacgggtgtgtcagatctgctctccctttgtggggcgaggatgactccttgtcgcactgccactagttgtgccctccgtctttgcgccgaggcctgtacctcttccccaccatcacctgtgttgggcctcctcggcagcctccatgagtggccgccgccaggcggtcccctccacatccgtgatgacctaagcgcacccgtcggccacctccacctctctccaagccatctctggtctgtccgcgagcgtcggctcccccactgccatgggcacctcccagcaagcgccaacctcaggtgcagcaagtctcagcggcgatgacgaagatgacgagctgctagggcttagctttgggctggggccggtgaggtggcgagcgatgggtagagatcgacagcgaccgagatgagtcaaggaagaggagaccaagagaggaagaagcataactgccatgtgtgtgtcacgtaggaccaaaaccgctctagagcgagtcaagggggcaattcgttcggtatgaaaagttgagggtgaaggttgtttgattttgtggtttatgggagtaattcgtactcatacaatagtacataggggtaattcagactttttcctatagcattggatagtgctctttaaggctttttccgtccaagccacatatagtctcgtaaacgaatttgagttccattttttaacagaaaagaacctggacacaaaactcatgtttgaccatcaaacctaacaaaaagtgagaatcgcttgatttcttttcaactaaagaaatagttttcttccatcaactttgtttcaaagaatattttgccacaccccttcctcatttattaacctgaataaccatttgcggagcaaacatctagtttgctcattcaagtttagaatacccaatcattataatcaggtttttttaaaaaaaaattccccaaaggatcgtaaaaaggttaacataaatattggtacgctcctcaacattgaattaacaagagttggattactacctgcagataataatttgcttttccaacaacttagcttttttttttctaaaacctgtcctctacttctttccaatctttatttaggttgatcctctaagacataggttttaatgctttaaacccatttggcacatttagagtttggatcgattgtattgatcaaatccgtggatgatctcgtgagtggaaagggtgcgaaagtaagaatgtaccatgaatttaaaaagaaaagaggagttggacaggataggaccgtcgcttctctcatgatcgattgtagtgatcaaatccgtggatgatctcgtgagtggaaagggtgtgaaaataagaatgtaccatgttttttttaaaaaaaatgaggagttggacaggatagggttgtggcttctctcgtgagtagaaagggagtgacctagacgtttttgttaggcggcgcaagggccgacccgaacacaacgctagagtactcacaaactagttgcaacctaaccacaattgggtagggcttggatgaacatccacaatcctcctgggccaaagtcggatatagaacaagcatccggcacgagacccgggggagaaatatctcctatatacctcgatcccccaacaacggccaaacctgccaactcccgccccctgcagctgggattacaagctcgcaccaccgagctcggcgggagcatctcaatcgcgtcctcttttatactggcctaaaccgatgtagatttcccatatggtacaaaacattgctcttatgcattacgcgtgtaataatatgggctgtggctgaattaaacacaggccggcccgcagtcccagtaaattatcatatccggtcttattatgtttcgtctcatcgtgattttgcagaatcaatgtgtccttgcgtggtttggatacaaagccaatgacccaattttgcatagacgcgtttacaatcttgaaacccagctacaaccatggccggcgtcgcctcccggaaacggcagagcaggattgcacctgacgaacacaacggtgacggcggcgtacacggcgacgacgatgccgacgaacgccatgagccggtagtcgtcggcggagcagagcgcgaacgtcgccgcggcgaacagcgcgacggccgtcatcgtgttaattggtgatcagcctcgccgtgaccctcctcgacgcgcagccgccgccgccatcgcccacggcgagcagcatcagccatgaggatcccggccagagacgtggcgaaagtgcacgtgttgacgatcaggtacagcgagcagagccgcgaaccagtcacgcggcctcggcatccacgccggcggctgcagcgccgcctcgagcgccatggcggcgaacagcgtggccaccaccatccaggcagccatccgcgtatgcacaacaagccgaagccgccccgctgttgccgctaccaccgagcactaccggctttctcactgacaccgccggcgacggcagcggcagcctgacggccgatgttctgaacgacggtgtggccattgagagggacctggatcgtcccgtcgatcaccagcctgatgaactaattaatcgccattgaacatgctcatcaacagtaaattgcaagcacttgagctgagttgattagcctggacagaattggcagagtcgtcggcgacagaatcaatcgatccatcgatctgtgcacaaaaatcaatgatgtgctcgagctcactctctgaatgtggaatcctaaaataaatgtggaatcctaacataattaacgccattgttttgtactctgctcatgcatcttcacctcacctgctctgcaattctaattgtcatcttcaccccacttgctagttgaaggnnnnnnnnnnnnnnnnnnnnnnnnnnnnnnnnnnnnnnnnnnnnnnnnnnnnnnnnnnnnctcgcagngttcgtaactgcacgg

SEQ ID NO: 4154 - DNA, 2700 bp, Oryza sativa
  unsure (1)..(2700): unsure at all n locations
cggccttgaatgcacatgcactccaannnnnnnnnnnnnnnnnnnnnnnnnnnnnnnnnnnnnnnnnnnnnnnnnnnnnnnnnnnnnnnnnatcaatgatgtgctcgagctcactctctgaatgtggaatcctaaaataaatgtggaatcctaacataattaacgccattgttttgtactctgctcatgcatcttcacctcacctgctctgcaattctaattgtcatcttcaccccacttgctagttgaagggaaaagtaaaagaaaaatagcatcataaaaagaaaagaggagagtagcatcattaaaaataaaaataaaaaagaggagaagttggacaggatacgaccgtgggcttctatcgttaaagcaaccaggaggccaccgacgttaaacaacgcagggctctcaaccagccgcaaattgggcctggggtttgatgacacctatagtcctccccctaagtccaaagtcggacaaatagaattagcatctgtgcctcaacaacccaacgagaccagggaggagagatatcttatctataccctcgatcctcccaacatcggccaatcctgccaactcccgccccccacagctggggtgacaagctcgcacaaccaagctcggcgggagcaacacgaccacgtcctcttttatacaggtctccaccgctgtaaattttccatgtggtactaaactccgttattgtgcgttgcgccgcgcgtgtatagtaatatggctgaatcaaatgcatggccggcccagtattatctgctcttattacaatcttgacacccagctacaacaaccatggccgccgccgccgccgcctctccggaacggcagagcaaggttgcacctgacgaacacgacggtgacggcggcgtacacggcgacgacggtgccgacgaacgccatgagccggtagtcgtcggcggcgcagagcgcgaacgtcgccgcggcgaacagcgccacggccgtcatcatgttggcgatcagcctcgcggtgaccctcctcgacgcgcatccgccgccgccgccgccggcgtcgcccacggcgagcagcatcaggagcacggcgagcgacgtggcgaaggtgcaggtgttgacgatcaggtacagcatcgccttcccggcctggtccctcgtgacggcggccgccgccgggtcggcggcgagcagcgccgcgaaccagtcgcgcggcctcggcatccaccccggcggctgcagcgccgcctggaacgccatggcggcgaacagcgtggccaccgccatcagccacccgcgcatgctcaacaagccgtcctgttcttgcagccactcctcgccgccgccaccggctttctcactgacaccgccggctgacgaatcgccggcgacggcggcggcagcctgacggccgatgttctgcgcgacggtgtggccattgagagggacctggatcgtcctgtcgccgatgtcaatcaccagcctgatgttctacaccatgcaattgatgaacatataataagcttattaatccatgaactaatcaccattaaacatactcatcaacagtaaatcgcatgcaattttcatctaagaagagagagatttaacctggacagaattggcagagtcgtcggcgacagattcgatctccacatctcgccgaatccgccgtctatccatcgatgatcgctgaacaaaaatcaacgatgtgctctagctcactctctgaacgtgtaatcctaacgccattgttatgtactctgctcctgcatcttcacgacttcacctgctctgcaattctaagttttcatgtcacagtctcactagagttggcaagagaagctgcctaatactattactaactcagctatcaactactccctccgtcttataatataagagattttaagtttttacctacaccgtttgaccactcgtcttattcaaaaaaaatttagaattattatttatttttttgacttactttattatccaaagtactttaagcataacttttcattttttatatttgcacaaatttttttgaataagatgagtggtcaaacagtgcaagcaaaaactcaaaatcccttatattatgggacgggagtactaattattgttcttcgcaaaatgaattattttttgctttgatgctcttcttattaagcagacgcagcagtcgccatcgacccggtatgatattacaacgtatggcacgagcatctttaagaagagatactaccaaactactaacagctaaatatttaggacaaattagagaagatttggtgaggtgagagagagcaaaaacattcaggtgtctgaatattagaaaagaaaactggtgtttgaacggagcacaaaacagggggctcagaattagagcttcaattatttgacatcttgtctcaattttatccactcagatggtctcacatgtcatcctcataagtatcaattaaagtaattcgacaatgaaaaaagttgttaaattatcaaatttttcggctgagaagaaaggaaaaataacaggggttttccttgtttcctttgcccaagtgtttgcttaatcccttttcatccaaactgtcccaaaataaactgttgctgtcaacaggaatatnnnnnnnnnnnnnnnnnnnnnnnnnnnnnnnnnnnnnnnnnnnnnnnnnnnnnnnnnaaacgagctgacaacgtntcacacag

SEQ ID NO: 4155 - DNA, 1064 bp, Oryza sativa
  unsure (1)..(1064): unsure at all n locations
ccgtgagtgnnnnnnnnnnnnnnnnnnnnnnnnnnnnnnnnnnnnnnnnnnnnnnnnnnnnnnnnnnnnnnnnnnnnnnnnnattgcattgaaaacttgttggaaaagaacccctctttgcacttggtcctaaatatacaaaagctccatcactgggtccaaagtaaacataaacttacagtcacaaacttgaaccttgcagatctctagttctctggatctttggtacaaaagaatgaagtctatctgtggatctatgttcccataggaagttacagtgagaaagatgtggagcatatccagatacaatcatacaatatctgttgtctaagtttcaaggcagatctgctatcttgaaggtaaaatcctcccaagaacccttttactgctagtagatactagatagtaatgttaaataaacccaaaaatgtaactggaatgttcattacaatctgggttggcttccaaccctactatccgcctaccaaattgaatcctgtataatgccgccttctaaaaggaaggtattttcacgcccttgagtactttgagctccacatcggtaccttgagaggctcatcattaaccactccacctccattctcaactttgctcaaagagtctgagatcaaaggagccgaatcgccttctttcgcctgtaatatatggcgttttgaagagctgataagatatgtgggaacaattgaaacgatttcagaactaatggtgaaccatttgcaagcaataaaattcagactggaagctacctgttgtggggagacttcggcgtttttttgctggccctccaatgtgcagaagtatgagtattagaccattccaactactgcaattaggatgccgggtatgtttctccacgtaaatgggtcatgaagccaaacataaccaaaggtcagtactaggcatgttttaagatggcgccagacttggaaagtgcaagagaagtctttcctacccaaggaaaggcttgagtttactgagaccaatattaagcacgatattccaatgaaaactgtatataaaacaaggctaaatataattagttg

SEQ ID NO: 4156 - DNA, 798 bp, Oryza sativa
  unsure (1)..(798): unsure at all n locations
cgcgcggatanaatcgactacccagggcgaanncgccctcggtacccatcaatctctgtacgacccccaatcgcaggtctccctaaagaataaagtttttttaaaaaaaaaagaaaagaaagaaagagtcactgcaacacaagcacaaaccgccactcattctcctcgcgaatcatagatcgaacacccaacaggcaacaacagacgaccgcaagaagcacgaactcgcggccggggacgagaaaaaaaatcttggcgaaacgggacgagaaacccgcagatcaggtacagtaacacacaacccatcatccccgctcccaacaatcaaaaaggtaagtagcagtagactagtagactatagcagcaggcaccaagaaccaaaccggagatcacacacgcacacacgaagaaagaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnan

SEQ ID NO: 4157 - DNA, 3788 bp, Oryza sativa
  unsure (1)..(3788): unsure at all n locations
nttttaaagagcaagcaaggtcacacattccccttgagcatgttgatcccaatttacaaatgttttactgtttgcaaacaaatatgcatgttttgctaattacatggggtcagggttttacctatctgctcgcttgtgccatgtttacttgatatatgttctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggcggcatgtcggcgcacggaaacgtgtcgtggggctgtgtcttgtgggtacagttgtacacctctggccagagtaaaactattcgaatagccgtgcccgcggttatgggcggtcgaccagattcaccgtgattagtctcacacttaataaatcgacccaatacactgtagtccaggtgggttggttgggcctgttcaacgtggtgtagcgttgatcagtggagatttaatgttactctaattactcaacagttttactgttttgcccaataaaatgttttacaaccgcctttatgcaaatagccacaaaccgtccttgtatccccttgcacgtctgcatcgttggtgtggcttgctgagtacggtggttgtactcagccttgctatcattcccctttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaattgtctcctctcgcccttcggcaattctttgtcaaacagtttttcaaaattctcctcccagtctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttcccggagatgacctaaacccaatccttccctgaagagtagtttcgttagcttctagatcgtgtgttgtttgcttgtgtgcaggggtatggtttgcatcattggtggggatgcgaccatactaggttgtttgcttaagcaacttgaacaataaaagtgtactcacaacagatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagccggaatcaggatcagagcgacagtcagtttgttttcaaagaggaagcacccgcaacctcagatagtacgccaccaagtcctcagcaaatcagcacagctaagccaccaccaatcccaggagtaatatatgctacctattgtggttatggttttcaagcgcagtttttgcaaagtgtccaactatccatggaagatgtatgacagggcacctctcagagggttgttccacagtaaggcgtcagcgtcatcacatcaagagctttgttagcgacaccccaactcctcgagttgtgtcagttccaatgcagagtcggttagttcagtttttgcaactcgacaccgaagtcaagatagaagcaggacagtcatgccagtagttagaacttatgggaaagttagtcaagagtcagtgtgttcatgagctaaatgagagtcacttttatgtggaatttcctatcatcaactaagggttaagttccaaatcttgtcggggtgaaagtgcatcgccattgcttcaatttgatggaccgatgaagttttcagttttcaaagtcagggctcttggtaaatcagagaagtgttggctatatttgaaggacaacagttcaattgttcccagtcaggcgaaagtaagactactccctgtaaggggggtaggtctcacagatgagttttggctaacctcgttgccgtttcagttgtaggttcaacccagtgcagcaaattggttcgtaattaaaggagtcagttgcgaaccattagcagagtcaccccaatctcaggtcgacaggttcgattctaatgtacacccggggatcctcaagagttcagctgcaggcatgcagcatcgaggatggttgcagttcagacgaaagacaagtcaagcaggttttcctggaattacttgtcatttgagttgggaccaatccaagcggacatagggtaaatgatttacaaatgccagattccattttcatcctcttatagccagcgtggtgaattctcaggttaccaaaattgccaacctcaacagttcagtccaagataagtaagtttcaggagcatccgcagtcctagtctaggtcagttcatgtagaaccagtcggtccagttttcgcaaagcaaaggaacagaaaggtcgaatccagccagttcaatcgtgcaggtttgatcaaccagtcaatcaatcagtttgaagcagaatgtggtagttcaatgtgcagatcagtcagaccgccgaccagcaccggctttctttctagccatcccagaatctcgggacgagattcctgtaaggggggtagatttgtaacgccccgattttcgttcgggattaaaaatcattaataatacattttctagaaattaaataaaagttaaatcaatttatccaagtgaaatgttgggagaattaaaattttcccttaaaaataatggccgggaatattttgtatattttttgtgccctaatgtactctccggaaatttccgtgaattttcggactcgataaatagttttaatagcacaaagatcattgcattaattaaaataaaagaaaacaattaaatccccttttgttttgggctcggccattctccttcccttccctccttcccttcttttttgcgtgggccgg

SEQ ID NO: 4158 - DNA, 15573 bp, Oryza sativa
  unsure (1)..(15573): unsure at all n locations
ggcttgagaccacctnnnnnnnnnnnnnnnnnnnnnnnnnnnnnnnnnnnnnnnnnnnnnnnnnnnnnnnnnnnnnnaatagccacaaaccgtccttgtgttccccttgcacgtccgcatcgttggtgtggcttgctgagtacggtggttgtactcagccttgctattatttcccccttttcagaagtgtagtgcttctgagctgaagacgaagttagaggaccaaggctcagaccccagttgagttttgcctgtggagtggagctgaagccccgctaggatcgcctttttccgctgctgctgttttcatttcggtgcgaggactaagtgcctcttttgtaagtattttacgctttatttacgtttggaactgtgtattacttgtcgttttgtgtaccctggctggtcctggacagggatttaatacacaaaatagtctggaaatttgggctaaatttctgggcgtgacaaagtggtatcagagccaactcgactgtaggttgagccaaacggtcaaaccctaaagacaagctttctgaaaaccctatttgaaaaatgtctcccctcgcccttcggcttttctttgcgaaacaggttttcaaaattctcctccctgtccctccaattcttatagttggtaaaccgcggagggtaaaccgtcagcttcgtgtctgttcgggagtcaagtcaagcatcaagcttcatcagcaaagacgggaaagtccgttcagagtcgtcgttccgcgaagatcaaggagagttttcccggagtttacctaaacccaatctttcctggaagaatagtttcgttagctgctaggtcgtgtgttgtttgcttgtgtgtaggggtatggtttgcatcattggtggggatgcgaccatactaggttgtttgcttaagcaacctgaacaataaaagtgtactcacaacagatcagtaggcaagtggtttaaggtcttatctttagcaacccctctcttccacctctcttccgccctggcagaagatggtcagtgttagagagaagagcaacaacggtgtatgaaagtcacagatcaatggatcagtcgaaagctacaaggtactcccgatgctagaagaatccctgctcgtgatcaacatttggtatccaggatcagaagatgggtgtattgatgcaggagatgcaaagctcgatgcaaggtcgaatgtagcggaagcaactctagcagtagtgtgttgcagtcaaagtcagtggatcagttcaagacaacaagctaccagctgagtcggagcaccacactctggtaagatcctggctagccaagatctaatgatggatgtgtcagatgttgataccgcaactgcagagtccaaagcagcaaatgcaacgacaatgtcttcaccaacaagtacaagctcagatgcaagccggaatcaggatcagagcgaaagtcagtttgttttccaagagcaagcacctgcaacctcagacagtacgccaccaagtcttcagcagactagcacagctaagtcaccaccaatcccagaggcaacaagtgctacctatagtggttatggtttacaaggtcagttcttgcaaggttgttcgtcggcaaggcgttagcgtcatcaagacaacagctctattcgcagcaccccagttcctcaagttgtgtcaattccaatgcgagtcggtcagtttagttttgagatatcaactacacaacccatttaggtggacgacaccgaagtcgggcctgaagcatgctagatatgccagcaatagaactgatggggaagtagtcaagagttagtaagatcacgagctaaatgagaatttctttatgtggaatttcctatcgacaaccaagggttaagttccaagtcttgtcctggatggaagtgcatcgtcattgctttattttgattgatcgttgaagttttctattttcaaagccagggccattcgtaaattcgagaagtgtcgatttttcttcaaggacaatggttcaattattcccggtcacgcgaaagtatgactactctctgtaagggggggtaggtcgcagagatgagttttggttcacctcgtgccgttttccttaaagattcaacccagtgcagcaagttggctagtacttgaaagagccagctgcaaggcgtcagcagagtaacactgatcccaagttgtctaattaaattcgaaggtacgccggtgaggccaggtcaaccgtttggcttaaagaagtagcatcaggaacagccgcaatccagacaaggacagaccaagccagtttcctgaaaatacttgtggtttgaatcaagagcaagtcgagcaaagtcattgtctgtgggttacggaagtcagtttcaaggtttcggaaaaactacaccgatccccggtcagcaaagtgaatcctcagtttatctaattgccagcattagcaattcaatcaaaaaaaaatagaagttctatgagcaccagcagttctggtcaaggtcagactaattagagtcggtccgtcagtttatgggaagcaacagaacagcaagcttatgcaggtttggttcatcgagcaatcggtcagatgaatcagaaagaggcagcatgtgtaagcagatcagtcagaccgcccgccagcaccagctttctttctagccatcccagaatctcgggacgagattcctgtaaggggggtagatttgtaacgccccgattttcgttcgggaataaaaatcaattaataatacattttctagaaattaaataaaacttaaatcaatttaatcaagtaaaataatgggagaattaaaattttcccttaaaaatcattggccgggaatattttgtaatattctttgcgccctaatgtactctccggaattttccgtgaattttcggagctcgagaaatagtttcaataacacaaagatcattgcatcaattaaaataaaaagaaaacaaataaaatttcccccttcctctctttgggccattttcggcccaagtcttctttcctctcccgcggcccgcgcgccttctccctctctcgggccggctcccctctttcttggcccgctcgcaaaagtctgttttgcgtcccttcttctctcccttcgccgacaggtgggaccggcggtcccacccgtaagctcctcttcctacctctcgccggcggaccccaaccgccatagccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgagctccggtcgccgtttcccgccgccacagccgtcgccgcgccgagccaccgccaccgccagcttcgccaccgcaaggggaagtccggccgcctcttatttccccctctccacccctcgagcaccactcccaccgcacacccgaggccgccgcccctttcaccgcctccagccgcgtcgcgccgccgcttcggtcgacgtcgactcgcgccgttgcctccctcagctccgcaaggacgaggaggacctcggccgccgcctctcttcgccggaaatccgccggagctcctccttcctcggtcgccggtgagctctacctcttgtcatcgccatcggtcttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtgaggatctctcctcccttccttttttcccgtcccctttcttgccgactgccgcctcttggggtgcgtcgccgtccccgtgcgcgccgctgtcctccggccacccgccgccgttccacgtcgccggctgctgcagccggttgccgcctctgtaacgccccgattttcgttcgggattaaaaatcattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgataaatagttttaatagcacaaagatcattgcatcaattaaaataaaaagaaaaacaattaaaatcccctctttggcttttggctcgggccattctcccttcccttcccttcttccctcctttcttcgcgtgggccggcccatctcggctcccccttctccaagtcacataacccccatccttcttccttcttcccttgccgacaggtggacccgaagccccaccttgttattgtctccccccaaccgtttccgcctctctacttttccccgagccaccgacaggtgggccccacctgtcgggtccttcccccacctcccgccgatcccggtgcgccgccgcgccgaaaccgtcgccgcacccacttcctccgctttccccgcgcccacgccacgtcgccgcgcccacgccacgtcgccgccctctccccgcgtctcccggccgcgccagcgcacgagaggggcgggattcgattttgaatcttcccccccaccttctctctctcctcccccacgtcgccggcgaaatcggagcgccttccggacacgttcgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgtcgcaagacccttcccggccgctgctctgcgtcgccggaataccaccgaaaccccatttccctcgcgtcgtcggtgagttctctctccccttcgactccggccggcgtggatggtcgccgtgggggttttcctccgacctaattcctctcctctctttccctaggtgtcgccgtcgctcgtccgcacctcggcatcgccggtcttcgccgcctccctcgtttttctccgccggccattgccgcccctccggtgaggtctccctccccttccttcccttctttttttttccccgtgcgccgccgccctcttcgcgcgctcgctggcgctttcgggcggcgccgatcgcgccggcgacccgccgtccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccccttgagccgctgccgagtgggcccgtgtaccagcgccctccccctttgactcgctgacgtgtggggcccgcctgtcggcgccggccctttgctgacgtcagcggcagtccttttcctttgtaaaaataaataataattgcgcaataattcgtaaataattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctattctttgtcaaccttgggtaatgaatcgactagcttgtgttacttatgtgacctagctagaactatatgcttagccatgcttaattaccactagctcagttgatgggataattacagttttagacctttctagtatcttgttgagccgcgtgctcgagacatctggccatgtttcatggtcgtaattatccaactaaaatgcgactgaatggtgggctgtgggtgcatggttttgcgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttagggaagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccaccttaataaatcgacccaatgcactgtagtacaggtgggttggttgggcctgttcaacgtggtgtagcgttgatcagtggagattcaatattactttaattactcaacagttttgctgttttgctcaataaaatgttttacaaccgcctttatgcaaatagccacaaaccgtccttgtatccccttgcacgtctgcatcgttggtgtggcttgctgagtacggtggttgtactcagccttgctatcattcccctttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacagcctcccccttgccgcctcccccttgccgccgccgcgccatgtctcggccgagccggcttcatgccgtgcccgtgccccagccgcgccgcctcgtggccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgatgacgtcagcacagccttttcctttgagaaaataaataataattgcgcaataattcgtgaataattctagaaattcattaaaatggctcaaaaccttctaaaattcatatctaattcattcgaactccaaattgagccgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgtgaggaaaagagttcggaagattgttttgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacatctggccatgcttcatggtcgtaattacccaaactctgaggggagggagatagagtaagactgagtactacccactgtactcagcaagtcatgccggaacgaagggtatgatgcaggatataaccaaagaaggcgaaaggggttcatttgcataaagctagcatttataaacagtagttgaaagcagtaaaacagttgtaatagttaatcaacattaaaccaatcattgctcaacgcgacaccacgttgagacaggcccaaaccaccacatgcactaatcagttccgttagggtgagactaatcacggtgaatctggttgaccgcccataaccgcgggcacggctattcaaatagttttactctgatcagaggtgtataactgtacccacaagacacaaccccacgacacattcctgtgcgccggcatgccaccacgatataccggaaagaggtcgtgacagcacccttcgcataagcccctccaaccaaacacaccaaacctcaagtttcacccccactcctcgcaaggcagcgggcagtcccctctcgtgcttaggtgaatccggaagcgacaaaggccgttgtagggccaatcccgctccatcacgcccacccttgcatggatgcgtcagctagaggaaagttatactacaagcccagccgttgcccatgctggcttatggtaagtacgaggaattcttccagagtttcccgcgaaccggtccttaattgccatgggtgcgaccatcaaaaccatgcacccactacccaccatttaatatattttaattaactaacacaatagcggtggcactaatccaacatcaatactagagtctggaatctatgcattaatgtaattcccccattgtgtactagttgaactaagcatggctaagcaatccctaatccaacatctagtcatgttacaacccaagctagcaaagaaacaagatatccaataatatggctgagacagtaggtaatcatcccatagtaacattataaaacaatgcattatttaaaggaaaacaatagagcatttgcaatatgggatcaatatgttcaagtgacaaacatgacttgcattgctctgcggctggaggaatctcagcgactatctcaaagaacaccggagcgtcgggagagccggaatctatgcgatatacaaggcaaacaatgcaaacatgctataagactactaaaatagagaacaaaactatttttattggattcttagtatttttcttgatttactgagacttgaatgggcttaaacgaagcacggatgaattttctatgaattttagaagattcactgtatttttacagtaaaagaaaaatcctgaattgatttattgcgcaataattaaccctggcgacgtcagcacaagagggggtggcgccgacatgtaggccccacatgtcatcggctcagcgccgccggtccacggtggaccgagtccacgagaccggggatggggagcaccacgtgacgcacacgtggcgccgacgtggcggccacgtgggctgccatgcgggcggcaacggatggcccccgatcggacggcggagacggcgcgcggccgggcgcacgcacgggtgacttaagctggcccagcggccctggcgcgcggcgggcggcgtgaggcgacgagcggcggcgacgtggctaggcggcggcgctgggcagtgcggaagagagagggaaaaaaggggaaggggtctcaccgacgacgattgacgacggcgagcggctacaggcgaaggcgatggcgggacaaactccggggcaacctaatgaggcacaggagatggattagagaggtagagagggagcgaaacgggcgaaaatgccggccgaaggcggcggccatggaggggctcaccggcgcacgacggaggatggctcccggtggcggatttcgatggggaagggctggacggcgtggcccgtgggcttgcgaacccgacggcggcgacggtgaggctcggtggcggctctaacagcggcgagcggcggccggaatcttcctcaattacccaatccctcgattcggtaaatgcgacggtcatagctcccgtaaggactccacatccgggccaacgaaatcggcaaatccctgtcgattcgatctgtaactatctatccttgcaattttttttgtgcatttgatatctgtgaaaaagatatccccgttcttttttctctgtttctgaactcaagcatcttgaccagtgacaaacatggcgcaaaaaacacaaacacacaagctaatcatcagcactggcaagcatactaaattcaagacgcttcttctgtgggagatgttcgggaatggagcgagtgggttggcggtgctgctcatcgccaccgtgtccgtgcagatgggatgctcaacgggcaaactgttttaacagctctgattgacgttcacctatttattacatgtcatctaaataattattaaaaaattctatctatctatctattatatactaaaagtccatgagactttctacaaacgctctcaagccgccaagtgacgctctaataaaatagagaaaatcctagaaattctaagaaaaaagaaaaacaactaccctttaattttcacttaaattggtgagtccaatattatacaccgttagataaaatcgatcttaaaacaaactaaatatcatgggtcccacctatcttcctcctgcacgttggcaggtggcaggtggagtatatacgtacgtatacattatacgtacgcttccttccttttttttcttttttttctttttttcttttccatttatatatatatatatatatagtgcatatattttttaaataattataattttacaaaacaaagaatctaccatcatataacaaaaaatcttcctttcaaataatgcactattttaaaataaattttacacaattatattatgtacctattaaataaacaatatctatattaactaatttatacgtgcacttaaactgatggccccattatataaatcatcggatctattttttattacattggtatattattctcaagtaatgtactgtttcaaaataaggtctacaccattatattgtgtacccattaaattaacaatttaaaatatatattaactaatgtacacttacactagaactggtggacttattattataatcatcgtatctattgtttgctaataaataaagcgtccgaaattcttttttttgcccgctgcacaatgcacatttgcacctttgcctttcgcatgggtgacaaggtgtagtgtttgagacatataaggtgatcacaaccactgtagagctaccgctttgccatatatcaaatcatatatggagatgattaattttgttaataacatgaaaagaaaattaaaggtgtgatgcagcgagagaataattaagcaccatgggttatgtttttctcaacgctaattagctctgtttaagttgaaaccgaaagttgattatataataattataatgtatttgtgttatgtcgtatttggattttgtactatttgttcgtaaatgtgaaagggatcattatgttataaatgtgagcgtaatattgacgaatattaatagaactcttactatgataagggtgataaagggagtttaaggccctttatttttttcccgattccatattttggatttttgtttgcacactttccaagtttctaaatagtgtcttctttaaacaatattctaactttttagaagtcaattcatttgttatacccttaaatagctatcacataaattatataattcattaatttcagctatcctaaaccttaagtactacatattttttttcatgcaagtcatggtgataaatcattaaagtcgtaaaattaatatgtaagagttactctgaacaattgtaaataggtgtcaaaattaattgctattaattagacatctaatggcttgcaagccacaaaattaatttcactctacatgtatataaagatggacgaagttggaacaaatattaccatatgtcccatacatatatattgcgcagttaatattctaattacatgtgttaagtcatttaaaattcatgaaaatgctctcaagctgcgacgtggtgctctaataaattagggcaaatattagaaattctaaggaaaaaaaatcaaagtatatatttcttgattttcacttaaatcgttaggtctaatattataaaccattacattaaattgatcctagaacaaactaaatactacgaggtcccacctctcctcccgcggcatacgtacgcacctacttacatgggtacgtacgtttcccctcccttttttcattttttctccttcttttttttttaccatgcatatgcttccctccctttattcctatatcatacgccttcatgagacgatttaatcaaaagaattttgagtatcttgcactcgcatttttcatttgtagccatactacacggtatatatatagatggactacttcatatgataattaactagcaatacctttcaataatataagtgcccgtgcatacgcgcggaccaccttcctagttaaaaaaaatatgaacaagatagatcaatatgtaatatattgatccacaaacatacaagttaaaattcaacttctacaacttgtaacaaaaataacaaacaaaactcaaattactatatgtatatttacaattaaatttgttatttttgttacaatttgtagaagttaaatttgaacttgcatgtatgtggagtgatatactacaaattgatctatcttgtcaattttttttaaattttttcgtaattatttagttgacatgtaataaatgggtggacattcactcgagctattagaatccatgctcaacggtgctgactgggtgcactacagcagctatctgcttcctcgcatcaccaaatccaaatagcaagaaacaaggagatccagcggcaaagcagtcaaatctacaagcaagcaagctgccggtacacgagcaacagcaaagcagtcggatcgatccagtactccgtccgcacattggtcgccgcctgcgctcaccgccgagcagcctccatcgtcccctgtcgtagcccatcgtccgttgccacggctcgcaggggcggcgctagagccaaattgagaggggtgcccggcccctttataagcaatgttatactccctccatattaaaatatgtacgatgccgttgactttttgacaaacgtttgaccttttatcttattaaaaatatttatgtaattataatttattttattgtgtcttgatttatcatcaaatattctttaagtatgacataagtatttttatatttgcataaaaattttgaatcagacgagtggtcaaacgttggttataaagtcaacggcgtcataaattaaaatacggagggagtactaagtagtgatatttttggcaacttttatagttcatcacgagtaacggtgggagataaagcccaaaaggatatagaggttaccaaaataataaaagtcacagtgaactagtgaaggagaacttcataattaccaaggataacaagtattagcaaaatatataatctagggtttgcgtgcgtgcattcttaggagtgaattgtctgcattgtactgtgtaattttaaaaaaaaattgtccacatcaatttgcatgctctacaacaagaggggaataaaaaattttcattttcaactaaaaactaaacaaaaaacagaacaaaataaattcatcaatttcaagttctccaaaatcacaattcaatgtttaaaccctaacattgcgatcttaaagcaaatgccaattaagagcataatcacataatccataccatatctatcagactcgagggtttcttcttttgttaatcaacactagttagcagagaaaaatcataaagggaatgggggggggggggggggggagagtataagcccaaaccttgtggtgtccttggacactgaggtcatgagggacagcagtcgcctgaacaaattccggtgaagccaagctagccagcggcggcgagggcatctactctcgacggagggtgagccacggtccacggaggcaatgaacatgaaagcggacaggcgtcatgtcgcagcagtgattaaagcggtgtgcatcccaagtcccaatcctcgtatagtgtgcatcgtgcgcgcgtggccggcacgcccgtgggcatcacaggctcgcaaccacgattgggccgcacatctgtgagcttcttgggcttagcaagtttaccaacatgggctattttgatccgggttcctgggcaccccccccattgggctccgcccctaacggctcgtcatccaactccgtcaagctcctcgtcgcgctagcggagaaggccagcgccgctctcgtcaaggctgcggcggtggtaccctcccctgccggaggccgtcgccgacggggcgcggtggcgccgctcgtgttcccgctcctcgatgagggagagatggttgtggcagcggaggccgcgcccaagccagcggtggtgtggaagcggcaggtggcgtgccgaggcgggagggcgagcaagcggcctgctcggcgctcgcggaggaggcatgggctccccgacagacctcttttgtcagctctccctcgttttcgtcgtcttctttctccatcgctgccatctctctcttctctcgaatcctctcgctctctctcatgtcgttggatccaccaacctccactacccaagaaatcaccactgtcctccttctcgtcatcgccttgtactccgctgtgaacaccgcgtcggcgccggtcttgataccgtgggagcaaacgccgcaccggctttgcatccaagcagtgaggaagagaagacagagagagaagacatggagagctaacatgtaggtccaaggtatgacatttcaacaatttctctctcctctccaaccgaaaattattattttaatggatgcggtatccaatagtaaatatccaacttttgtgagtgtgttccctaaaattgacttcacgcagtgtcctatagctaaaatcacaaagtcgcgaagttctgtagcaaaatttttctatcaataagtgtatgcatgcatgtaatcaatgaatattaagatggcttctcgggttacaacgaaacatttaatttatctctccatttatgtcatgaattcacagagattataaatagaaacaacttactccctccgttttttaatagatgacgtcggggtacagagatcgaattcgccttataatgaggngttgatctactgtaccg

SEQ ID NO: 4159 - DNA, 10672 bp, Oryza sativa
  unsure (1)..(10672): unsure at all n locations
gtgtgccgatagaatcgccttattatanggcgaattcnagctcggtacccagtactatgagtgatgaaacaactcgtaacaaaataaattataattacgtaaattttttgaataagacgaatggtcaaacatgtgaggagagagtcaacggcgtcatctattaaaaaacggaggtagtatttaataaaactaaaatatgaaaaaaagtttaactcttttgatggagggagtatataagatcaggtgaactaacgttgaggagcaaagttgattgtggtaaaagaaaggcagaaagcgttattagactccctaaagacgaacgataagcccttcgcaaagacgacggcatgcatatggtatgatattagattataaacagttctagtggcgcacagcctcgttgtcacccgtcgcgcggcgcggtgacgaagcagagtgcgagaacaagccagcaaagaaccgcgggaaggaaaaaacaaatcgtaatgacggcatacaccgtaatgatgaataacacccacatcgtgaggagcatctcatgggagttggccaagacgaaggtggcactgctcattaacgccatcgccagaaagtgcgtcggcacatgattattgatggcatgcataccggaggatttattcaccagcaggagcgtgaccagaattgtgagcgccatcgcgaaagtgaccgtgttgcaggcgacgtacaccaatgctatcacagtttggtacttggtgaggacttggagaaggagcagaggtgatggtcgacggagccggagcagcactggttttgcttcggtaggaacggagttgcactaaccagtcggtcggcggctgcagcgccgcctggaaggccatttgtacgaagagcgcggcaaccatcatcatccacccgcgccggcctgtccctcatgtactcgtcaaagctgcgggagcgtcgcatgttgttagtgtcgcccggtgcagtgctgccactattggattgaacaccgtcaccctccctgtgctgaacattaacggggttccctccaggagagccgtccatggtgttgttgttatccgtgtcgatgttctgcgcacaccgaaccatgcatacaatgtttgagaaaattaattaattgcaggtcaaaaaaaaaagtttttaagaggaagagactgaacctgaacagaatcgacattcactatagcctcatcggcggcgactggctcgttggcattggttgcatgttgatatatatctctgcagtctcagacacaggcgctgccgcactgctgtattttttttagataggtcaccggaggggagagattccccacctaaaagccgcactgctgtattgtgaactgtaatctatactaacctcactccatcttatatagcgtacgtactacgtagacatttcctctgaagtgttcgcctcgtgatagtctgctctgctatagatctcacacaaatagctccaggtctgaatttttgcgcttccaagtagatcactctgccttatggattcgtctccattaatctagataattcttattataatccaaaatgccatatatttttctaaacattattgaccgtattaaataatagaagatgctacgacccaattgttacaacaaatagaaaagaaatacgtgaaatatagagcaagcaaactccaccttttgaaaccatgtaagagatacgagtagacgagcaaacttacaacagtggccgattctgcacaagtagaagcatatgaagccctattctcgtttctccgacagaacaggcaatcgacgcctatccagacaccaaaaccgatgtcatcactaatattatcatcgacaacccgagaaacaaataaacttaattagtttatcaggttttaatttcatagagaacctcgtgaacaacttacccattaacaaagagaaaagaaaacgaaggattggaacaaactaactccattatcatcattgaaacacaagccctatactatttaatagatatttcgaaaatgccacatattggacataattgaaagggaaaaaaatcatgcactattgatggaacaccagaataatatgaatagacatccatatccatatagattagggatgcaaatgtggcgagtaagcggttttttttcgcttataattatagttaattttattctttttaattttgtactaacaaataggaaatggaaaaaatattctctgagacagggccatgagtccgactccatgagggcccgctgtagatttttgccacgtgggtgatgagcacgaatcttggaatagtttcatcttcttcctcttttccccttacctccttccgtattctcgtccttctgagtgctcctggcggacaatttcatcgggtttttctgtaaacttgctgaggaatgattgtcgaaactagatttcggcaataataaaagggggtggctatcaagctcggaaagtgtatgggtttggagacaaaagatttatacaggttcaggccttcttataaaagaagtaataccctactcctgtccggggatgaatccgccgagtgtattattgattgtatgattcgggaaaaatcagcatctacccctagaggcgcccggaccccccttataaatgggaaggagtccggattacaaaagataatctatattcctaacggaatatgaagatataggtaaaatacagtcgtaaccgactaagtctcagggtgtttccttgatatacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatgataatccgagcacttcaaactcttcaagccaaaacctgccgagtggactgtaaagggcgaaaagataaagaatatggtgcatcgaatagatgcacctaattaggtgtagcccccaactatgtgattagttagcaaactaaacatatagttgaaaggcaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcattcctagttaacccaaacagcttttgtagcctaaaaaagcttgcaaaaatagcataacgcctttctgtcgggtacctttttaatttgcattgcagtaattccaaagaattatatgaccgcataaaaatgatttgatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatcctatatccaagcgacgcttcgtcttccccgccggaactctcgccattttccccattccctgctacagtgcaaagctgcgccggcgaactagggttcacaactccggccaaatccacctccgaaaagtgcatcaaaatccttcccgtgatccacagcctcaatccctcacctctcccaagccatccctcaaatcaaatcaacgcattttagtgaaaccaatggcggaagagagagaaagcttcgaaggccaatgggcgtcatccgacgtaacggaggagaatcttaaggagatggtggcgcacggcgttctccctgccaaggagatcatcgggtggcgaccagcgcacggtgaggctttcccgtctccggatactcatgagattgtggtcttctcgcatttcttctacggcggcttcgctcttccgacctcaaaatttttccgcgggatcttgaatttctatggaatcagcttgcatcacctaaacccgaattccatagtgcatatcgccaattttgtccatgcttgtgaagcctttttggggatcaaacctcactttgccctattccgccggatcttcttcctcaagccccaaccaaacaagaacaaaccatgtgtagtcgggggggcaggattccaactaaggggaactctgagtcaaaaatatttctcgatgcccttcaagacttcgaacaaaggatggcatgcaaactggttctatgtccagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagaacagatcactcggcatttcatcaaatgccgactagcgccaatcaaggaaagatctcgcacggcattcgagttcgacggcaagtatgatcctaaccgtgaagaatcagactctctggatttcagaatcatgaaggagaggatgtataaaatcttctcaaatgcaatcgtcgtcagctactcacaccagctgccagtcgtgccatataatgcattcaatccgcctccgcaggtatgtatcggaaatcttcaaaccatgatcagaacataattttgtcttcatgctgaattgactaactatggaagcatcttgttcaggaatatgcactgatgaagtcagatccaccagtcactcagcgccggtctcctcgccaacacactgctcagggaggtagagggccaacgatcagaccagatccgcaacctcagacctccaaatcaactggtcagacgggtcctcgcaagaggaaactggtgcttgatgacgatgaaggcgacgatgataaatctggggataagggctcgcctaataaacccccaaagcgcaccatgcccaggaaaaaactggccggccgcgcaatgctaaaaattagaacatcttccaggtataagacctctcggtatgatttcactttggtaagctctctcatgaaaatgatgctaaattctgaaagaatactttgcaggaaaccatctgatatagatccatctggaaaagaccccgatccagccatggcagagcaaaatatatccaaagaccccgagccaactgccgaaagccagccgactgccaaaagccagccgaccggcgcccatgcttcgggtgaccaggccaatccgagtgaccagccgccgactggaaaccagtcggcaacaactgaagcagcaacaactcaagagcccccgactggaaaccagtcggacgcaggccctgatcaagaaatccctgaagtagaagcgcagacgacagcttcccaagggccagaagctggtaatgactcgatagctggatctccaggcaaagaacaaagatcacctcacgctcagctaggtacatcttcaggttagttgtcttctcatacaacggcgatttaaataacctcagtgtatccgtctaatgtcttggaaacacatcaggaccatcaggtgatgacggagaagaaatccctcgcataaaggcgaccgacgactctcgtcctcctatcttgatcaaatggtgggacgagaactcacaagctgccggcatagtcataaaccgtcaaaaagaagatgaagaagtgtgccagctgaagaaagcgctcggagaagccactcgtattgtaaatgtaagtcttccgagtgacggccttcagtaactttgttttctttttagcagaactgaaccatgatccatcatgcagagaatccatcttcgcaatgaggccaagactacaactttggaaaagctggttcctcatttgggaactctagaagcagttagggaccagctgcatgaggctaaggagtgcgccaaaaagacagagaaagagttaagggaccgaatcgcccagctccaggatgcaaacttcgagctaagtggttcatcaaaaggtaatcatctagatctgttccattgatttatactgtcataattgcatcctcaaatatttggatttcaaacagcgcaagccaccagaatggctcagatggaaaaacagattgaagccttgaaaaaagacaaagcaggactggctgcagaaagggactcagccttgaaagaagttgaaggtactgccggctgatgatctgaactttcctctttttaatgcagtagagtctgattattataaatgtgttctgtagaccgtaaaatcaagtctcaagctcagtttgacgtcctggttggtaagatcaagaggcttgaaggagcaagagatgaagtcgccaatgtcgctacaccactcatccaagccatgttcctcaataacagtggtccgagtacactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagtgatgttgtagagcaatttcgcaacaacgacctccaaccgagtaatgaagactctgatgatgaaaggactgattctgactgagtttgaatgtgatacatggaggctcaatttgtacaatactggtgtatttatgctgtgcttgatgattcttgcgaagtttttgatttcttaaaagtttttgctaagctttattgagcctaaaacccaaagaagctattaaaaactttcagtcctcgcaaactaagtagaaaaaccaaacaaggcaatgataaaccaagtaagcaaactgaattgataaaaatcacactccattattatgatgatagcccccgactgacaacttcaaggagaaaacttgatgtttgacagtcaaaatagggaaatacaatgataaagttaaacgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcctctgccccgtagacaaggaaaaaaggtgactggccggtggcccgactgggagtagttcgtaaggaccagagtaccgatggcagttgttgcacccatttgccggcatagggttttagccggtcaaagacacgcgctttaatcccttgaagtatcatgccattagctcgctccacctgtccattgctcattgggtgtgctactgaggcatagcaaatcttgattccaaagtcttcacaaaagtctttgaaaactccgccggtgaattgtgtgccattatcggtgatgatccgattgggtactccgaatctgtggacaatgttgatgaagaaatcgcgagcattatctgctgtaatcgtgacaacaggcttagcttcgatccacttggaaaatttgtcaatggccacgaagaggtgcgtgtaaccgccgactgcctttttaaactggccaaccatgtcgagcccccaaacgcgaaacggccaagacagcgggatagtctgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtgcgcgctgcagcatggtttccgcatatcccagaatgtatgtctttcagcaattgtctcccttcctctaaagatacgcagcgttgcagaattcctgaagggcttctcttgtatagctcggattcatgcataacataaagtttgctccgccttgaaatccgctcggcctcatctttgtcttgagggagttcttgagaagtcaaaaatcatatgaggggctctcgccagtcggcttcaaccatagctatgtcatgagtgtccgcaacttgagtagcatctttgtgaggtactgtcggggaataaaggtgttcgacgaaaaacatcagatggcgctgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaggaccactctttcataacttggttaacaaccagctgtgaatcacctcgaacaattagacgctttatccctagggaaattgcaatccgtagcccatggaggagggcctcatactcggcgacattgtgggacgccgaaaaatgtatccaaagtacatagcttaatctttctccagttggggagatcaaaaccactcctgctccagtgcccgaaagtcgtttggatccgtcaaaatgcatggtccaatgctctattttctccacgggggtatcctcttggcactcggtccactcggcgacgaaatcagctaacgcttgagacttgattgaagtgcggggcttgaatgatatgtccaaagacatcaactccaaagcccacttagcaatccgcccatttgcttcgcggttgtgcaatacatcgccgagtggaaatgatgtgaccaccgttaccgagtgaccttgaaagtaatgagatagcttcctggtagtaattagaataccatataacagcttctgaacctgagggtacctcgttttggagtcggccaggacctcgctgacgaagtagattggtcgctgaactttctggacatggccttcttcctcacgctcgacaaccaggactgtgctcacgacctgggaggtggctgatacgtacagcaacaacggctcctgcgggtgtggtgaagctaagaccggtggcttggtgaggagttgtttgaaatcttcgaaggccctctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcagggtttaatttcatcctgaaagcgcggatgctcgcgaaggtttcttctagatccgaaattagatcatccttttgcttggtcttgacgactacgtcatccacataggcttcaacgttgcggccgatctgtgttgagaagcatctctggatcatgcgttgataggttgctcctgcgttctttagtccaaacggcatggtgacgtagcagtatgccccaaaaggcgtgatgaatgaagtcttcaagcagtcggattccttcagtcggatctgatgataccccgagtagcaatccagaaaactgagaagctcgcagctggcggttgagtcaactacctggtcaatgcgaggcaacccgaaaggatcttttgggcaagatttgttgaggtcggtgtaatcgacacacatgcgccattgccctgtctttttcctaaccaggactgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaagatcagaaggatctaagggaatctttttagtctcggcttcggtttcccccctttttgaaatcttggcggcgggcacttctccttcgctcaccgtggttgcagccagtcggattttctctcgggcagatgccatctcgcgggtttgggccatgtcgcaactctccttgtcgcatgtgacagcttgcttgatgtcactccgtagggttaggactcctcggggaccaggcatcttcatcatcatgtatgtgtagtgcgggacggccatgaacttggctaacgccgggcgtccgagtatggcatggtatgctgtctcaaaatcggcaacttcaaagctgatattctctgtgcggaagttt

SEQ ID NO: 4160 - DNA, 18009 bp, Oryza sativa
  unsure (1)..(18009): unsure at all n locations
cgccctctaatacaaccatcnnnnnnnnnnnnnnnnnnnnnnnnnnnnnnnnnnnnnnnnnnnnnnnnnnnnnnnnnnnnaaaaaaaatttagaattattatttatttttttgacttactttattatccaaagtactttaagcataacttttcattttttatatttgcacaaatttttttgaataagatgagtggtcaaacagtgcaagcaaaaactcaaaatcccttatattatgggacgggagtactaattattgttcttcgcaaaatgaattattttttgctttgatgctcttcttattaagcagacgcagcagtcgccatcgacccggtatgatattacaacgtatggcacgagcatctttaagaagagatactaccaaactactaacagctaaatatttaggacaaattagagaagatttggtgaggtgagagagagcaaaaacattcaggtgtctgaatattagaaaagaaaactggtgtttgaacggagcacaaaacagggggctcagaattagagcttcaattatttgacatcttgtctcaattttatccactcagatggtctcacatgtcatcctcataagtatcaattaaagtaattcgacaatgaaaaaaagtgttaaattatcaaatttctcggctgagaagaaaggaaaaataacaggggttttccttgtttcctttgcccaagtgtttgcttaatcccttttcatccaaactgtcccaaaattaactgttgctgtcaacaggaatataactctgctcaactaccgtgctgcctttcagtctctttctcttcatttttttttttaaggaagggaaaaaaaataaagatattttcgtctctttcaatctgctagcattagcatgatactacgtacgtctgccatatataccagctgcgaacacacaagaatgcatatacttctgaagcatgtccatgtctgtgtttggaaaactggtatttatcatgaataaatggatcatctgctaatgtcagcttacaacaacaggtcaacagcagcagcagcatggttctagcagttgatccttccctgtaaaccatccatacaattacaactgctgcatccagaaatggagctacgcaacagatcatctaacatcagcggctcagcgctatgttaatatgttattaaacagcatggaattgttccctttttttaagataattgatagaaacaaagaggaaaaatacaattaagcagtaaaaggaatcgctcgttttttataagatgttgtctactatcagctgacttaaatcctaatacctacggtaacatcgctatgttccattgcaaaagagattttctccggtctaacaaaaagtagctcgaggtaccggtatctcatggtaccaaatcatttacgatcgttggatctaacattgtacatcctgaccaggtagatccaacgatcggaaacgatttggtaccgtgaggtaccgttacctcgagatactttttgctggaccagagcaaatctcccattgcaaaaagactagcctgctaggaggcgacctctggaatatttgctcaagctgttcagcaagttccagctcttgcctatatctgtaaggagtgcaaaatggtagtaagaagcaaagattagtggtacagtttcaacaaaaagatctaaaagcaatacaacaaattgtattccatcttatccaactgaagcaatagaataaattgtaattgctctgagcatatattcagtaatagcccaattttagagagcccctaacttatctaactgcaggtgtgcgcctttcaatttgcctgtttagcacagctctagctctggagctcagccaaacagtttcagctccacctaacataagagcagagctctcacaaaatgaactagagtggtggagctgggtttaggcagctacacaactccactccagacccaactcctggagctaaatttaggagttggagctctaccaaataggccctcaatacgtatgtatcttgtgtgtacataatatgcattgttccaagtccgagggggcatcaatccctaacaggtggggcccaccctccataggcccacacatcagaagcgcacacccttcataaccctggacatgattctgtttggtagactggtagtatttatcatgattaaaatggttaaacatcagtttacatctagtacatccagaatggaggtatgcaacaacagatcatctaacatcagctttctatgtaatctaaccaacatggaatgctatatacacagcacagtagggaggatgcatggtgctattttcttttctctctttttcagtattgggaggtaaagaattcattagaagatggtgtctactgtcagcttcctcttgggaggtgacctctcgatgatctgcttctgcaagtccatgaaacttaaccccttatgtgcaaacaaccttctgagattgataaccgagagctcactgtattttgcgatggcgagatcagcctgtaccagctcatacctacatgtcatacaaaatgtatattccgcaggtaagtagccaagatttgctatgtagttcaacagaaagatctgaaagcaatggaacaaactgtgctctaatttcaaagaatattattccaaaaaagaaaaaataaatgagagaactacatacgcaggatgagcaccaatgagtgcaactgccatcatggtacagttgtgagcagcggttacgcctctcgggtcatcctcaaacaccacacactttgagggcttccgatccagctggtgagaaaagacaggtttgacaaacatgtgagcagtatatcctgaaaacagctaaatattttgaagcggagcagaagcatgccttcatagcagctgagaggaacctatgtgctattgactccatatcatcctcgtcagtcacaattgcctgaaatataaaggaggaatgaataaaattaacttctgatatacatcgtattcgaagaatgtatttcagaaaataatgttttggtaaaacttggaaattaggatgatacaaaaaaaagaaccttgaagtatttgcttagttccattcgatccaaagcttcaatcatgcatctcctatccagggacgatgcgacagcacaagggatgcctgctgtctggacagcatccaaccattcccgcaatccatttactggtgtatcaagctgaatgaaatgaacatacttaatcagaaacaattatgtataatttaagccatcttttatcccaaaagaagcgtagaaataattactttgaagagattttcgtagtataactctataagccgtgccttcagtctttccatttgactttcatcttttgcccaacataaaacctgaataaggacaagtagagttgccactttaactgccactgggtgcaaattgcaaaaggaaagccatatgcacaatagaaagaatgtgcccaacaaagagtatgcttttattattattattttgtttgcagcaaaataactttcagtggcaaattagtgttactaaaaagtaccaaagctaattgatgatgcaagcatggtatcaactctaaaacatagaccttccgtatgtataaagaaaactcatacctttctaagcacatggtcggcagcaccatgaagaatactcttttggacatgaccagcatttgggatatccttccctgcatgaaataaatttattagcaatatcaaggtagcatccctggcagtgaggtaaacacaaacctcaatgacaaataagtagtttagaccgattttattcagtcaaaattgaatgagaagtcataaaaggttgcacaataagaatcttatatttatagtaagttaatgtatgtgctcctcagaccttgcagacaatataccactgagaatctgaatgtgaagacaaaatatgaacttaaacgagtaagaaaatgatttctacagtttgcattgtcggaaaaaagaaaaggacccatacaataacattataggaatagtatgtttcataaaactttacactgaatatttttattttaaaggtataccttcttccaaagcaagctgtctccaggcatccaactttagtgagtctgtatcagcctaagagaacagaagaggatgacaaatctgagtcaattatagatgcaacaatgggcattgtaatggaggtggattctaatcactcgagtggacgtccactcatttagtgcatgtcaactaaatgatcatgaaaaaatttcaaaaaaatttacaagatagattgatataaaatatatcactacacaaacatgcaacttaaaattcaacttttataagttgaaacaaaaataacaaatttaactgtgaatatgcgtatactactcagagtttgatttgttatttttattacaacttgtagaagtcgaatttgaacttgcatgtttgtggggtgatatattacatatgaatatatcttgtcaatttttttttgattttcttttcatacccatttagttgacatgcaacaaatgggtggatgtccacctaggtgattaaaagtgtttccccattgtaacagctctataaactactgagaagaatggacttaaggaagctgactcttgttcttctctaccaatcaaccagtgtagttcaaaccaaaaaaacaaagcatcccgtaatgaagttgaaacagaaacaaattttaaattattaacacgtaaggtagagtttgtttgaatgatcttcacaacgagtaactgcagacgagaaggcctaatgtgccacttagaagaaataaatatcactagtaggctagtagacattgcactattacaaactagcacaagaacaaaaaaaaaaactcacaattacgttgtcccatgagaaaataagcccacatgcttcatctggcttcatagcatgtcttatcctttgaaggaagcattcttgcaatttttcgttcagataatcctgaaacaatgaaaggaaacttatacaaaatgtaacttaaggaagtaatacaggatgctagatatagaaaaaattgccatgtaagttaaatgacgtatactcaccacatcgaccttgagtggtccatccatcctaaatgtctcaaaaccttccccatattcagctccaattgcctaaaaaacaaatgcacatctaattagtcctggcctacaaaaatgaaaggtaaacagctcttatcctcgaagagtgtatcatgtaatggaataatataaaccatagcttgggaacgttcagaaatgttagtcataagtgatccaagtatatgaatatggtaattaactgactaccaagattccaagcaacagaactaaaaatctactccttagctaagagtactacatcatcgaacccaccaactacaagaacagcaatactggggataattcaccaaagggaaccatcaaactcaaatgaaactcacttagtcacttgccctgttttagacgaaactcgccaatgctccgaaatggaagaagcatgagctaactttccaccccactagtacaaccaagataagaaaagatggaaattaacccatgaaccacttaaatggcattgatttctcccaaagatgtgcagtttgtattctaaagaagcatcagagcaagctgaatccctgcctaatccggaggtcgcacagagcaaatccaaccccaatcgaagttaataccacatttgcgcctagggcaagccagacttcttcaaaccaaacaagaaattaaccaagaaaactcttatctttacacccatgaatcaaacaaaaaccaagaaaagctcacctcctcgacgaacaccttaccaggtaggggagggaaggcctcgaatccggacgccctcctccgcacccccaccatcctcccgtttcttggtctctgcaacaaccaaagaaaaaatcccaaaaacatcagaaaaaaaaaacccaaaagtttccataaacccgccgtaaaaggagggaacttcttacggggaatcggaggctggagcatggcggcgcttgtcgggaggaggagggaagcgaggggaatggcgatggcgaggcggcggtgcggaagctacacgactccatgagaaggggaaagggggagaaacgggatgggagtggagggggttttatttttggatattttttttatttttcctttcttttcgattttatttatacaattaatatttgtggggattatttcttttttttctcgttttaatttttatggctggggattggtaaaaaataggaggggaatttttgtttctactcttgttgctagctgtgttggttgaacggttgttgcaccacaaatacgacctgaaattacgtcaattttttaacttttctttttacatcagcctttgtaaaatcatactagccactagtaaaaagcttaagaagtggattttctatactttttcggtagttttttttctttggataatggtttgtccatgcaatagcgtcagaatgctgcctaatctattctgggatgtagtcatgtagagttgtgcatttttttcccctttttgtgggagagaagagttgtgtatcagctataaacaaaattaatgtttggataaacagttcattttactttttaaaaagaaattgagatgttctgtcgatcgtcacaaagtttgccattcgtataagggttaaagtagatataaaaggacttctttttttataactatatgtctacaaaaccattgaaaataaataacatactaagcgcatgcagtgtactaataattactaaggcttatgcttagttcaatagtgattttggcggtaggcttttagttgcattcattaacatgtgattaatcaaatattaatcactataaataaaaatgagtttattttatttttaaaaagcttttgtaaaaacttcttgttcaaaataaatcgtttagaagtttgctcctagctatcaagagagttaaaaagataaacgagttttcgaaccgagcttaatagcctgtttggcagaacttatgattctgaaaaacggtttgttggtagccatcttctgagatatagaaaagttgagttttctaacttccaaattttagtttattttgtaaattcgataacctcatcttctcataaactaaatgaaaagcgggactattataggtctaattcttatgtcattctatccaccagtgaattatggaactgggggatgtcaacgtcaagtatgccctcatctatctttagcaccagtgcaccagaacacttttcaaccgcatccacaatctcaatgcagtcaaatatagaatattctatgaagtaaaaggaacatactagttcagtataagacggttttatgaagctgtattgcatggttttctatttacaccctatgtaaactatagctactttaattatacttctgaagattaaagcagcatgtcttaaagttagcaaaatcatcacatatgacctgtttgttgataggtacatcacctaccactgatagaacaattggtcgtaaataggagcatctgcgacaagtttatgatttaaatgtttcatcgtaagaaacctaaccaactaatctacactcagcattgtctattctgttatttgaaaaaaaaatataatgaatttcaaatattatgaaagtgtgatacatgtagctaaagtagtggacatgcctcacatttttttttcagaaatatacatacagaggtaaaaaaaaaaactatgctaaatgaaattgtgtaacttcctgctgcctattccatacaaatttcgtaggttcatttccaacctcaacaagaaaaaatataaacacaaacagaaccgaatttccatatgtttgtaggcccagtaattaattgggccaaaatccctactacatgcaccattactgggctgaataatgggccaaaattagtgaagccaaaagtccaataggcatcgccaaatctgacgctccaaatcgaacccaacccatttaccccgaatctcaccctccacccccaactccggcgaccacctcgccgccatggccgcccgccggagccccgccgcggcccaccaccgcctcttcctcctcctcctcctcttctcggccctcctcgcccccctcgcgtccgcctaccgccccggcgacatcgtccccatgctccgctccggccagtaccacggcgtaagtgagcaaagccgcttagccttcggattctgaggctgatttgcgttgttcttcggcgcgatctgatctgcgaggtggggtttttctttttttgtttgtttgcagtcgaggtcggtgtggttcgatgtggtgggacgccactgcccgtccttcgcggtcaaccatgaggtgagatgggggtgtgttcttggaaagagaggggtcgagatctctgattcgtttcatgtgtgtgggggagtggttttggtgatttgggttggtctctcttgtgcaggttatgatgccgatccccaagccgactgggttcaccggtgcagatccttacaagatgtgagtaagatgttctgctgttgttcatgttttagacggaaaatttacacttctgttctatacaattttgagtagaacagtgagttcagtaagctgtagggcatgactttgaaggttatcatcataatcggtgatgattttgtgacaccagaatcttgtgactgaaatcataaattgttaaaactttttcttgttatttttcatttttgagagagagaattcagaaggtatggtgttctgcatagtttgtgctaggttataatactcattgtaaggttaagacgaactgacttttagttcaattgactgttgtagagaactaaaagagtaaatggtagtaaggttggaaatgttatgaacatatgagatttacaacctgtatatgagtgtgtttctggagatgtgttttgcaatcttacctgattctgacactgtagaacatttcaaattggtcacgaaaagttccaccttccttggctttatgtcataaatcgcaaaagctctgaagttccaatgattgatttccatttggtgagtccttgcttaatagtttctatatacctttccagcaagacttgtctctgtgcttaatttgatctacctttgattacgcagaaatactctggaaatgatttacttggtgtcacagctaaagtagtggacatgcctcacatttgtatgtattgttatcacatgtcctcgtgatatatctttttgcatatgtctaaacttatataattctatcatatttagtattgttattatttctcatgcaagcagtaccatgtacacatttgtatgtattgttatcacctgtcctcgtgatatatctttttgcatatgtctaaacttatataattctatcatatttagtattgttattatttctcatgcaagcagtaccatgtacacatatgtttgccaaatagtaacaaaacatttcatgtgtagcagcgcttcattaataagttatgttctttgcatgtctgttttcctgaacgtagttcgtttatataaacccattatgagcattgtttttcagttcaggggaatctttaaagatttatcttagtgtagtcaagtagtcaactttgtttacctttcggtagtgaactaatggtgagctcatagagcagcccttttgggagttatcagcaaatgctcatgacttctctctctctctctctctctctctctctctctctctctctctctctcaataccgcagcaatattcgggccttgtataagggcacatagcatatgttgtaaatttccaatagactagactttttcaaggatagctatcatttttagagtggtttttctttcacctagtaaattatttttattcacaggctgattttgttgttttgtttctcgatttccctaattgctaaccaatgctcattttgttatccagatgttgaacatcatcctgacataaggaagaatttctgggatcaacagaattggccaaaatatgttctggtcagatatacatggtaaaaacttactttgtaatttaaaattttactatgacctttcaaaaagatctttaccataacaaactagggtgaaattgattcaaggacttgaaatgattcattcagggaggagcaatcggagatagatgttcctggaggtttctatgtgttgtttggatctggtgagttcgttttaactcaaatagcatttgtttgccatgctatactactcttgcgatttcccttatatcatgaacggaacatttatgttctgatgccatctatgctgatatagcaaagtgtgatagttttctagttctaatggctttcacatttgtgtcctaaaatagcttctttttatatatgcagggcttgttctatccttcatccttgcaatctacgtcctgcaatcatctcaggaaaagttgacaaggtttgtttttcacctttcagttagttttctgtatataggctgagactgaactattcacggctacgtagaacaaaaataatgagaattcattaattttttgcatcctgcatgcttttggttttgtaggttgaacactgacccaatttctataaatcatcttttaaagctgtattgatcataatcatgctagcttagttacctggagatgtactgctctctcccattttggtcgcaacattaaagaataatagtggcgttggatggattaattcaattggaactgatccgtgttatttgacgctaccattttgctttgtagatttgtgcgagaagcagttaatgacagtagtctaccggaaggagggtttgcaaaggttgagtgatctttctacaaggagctggaaaattatacactagtctgtccattgatcagaaaactgtcagtagataccgagttgtcagtcaaatttcatgggcgagctttcaacttcaaacaagagccagtggattgtcttgtataaatacatacattgcaaacgatttagctattatgacatgaaaagaggaaagagaaatggacattaggttttcccttggcagaatggtatttttagcaaactattgtccgactgtcactaactcacttcagttgatgtattgcgtgatgattttgtctgatgcattttttttgtgtgtgtttttatgcttcttgtggaaatcttcatccttgaaaaaaccaacaacttctcggtttttctaggatggaggaggtatgtattaaactgctatggcgcattgctttctgcttgtaagaatcactatgtcaagttaatcaagtttggtcatcctgatagtttgacatgcatagtatgaaccatggataattagactgaataaaatggtccacaatttaattaataatttagttgtgtgtgtcctgatcttattaaaaaaaaaacagaaactacaaatgcaacattgcccaagcatccaagaaattatgggcacatgctagatccatgagaaaaggattctagtatctttgtactaagtattagcacactctagtatcattggttacgactgtattaactgaacagtgatctaccttctgataactgcgattactaaaggacaaagacaacatcaccatccagtgcccactacctagacaaaataaactctaaccaaccttgttaattaattaacatcttttctgcatcttacgactgcattacaactaataaagcagtagttggacgtttgccacgaagggaaaggaacgatagaaaggggaaagtgtttacaaccctcgtttttcatgtcttttttttaagataatggagtgaaacatcccgacctttgctcatgagagctacagccaattattataagaagtagcacactaaaaggcgcagtccaaaattaaacaagcacaccaaccaaaaataaaagaaatcctaacatgacaaggaagattaactaaaaaaaagattaaatttgtaaatacacataagatatatcatgaaaaaagattaacaagataaattgataagatatatcatgcatataaacatataaattcaaattaaatttgtaaatacacataagggagagccgtgcgttaaggccagatatagcagtttgatgttttattaatctatttgatccaataccagacaacacaggatgcaaataatgcgaacatcagaatactgtaagcagaccatgaacagggaacagaatacagggcttggaggggtttgaagctgtgtatgctgttctactgttacagcttaccagaaacagtgaatcatgtcacatagtacgtcagaacatgtggcaactaactgaaaaactgtgaccttattacaaccttcagaattcagaaaacgagtattcacagcggcaaggttgacagcaactcatgtagacacatacatgtttatcaagaaaattgctcaacagcattatctcgttacaagtttcagagcaagcggaagcagcataacaagtagcagttaccaagcattcaacagtataatatcaggggaagaaacataaggactgtaatcgaatagctctttaatattgaatatctgtcaaagtgttccaacaaaggctgctcacaaatgcccagagaaaacaaaacataatagtattacaaagtcaaaaaacatagctgaaacattgcagacatgcctacaaaacataagcatgaacttaaagaaactgtgctatgctaaatgatagaattaatcagggccaaaagccatgggcgttgccatgtttacatttttcttttcaattcaatattattgtgtgatatgtttctaagggataactatcaccatgctcaggtgatcctattgcagcaagagtgtgggtgcctctagtcaatcttaacagatgagaagaggtaatggacgaagtagaaggacagcaagaagccaatagcaccagtagacagcatgatggcaagggccatgatcagggaatagccaaggtagagcgttgctgagaccggtccacttaggctcctaaggtcgaacacgaggtagttgattgagtataggaagacgtagaaggcgacagaaccagaagcaaagaaggctttccaccaccacttccagtcctccacacaaagatgcatgtaggttaggactaaagaaacctcaccacagactatgaccagcaggaaaaggacaatgaacaggaagccaaagacgtagtagaacctccccaaccaaatgctagacaggatgaagaaaagctcaatgaagagggtgccaaagggcaatgttccagcacccaaaacaagcagccatgacgggaacttgcgctcagggatctctcgtggaatttggttggtacggacagggtactctatgcttgcagcacgtgtacccagcaaacctccaataagtgtgagtggaactgagatgcagaaccacagggccaggagtgtgaaaaacagtgagataggtaaagctccagtgctcttcttgccccacaggatggagttcagcacagtcaggataacgaaaacaatgccagggaagaagcaggaggtcagccaagcaacagatttccacccttctgaggttcctttgattgtcctccaaacacggacaccgacatatccagcgataattccaaggaagaggtacaggatgatcattccggtcaagagcattccccttgaagcaggtgagaggaaacccagagcagcaaagacaattgtaaccactgccataccagtgatctggataccatcagcgaccataacacatagcagctttgagcagcaaggctctctgaagacatcaccaaccacaagtttccatcctgagagctcctcattcatctgagcttgcgcctccttgtccatctcctcataccgtgtcagatccctacggacagtcctcaagaatatgacaaacacgataccagccaagaagaagacaaccatcatcgagttcatgatcgagaaccagtgaaccttggcaccatccattttcaagtatgcatcccaccttgatggccacttaatgttgctcttaacatactcaacgtcataggtgaatgtaatcctctcgttctcacggatagcctgagatttctcaagctccaatgggcacttgacagaatcaaccttgtcatacatcttcagcttggacatcgcctcaggatcacgcctcacactgcaaggcacaacctcgaagccaacaatctggaatccgctcttgcgatccgactccaccatggcaacgccatcctcactggtgatcacaacatcaccctgcgcctggtactgatggaccaagaccttgaacctgagatggttaatgatgtaatcctcgttactccccatcgggttgtacccgaccgggaatccggtccactggatagtcaccccattctgctcggtgaatcgcatgaccggcagattgtcaaggatcatgttgacctggtacagatctcgcgcccgcttcttcaacagctcggcctgctccttggtgagtgggtccgtggtgcataggtacacggactcgttcacgttgactcggaaccggtatggcgaattgtcgatctgatcacccatgaggatctcgccgaggttctcggcgctcttcttgacgccttacgggggcttacagtagggcaagctgtagtagctgaagggcaactcagtctcaatggaggtgagcgagttgaccttggctgagatcacctcatttggggtgtaggtgtgcatgaatgtgcccgggaggtagaagccattggcaccaccgtgcaggctcacgagaacgacgagcaagtaagccaagatccatcggcacgactgcatgttggcaagcattccaccccctgcgacgatcaatccaacaacactcaaaataatcaatntggttcttgaaacctcaaaccatctatactctcctaatctcatcttatacatatacataaaaagtagatcaaatccgatcttcgtatcacaaaccgaagtaaaacgcgtacaaggggcggatccaaacatatttttttgggggaaaagaacaaactgctactacttggtcaaagaaaatggctgcttccagatctaggaggagaagctaagggttaacgcaaacaaattcgagacgaaagtgggtggagataaagagagatggatgagaaaagaggatccggatccataccaggatgtggcggaagcagccgcgcgccctgctctgctcgcgagatgcaaaatcggcggcaggaagtgggcaaagaaggagccgagacgagcgcggagacggggataaatataagatcctcgatgaacgctgagatttttagtttttcttttttctgttccacccttgggcacgattaaattaaattaaagtaatttatttaggttaaggtccacgttatgccaagaccaatagcgaattcacataaaaatataggtgggtccatacttagtatcagtagaaaccaaagtaagtatagcttaactcgttaggttcctgtggtgaaaccaacccatccgaattgtatttatgcctaattattcttttagtgatagacgatgtatatgtggtgacttcattaatcttaagatatgccgactcaatcttcggaagatgctcaaagaggtagggtgtgtgcatttatatggatgagtacgcgcgtattgtgagcgtttacgattgtaatgtgtttataagaaaaataaaatagttaaatttagtgcgtatacacggtcaaatagaaaaaagagacacgtaggaaaaaaaatgaagtgcctttcaaggcaattagttgaaaaaaaaaatcagcaatagagctactatacaacaactaatcggcaaagcaacggtttaaattgctcgtgtcaccgccagccgtctgctgaatctgctgatgcaccctgacatggccgccccctcacagctcacaaaaaaaactgttttattacggtatactccctccgttccataaaaaacgaatctaagaccggacgtgacacatacatatgtcttaattcatagtattaggatgtgtcacatccagtactagattggttttttatgggacagatggagtgtatctggaaaaacatttgatgtggtaattatgtccaaatcaatcttgagattcaaccagggtctaactttcgatttcaaagtaaaaatcgcttctcgccggttcaccgaaatccaacacaaaatcgataaaaaccgatgactttcaatcaacatggtacaaaaacaggctaatacagatcggttttcataaatcgttgacatagtggttttatgaaaaccggtcgatttttacgaaattccaacgttttgtcatccctcgattcagctgtcattaattaaaaaatatattcaaacagtaggagttagagattacatgaaattcgatggtagcaaacttatcaaaaattttccaggggtgacttgaaaggaaaaactagatttcccgtttgtagtcggtgcttgttttcaatgagaaatctattgttccagtggtgatttacttcctccgtcttaaaatatagcaagttttagttggatgtgacgaacctagtactatgaatctgatatgtctagatttgtagtaatacgatacatccaatccaaacagtattttgggacggagtgagtactaaaccgtatttaggaggtgtttgtgaactacagggacttatgtttatgtaggagggactaaagtttagccccactttagtccctccaaccaaacaacaccttagggggttaggtcatgttgcatttcgtcggttcgcgtgtggtgtgggggtggtattttggcgctggtccacgttcggagatccggctctcctattggcccatttcgtcctgcttctagtacacgtgtagtactactaatattttggtcatcgtttgacctggtgtggtgggttcggtaggttggtagggagcctaaccagtgccaatgacatgtgggccacccccccactaccggacgaacagtacactacaggtacaagcaggcagcagcttcgcctgattcccattatttttcttctccttctcccctcggatccacaccgtcggttgaattgtttttgtctcatgccggccccaccgcagggctgttgacatctcgatcaacggcccagatctgccatgccattactgctgcacgaagactcggagagagagaggagacaggtgaccatgacaaaatggcaacaatggacaaatggtatgtggggccatggtgccagtgggcagatgacatgtgggcccagggggggtcgtggggttcaatgatcaatcatggagttcaagaaacgcatctggcatctcctccgtggtccagctacacaacggcgatctccaacctgccgccgtgatgccaacgagcgatcggggttgtgttattccccaactcatatcctccggaaatcgtacgtttttcaaatcggaagttacttttaaaaaaatcatattaatctattttttaaaataaattaaactaatacttaattaattatgcgctaataaatcgcttcgttttatgtatcggagggattagtttcatccccaagaccacaaccaacgaacacagccttacttagcccactccctttcaaagaaaaagctgcgcgatcactcgtccagtcctatcatttgttttatgcttttataagctaaacttttaaatttatacagttaactttgtgagattttattgaagtttattttacaacatttaattttgaatcataaataattttttttgaacgacctgcacgagacggtgttagattctattgatagagcaagaaaaaaattacaagattacaaccctggagggtcgtaaccaggaaaaggaaaaaaaatataccaccacccccacactgacagtgccaatacacaactccgggagaaggctaacaccggaccggccgctgctaagcgtgaccgactgccgctagactaacaaaggagcacaaacgannnnnnnnnnnnnnnnnnnnnnnnnnnnnnnnnnnnnnnnnnnnnnnnnnnnnnnnnnngagtagtagaagttcattcaaaggccg

SEQ ID NO: 4161 - DNA, 823 bp, Oryza sativa
  unsure (1)..(823): unsure at all n locations
cctggcattaaggcccggttcacgggaaccctggagccttacagtccttccccaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttagggaagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccaccttaataaatcgacccaatgcactgtagtacaggtgggttggttgggcctgttcaacgtggtgtagcgttgatcagtggagattcaatattactttaattactcaacagttttgctgttttgctcaataaaatgttttacaaccgcctttatgcaaatagccacaaaccgtccttgtatccccttgcacgtctgcatcgttggtgtggcttgctgagtacggtggttgtactcagccttgctatcattcccctttttcagaagtgtagtgcttctgagctgaagatgnnnnnnnnnnnnnnnnnnnnnnnnnnnnnnnnnnnnnnnnnnnnnnnnnnnnnnnnnnnnngccgctgtcaacatnttcacatcgt

SEQ ID NO: 4162 - DNA, 5916 bp, Oryza sativa
  unsure (1)..(5916): unsure at all n locations
gcgcccttgatganctcctnnnnnnnnnnnnnnnnnnnnnnnnnnnnnnnnnnnnnnnnnnnnnnnnnnnnnnnnnnnnnnnnnnncacgtgtcatagaaacatcaatctgtacagcagaagagtgtgaaatgataaagtacgtttgtcacacccacaactgtacatatcacactttccctgatcctcggcctttcttttccatcaaatctagctagctaaattctaagcttataatgatcaaaacatggtgttggtggggaagcaccgatgttatgcacatatgcgtcttccatgtaatcgaaaagatcacggtgtttgcgctcttaaaaaatcaaatgaaaacggatctctggttccagattttcagatgttgtgtgcgtatacgtcttccatgtatcaaaaagattattatgtttgtgcttttaaaaaatcaaatgaaaaagtctctttggttccggattttcagtccaaagttcatgaacattatattacatgttgaatgaagtatttaatttatagaaaaaggtctcaatacaccaaaacttaaagttggtcccgtttgtcgatgcttattaactatgcatacaagttaaaataaaattataagtttcacaaaaacaaactactttttatttggacagttttaaagccaaaagccatatatgagagcagcttttttcgctggcgttattatgcgtaaagattgcttatgcttgcagttttgtacttttgcataactcaaaagtcaaaggcatatacttggtgaggttgcttctcgcgtttcaaatttcttaatttttggcagatagcagctggccagatttttgtgttggtaatccaaaatgatgtaataaataactaataaaacaagatgaaggcagggagaaatccctccactacgaatttaaagttacaactaggtcacatccggtgggaaatgactcattcctaagaaatttatacatttcagttaagcttactgatgtagaaaagccaacaaaaaaaagactaacccctaatatgtgcaaaaattacgcctaattcggaatgaaatagcctatgctgattaaccttgctagtgagaaatgttactagagagaacagtacgcattgaacttagtcagaccatctagatataaactgagatgatggtatgacccaccatgaagctcaggtgtttggagttcttcacaaagatttgctggccttcagaaacaggtgatattccttgagcatcatctccccgccatttacagggtcaaagctgtatctgtagaaactgaatgtgccaaaaaattgttgttgtaattagtcgaaaatatttctcagaagacaaacccatgacaatgcaatattcagcaaataattaatacatcatcaaaatctaaataaggtttatgctagtattgcacggactacttcagtccaacctacttaactgatgctatcccctgtctaactacacaatgctatggcattttaaacaataatcccaataaaatataatccaaaagaagtacatataggaaggcagaagttacagatccagattgacttgaacgagcatgattgctcaataaaaaaacaaagaaagaaacagggaactgcttacattgcatatttcttttgttattttaatttgagtagcaaattgccaaaaataaaaagttatggtgtgcacaatcatcgtttgaagaatctgcagactggatcttttcaatcccttttagcaatatgaattaattcccaacatgcttatcagattttaccaaagaatattgacattattttgcttagacatacatttcttgggggacgtttgaatttagtaagcatgtgagtttcaccgacaagaaggccccacatgtcactgatagaggtggtggccatcaccgctactaccttttaaagtagtatagatagtctttgagatgtgacttttatcattacatttttaactttacatcactggaatttatataggttgcaatatgacaaaagtaattcttcgtgacaaaatctagctttgataaaagttattccgagttttcacatatctagctttggcagttttaaatatttttaaaacttggaatgttagaacaaaagtaaaacaccatgtttgtaaactaaacaaaatgtctaaaacccatttcttaattatcctctgttgtcttttgtaaagaaagagtacctgccatcaagaccgatcatcattacagtgtcttgatctccaaatgccataatataccgcgtgatttctggtaaacggaactgagcaaaagaccattctgaactgaagtatttcggcagaatccctgtaaattttcaatgtatataaggaatttgaacaggaaatacagatggaagagcaaaaaatatgtattgtcaacccccatgcagaagataaaattgagtttcttttctctatcggctcgactttaaactctcaaagcccacatgccaatatagttaacaaagaaatagttttgttctttgtgtagtgtatatgaaacaccccctatagtaatggttggcaaactgtagcaaagtatggctagcaaccaaacaccccctaaagtaaacaaatgaaatgggatcgtaatttgtaaagttgtcgcggccatgttaatggtatcatggtattagcacacaagaaggggactgtaccgcattaccaattagaatcacagtaccgagcataaaagaagctatcaactttgttatgagctataagatgctaaatacatacatgtcccagaactgagacaacacaagttttctatgtaaaatgcttttgcaaggaagtttcaccaaaaaaaaaaaaaactagtgaagacaatatttgaataactgacaatactgtattttaaaattgattgaaatattacaaagagataacttactagcccataagattcaaaccttaatcaactaacctttcatgaaagacagggatgagctcgtattggatccaatctttgtttgtgtaactggaaccgtagaaccatagttgcaattgtcattcacctgtgcacctgcagttgcagactcccccttttttgcatcctcctctgcatctttcaccctcagactgaagacatgcaccgttcctttgtcactggagactgctagccactgcacatttggtgacagtgcaatgctatatatctcagctctgtcaagtcctctccgcacctaaatagcaagacgagtacattactgtttttttttttgaaggtaagtacattactggttactgctgaacatttgtaaattacatagactatagcaaggaaacatttatgatatccaaagacataacaatgatataacaaaagaaacaaaagattattttgcagcgcaaacaaaaaaagaaaaaaaaacagcctcacctcctgcacgcaggtgccgtccctagtgttgaatatcctgatcaaagtacccctgacactggcagtagccaagagtgttccatccaaggccattgtcatgcacgaaaggggcgagtcatgagcagcaatgaacctggtctccttcaacccgaaatgctcaatgagaacctgccccttggacgtcccagggcaggcgaaaacggaggcgtttgcgtgatgagacaggcagcacagcccattcgggttcgacaccgtcctagcctggtagaacagcctcaggtccttgaacctgtaaacattgatggtcttctcaagaacaaccacaaaagtagtccttggacagcctgacggctcggatctcgcttgtgaagttgtacttgtggatgcggcgttcggtgtaatcgtcccagagctggagcatggtgggtgggaactcggtgttggactctgcacctgccaatccgaatatgctggtgcggaacagcatctcggcgattccaatccctccattggggccaaacatcctcctcatggtctcgtggaagggcttgcaactgaagaccctgaagccattggtggttgctgcaatgaagcagctgttgtcctggttccaagaaaccgacagcaactccaccccatcgtcatcactgccagatgcttcttcaacatggcccataggtgaaaaagactgaagattatggcacgcaagtgaggttaatcaccaagattctggcagcagaaattgcccccttcttttttcagaattcagagtgaaccaatcgctcctagaacagtagagtagaacggcttgttcagagcacaagaactgagcactgtcgaacaattatgctcctcaagaacctaaatcatatacatacagaaaacatcatcaagatgatagaaagctaaggaaagctatcatgtacatacagaaaacatcatcaagatgatagaaagctaaggaaaacgagcactaaatcaagcagagatggccctgaaatctaagatttgatctctataataaataacatcagttgcctctccaatactccatagtcaatccatacacgctaacaagtaacaagagattagaaccaatggcctcgccgcaagagcgcaaaaggcagggaaaaatcaaacgccgacggccgatcaacaccccgcaaaagaatcagccaaccgccaaacccagaggttaacacgacgggaatcaaacctaaccaagagagagagagagaggaagtaggggcacgtacctacctacctacctacctagctctttcccgcagccgtgggatcgggaatgcgggggcggcggcgcggtcgccggcggagttccggggagctcgagctatcggcggaggcagcgagcgggagtttgggcgggcgcgctcgcggtcgcggccatggtggagcgctagatgacgagcgatgccgttccgcttcggtgttcaactcgggtttgtttggcgtggtttcgtttcgtgttcgggttgtgggagttgtgatgtgatccgggttcacttcacacggctccatggaaatcggttcggatttcgcgaaattcaaaatttccttttatgagatcgaaaacacgaaccactcgatctttctctatccttcgataagtttgacaagaatagactggattttgattttttttttttacaaatttatgcaaatttcatcggtttttattggggttcagatttcgcaaaattcagattgttttcatgagattgaaaacacagaccactcgatttttcgataagttcaacaagattaaaatgaattttaattttttggtaaatttatgcagatttcattgatttttatcagggtttggatttcacgaaattcagttttttttatgagattgaaaacatgaaccactcgatttttcgataaagttcaacaagattaaactagattttaaaagttttgacaaatttatgcagatttcattgaattttatcggttaatcaatggatttcatgattttcatgagtgaattttgatctactatctggattataaaccttggtcgtgaccgtagttctttttttttgcgttgaaaccaagtatgtttacctggttccgtaccacttgttagcagaaacaaacaatttgtagataaatcttttatatacatattcttaataattcaaaactaaatgctgtaaaaattcacaaaatcagatttaaaatttaaattttggtttatacgcgtaaggataggcgaaacaatagcacacaaacaattcggcaggttaattacaggagtacatggcttctgaataagtaagtagaatgaaaaacgggaagatgaacattgctgatcagatatacacgatgcatccgatatttaagagtatgtatgcatagatgaaataagcagcaacggattagcgacacgaaagtcatctgatatatatttcagataaagatgttcaacacaagatagcttcagaccaggcaatatagcaccagacacttggtgattcagggttcaacaaagt

SEQ ID NO: 4163 - DNA, 762 bp, Oryza sativa
  unsure (1)..(762): unsure at all n locations
ccagcattgtgggcttgcacngcacagaaggaaggacctggccaatatccaccatagcacaggttccttgtggcttccaaaaagcacccctcattccagtctggagcctatctgcccggcacacgaaagcatcttgttaatacggagcacatggaacgggtgaacccgaaccctaagttggaaggcatcctttcctgcagacttggtcatgtacttgttgcacgcgatacgcgcagcctcaagagcctcactggtgacattctccttctcccaagagacgagatgcacacagtgggagaactcatccacacccttcttcttcatcccgacatcgtagatcctgatcttggggtcagggacaccacggcagtaccttgacttggggtacggcttgttcttgatctggcgatagcaccttgcaggtcctaaccaaagcaagccacaaagtcaagttagttactcagaaacaccctaaagcacctacagccccatcactgttaatctgaatactattcataactgatcgatgaacacgcaaatagtgaatatacaaagtcatgaaagaaactaaatccattacattaatctaaataatcataattgatcgatgaacaagaaaatagtggatatagaaatagccatgaagtaactaaatccattacagggattcaaacttcaaannnnnnnnnnnnnnnnnnnnnnnnnnnnnnnnnnnnnnnnnnnnnnnnnnnnnnnnnnnnnngaagctgaattcaatccgcg

SEQ ID NO: 4164 - DNA, 1057 bp, Oryza sativa
  unsure (1)..(1057): unsure at all n locations
gcgtcaactgatgcanctgcacnanccgcnaannatantgntgacccagaccccgtncgncctncgtnctngcaagccgtcattgggcaatcgtcgtcgctgtcctcttcctccgcgtcggccgccgcttccggtgaggatctctcctcccttccttttttcccgtcccctttcttgccgactgccgcctcttggggtgcgtcgccgtccccgtgcgcgccgctgtcctccggccacccgccgccgttccacgtcgccggctgctgcagccggttgccgcctcccccttgccgcctcccccttgccgccgccgcgccatgtctcggccgagccggcttcatgccgtgcccgtgccccagccgcgccgcctcgtggccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgatgacgtcagcacagccttttcctttgagaaaataaataataattgcgcaataattcgtgaataattctagaaattcattaaaatggctcaaaaccttctaaaattcatatctaattcattcgaactccaaattgagccgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgtgaggaaaagagttcggaagattgttttgaagaagcaaggcaagtcacacattccccttgagcatgttgatcccaatttacaaatgttttactgtttgcaaacaaatatgcatgttttgctaattacatggggtaaaaattttacctatctgctcgcttgtgnnnnnnnnnnnnnnnnnnnnnnnnnnnnnnnnnnnnnnnnnnnnnnnnnnnnnnnnnnngaaagagngnagttgcatggcaaatcaatgcccag

SEQ ID NO: 4165 - DNA, 1029 bp, Oryza sativa
  unsure (1)..(1029): unsure at all n locations
gcgcttgatggcgtgactaaccnnnnnnnnnnnnnnnnnnnnnnnnnnnnnnnnnnntatgagttgttttatcactcatagtactttaagtgtgatttatatcttatacatttgtataaaatttttgaataagacgaatggtcaaacatgtgagaaaaagtcaacggcgtcatctattaaaaaatggagggagtaaattccggcagagctcctgccgtcgtcttcctcaaaaaaaaaatctctctcttcttagctgcaaaatgcatggaatttactgttgatgagtatatttaacggtgagtagctcattcactaaatataagctaattatgtttatttatcaatctggacacgtagaacatccggctggtgattgacgtacatcagtaagacgtacatgaccgtcgttcagaacaacggccgccgggctgccgcagccgccgccgccgccgtcgcggtcgccggccgcaaggacacgtcagccagccggcggtgtcagtgagaaagccggtgaagatggtggcggcggcggcggcgagcagttgctgcaacaacgacaggacgtacggcttgttgtgtgcatgcgcggctggctgatagcggtgtggccatgctgttcgccgccatggcgttcgaggcagcgctgcgggccgggcctgcctttaagccatatcggagacgcaattcgtatagacagaaacgaagttttgtaccatacggaaaatctacagcggtttaaacccatataaaagaggagacgaacgagttgctcccgccgagctcggtggcgcgagcttgtcaccccagccgtggggggtaggagttggcagtgtttggccggtgttgtggggatcgagggtataggagatatctctctccccgggggatgctatcatgatgttacatccggtctcaatttgagtgagttggcacttgttgaggtccctacgttctacgctggatagcccttgtgtcgttagattacaatgtctaggtgacttctcaattgattaaccgtctaagctgacn

SEQ ID NO: 4166 - DNA, 854 bp, Oryza sativa
  unsure (1)..(854): unsure at all n locations
cgcgcgcgataggannnnnnnnnnnnnnnnnnnnnnnnnnnnnnnnnnncctcgagtccgagctcctgcatcgagcccacccatgtcatcgcccctgcgacaccactaggtcggcatctcacctaccaagctcgggccctagatcagcagccgcctatgcttctcgacaaccgctgtcactgatgccaccggcgccccaccgcacaatagatttctccttgatagtagcgacctctcacctacctcttcctccctccctccagatttgccactatggttgagcttgtgcttgtgactcactcatcgagtagccgagttcgccaccaccgcttcctcgctcctcagttacagtgtgctcgctcacctccgccgtggttcggcagagtaccctctagcctctagagcctatgccttgctccgactacccacaccacgccacgctatagctcgcgtccctcagttcactgcccgctccctccctatcgaatctgaggtgctgatggatggccatggccaacacttgctggagctcttcctccactggcgtctgggacaacagagatagaatggggaatgttgtggagagtggagcttgataggtgcggccaacgagttttttttaaaaaaatttctaggtagatgccacgtagatcgacaagtcaacactatgtactaggtcaatatctacctcatccgaaattgttgtaaaaactgggggtggcaatttccccgttgggtccgaggacccgcccctatggagccgnnnnnnnnnnnnnnnnnnnnnnnnnnnnnnnnnnnnnnnnnnnnnnnnnnnnnnnnnnnnnnnnnnngnagtttcaatngcattcatcccg

SEQ ID NO: 4167 - DNA, 1159 bp, Oryza sativa
ataataagagcaaataatactgggccggccaatgcatttgattcagccatattactatacacgcgcggcgcaacgcacaataacggagtttagtaccacatggaaaattaacagcggtggagacatgtataaaagagaacgtggtcgtgttgctcacgccgagttggttgtgcgagcttgtcaccccagctgtggggggcgggagttggcaggattggccgatgttgggaggatcgagggtatagataagatatctctcctccctggtctcgttgggttgttgaggcacagatgctaattctatttgtccgactttggacttagggggaggactataggtgtcatcaaaccccaggcccaatttgcggctggttgagagccctgcgttgtttaacgtcggtggcctcctggttgctttaacgatagaagcccacggtcgtatcctgtccaacttctcctcttttttatttttatttttaatgatgctactctcctcttttctttttatgatgctatttttcttttacttttcccttcaactagcaagtggggtgaagatgacaattagaattgcagagcaggtgaggtgaagatgcatgagcagagtacaaaacaatggcgttaattatgttaggattccacatttattttaggattccacattcagagagtgagctcgagcacatcattgatttttgtgcacagatcgatggatcgattgattctgtcgccgacgactctgccaattctgtccaggctaatcaactcagctcaagtgcttgcaatttactgttgatgagcatgttcaatggcgattaattagttcatcaggctggtgatcgacgggacgatccaggtccctctcaatggccacaccgtcgttcagaacatcggccgtcaggctgccgctgccgtcgccggcggtgtcagtgagaaagccggtagtgctcggtggtagcggcaacagcggggccgcttcggcttgtgtgcatacgcggatggctgcctggatggtggtggccacgctgttcgccggcatggcgctcgaggcggcgcttgaaccgccggcgtggatgccgaggccgcgtgacttgtttgcggctttggttgctgtacctgatcggcaacacgtgcactttcgccacgtctctgggccgga

SEQ ID NO: 4168 - DNA, 765 bp, Oryza sativa
  unsure (1)..(765): unsure at all n locations
ntctgttttttgtttaggttntagttgaaaatgaaatttttttattcccctcttgttgtagagcatgcaaattgatgtggacaatttttttttaaaattacacagtacaatgcagacaattcactcctaagaatgcacgcacgcaaaccctagattatatattttgctaatacttgttatccttggtaattatgaagttctccttcactagttcactgtgacttttattattttggtaacctctatatccttttgggctttatctcccaccgttactcgtgatgaactataaaagttgccaaaaatatcactacttagtactccctccgtattttaatttatgacgccgttgactttataaccaacgtttgaccactcgtctgattcaaaatttttatgcaaatataaaaatacttatgtcatacttaaagaatatttgatgataaatcaagacacaataaaataaattataattacataaatatttttaataagataaaaggtcaaacgtttgtcaaaaagtcaacggcatcgtacatattttaatatggagggagtataacattgcttataaaggggccgggcacccctctcaatttggctctagcgccgcccctgcgagccgtggcaacggacgatgggctacgacaggggacgatggaggctgctcggcgnnnnnnnnnnnnnnnnnnnnnnnnnnnnnnnnnnnnnnnnnnnnnnnnnnnnnnnnnnnnnnnnnnnnnagtgtccatttcaatggcgcgn

SEQ ID NO: 4169 - DNA, 763 bp, Oryza sativa
  unsure (1)..(763): unsure at all n locations
ctggccttganatgctactctagtcttcannnnnnnnnnnnnnnnnnnnnnnnnnnnnnnnnnnnnnnnnnnnnnnnnnnnnnnnnnnnnagcgattggttcactctgaattctgaaaaaagaagggggcaatttctgctgccagaatcttggtgattaacctcacttgcgtgccataatcttcagtctttttcacctatgggccatgttgaagaagcatctggcagtgatgacgatggggtggagttgctgtcggtttcttggaaccaggacaacagctgcttcattgcagcaaccaccaatggcttcagggtcttcagttgcaagcccttccacgagaccatgaggaggatgtttggccccaatggagggattggaatcgccgagatgctgttccgcaccagcatattcggattggcaggtgcagagtacaacaccgagttcccacccaccatgctccagctctgggacgattacaacgaacgccgcatccacaagtacaacttcacaagcgagatccgagccgtcaggctgtccaaggactactttgtggttgttcttgaaaagaccatcaatgtttacaggttcaaggacctgaggctgttctaccaggctaggacggtgttgaacccgaatgggctgtgctgactgtctcatcacgcaaacgcctacgttttcgcctgccctgggacgtccaaagggcaagttctcattgagcatttcgggttgaaggagaccagttcattgctgctcatgactcgcn

SEQ ID NO: 4170 - DNA, 761 bp, Oryza sativa
  unsure (1)..(761): unsure at all n locations
acgcggnattganttgccnatgaaacgccnctnnnnnnnnnnnnnnnnnnnnnnnnnnnnnnnnnnnnnnnnnnnnnnnnnnnnnnnnnnnnnnnntagccacaaaccgtccttgtatccccttgcacgtctgcatcgttggtgtggcttgctgagtacggtggttgtactcagccttgctatcattcccctttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacagcctcccccttgccgcctcccccttgccgccgccgcgccatgtctcggccgagccggcttcatgccgtgcccgtgccccagccgcgccgccttgtggccgtccgatcggctttgggccgatccgggccgtcggatccccgtgaccggcggtggaccgccttcgtggtcccggtccacggtggaccggcgcctttgtgccctgaccggggggcccgcttccggcgccgcccctccctttgatgaccgtagacagcctttttctttgagaaaataaan

SEQ ID NO: 4171 - DNA, 969 bp, Oryza sativa
  unsure (1)..(969): unsure at all n locations
tttttccctaaagggggtagttattgcccagagtcgtgggggttaacaaaggccctttgggttttattaatatttgaaaaaatatatattgtgggacccctttgtcattcgaaaaaaaattaggacccccattttcatcctctccagcctctttcgctcatgcctcttttgtcctttgtagccggtctccaaagggccagaagttgaaccaaccggtgctcttttgtccgcaacccaagtattctgcatcgggcctttttgacttgccaatcacgttcttccgcttgactttggatcccaaccaccatgttctacagatccgccatcacgtccacacttcccacagtttccagctcgccacactcgcgtgctttctagatgctgggtagggggctcctcccaacctcgcacacctgtgccgccgccgctgctccagccttgctcctcgcatccgtccaaaggtggaaaaggggagacaaagggagagataatggagagagagggagtaggaagaagggggaggagaaagatgatggcatgtggcccgatagggttaatggactcttctgtcagatatggatcatgtttgaggagacgaagattctaaaagctagctggtttggtaggtagctatagcctctaaaaacatgaaaaaaaatggttcctcagcttgtaattttcagttattttctaaatagattgtatagttatacatcacataaaatatgtacgctttaaattggatcatgctttaaattgtaagtgagtttctagtaatggtaacttctcttacaatttctagctcttaaattggatcatgttttttttaaatattttcagcttctctacataattcaaattgtcaatcatactctannnnnnnnnnnnnnnnnnnnnnnnnnnnnnnnnnnnnnnnnnnnnnnnnnnnnnnnnnnnnnnnnngggcgtatcaatncatcaaatngccgc

SEQ ID NO: 4172 - DNA, 833 bp, Oryza sativa
  unsure (1)..(833): unsure at all n locations
cgcgccattagatgactgctctgnacnnnnnnnnnnnnnnnnnnnnnnnnnnnnnnnnnnnnnnnnnnnnnnnnnnnnnnnnnttcgtccgatggattccaagaataacggctggtgaagtagctcgtgtcaaatgcactatctgaggaggggacaaaggcagcctgcatatgattccgtgttatcctcggtacacctttacaatggagatgcaactatgtttaaagaataaatagttaaccatatcccaccttttgcctagcaagggtatcccagctaatgtctttaaaaaattgatgctgcttaacctgaagggaataggattataagcatcaatcatttatgtatcataagaagttttgaataatccatacaacggatgaaggtttctaaaacccttaaaagtcaaaatacctcagaggcgccatttgcacctagccgttggtgagggtcttctgtcaataatctgggtaaagcagtcataatatcacattagttacataaaaaacataaccacaataaacttcacaaaggattttgaaattgagcatgaagtagatagggagtattgtaataatatgcttaaattgcatgcggaaagatttcaaaaatacaaatcatattgaataggtctacctttgagcaaacagatgctttaaaccatgaacacaactgaccacatataatatgcagtgtgctactgttaccctataagctgaaacttgaaaaaagatagggactgacctatggcaatataaaatttagcgaggtgccacagtattaagcacgaaaatggcatattttagagcagatgggcccttgctagttcgacc

SEQ ID NO: 4173 - DNA, 938 bp, Oryza sativa
  unsure (1)..(938): unsure at all n locations
tgcctttgatgaccattcgacttcnacnnnnnnnnnnnnnnnnnnnnnnnnnnnnnnnnnnnnnnnnnnnnnnnnnnnnnnnnntgattgttttgtggctattactttttcctttcctcgtttgactattcatctgccggttttagactctactccgattctgtcttctctaggagacttagtcaggctcggtgttgatgtaggttttctttatcatgttggtatccaaagtacctgttgtttattgggtagtgattcttaattgatgttactcattcaggattgactacgatttagtttgtgactgtttcttgattcccccctgttctggttaaacttttcaattgttcatacttttcagaaagttcaaacataattgatgacattgcaatccttgaggtgcagaattggttgtcttattttttttatatgcacaaattccttcaatgtgttgactcagcttggttagtgtgatttttctttacattgcttatagtttctggggatggtacatgattaattaggatggtatctgatgtcttgatatcatgctggaactaatatttgcattttaagttatagccatataggtgaatactaatgttttcatcattactggtgtgactcctgctaatcatgatactggtacttagacttgaggatagaaaacttatctcacaccatctttacttatttgctaagcagggaacagaggttctggccgtacaccgcttaactgggagacgagatcaagcattgcgctggctgcagcccgtggcgtcgagtacattcacttaacaagcttattacattccatggcacataaagtatccatgtccttctgaacaagtcgtatcaagcacgtttatcagacaacggactttttgctcttgttggtgcattgtcccgaccaattccgtgccattgaataccgtgtn

SEQ ID NO: 4174 - DNA, 7555 bp, Oryza sativa
  unsure (1)..(7555): unsure at all n locations
acgccattgtcgcccgcttgnnnnnnnnnnnnnnnnnnnnnnnnnnnnnnnnnnnnnnnnnnnnnnnnnnnnnnnnnnnntttcttgcctgagaatcatatttcatgagttcgctccctgatggagttgttgccgattggcatggccgatgtgattgattgctgggtctttctttggatggtttggtgatctgtaaaacatgcatctcctgtggccgcatctggttgacgccttcggttcgtgaaagcaacgtgctctcgatccggtggcacgggtcttgttttcggcgagatgttttttgaatcgcccctgtttgttggtttcgtcctttgaattcaatctgcctgatacgaatagaaatgtgactgttgggctatcattattgatcatggtccataaatagatgccactgttaccctgtacgtagggtggtccaaaggaaaaatatgtacaggaaacgtactggttgagtgatccaaatgggtcgtgccgtttttggcttgggctacatctcatcaaaccacgatctatagcagtgtttccctagctccgtgccttcgttgcatcagcatccataacaaactctggccatattcgtctcaaaaagaaaaaaaaaaaagaaactggccatattctgaatcagtgtaaacatttagtacttcctccttttcatattataaaactttctagcattcccacattcatatatatgttaacgaatctaaatatatatgtgtagttagatttattaacatctatataaatataaacaatgctagaaagtcttataacctgaaacggaggtagtatgtatcaattgaacctttcatgctctggataacggatgaaactaaagtagaggtagctaggaacatggtaaggcggtttaacctccaaatctgcctttttgtttggtgggagctagagtttctggctagcttttcatttccttcccaacgaaaatgacatctaactttgcttcggtgaggggattctacttttcaccatcctaagcctaatgttagaagggcaaaaaatgaaaaaaaaagaaacagaaagagaattaaagtgtttctatattttctctacgattaccaggcaaacgtttattctttgcttcctaaaataaactaacataatataagataatacacatgttaaaaatttgtaatccgacaatgtgtcacactttgaaacggatctggtgtattttgtgaagccttgaggaaacaagccccggttacgcaggaacaggagcgtgtgattatacaagagacgcatgtgtcgtgcacgaaactgagatccggccttttcaacgggtagccgggtaggccacctacgcgtttttgtcccggtgctagtgctacgcctgcggcacacacctggcgtgagtggcgcgggtggcggcacacaccggcgcgcgcgcgccctccaaatccgaagcgagaaggggggtaaacgacggcggcgcgtcacatggcacgagctagtcccacctggcagggccaccaccaccacgccgccacgcccacgcatcggatcggctcgcgctcatgtgatccatggcccgggaccagagacggacggtcgtacgcacgcatctccggtgcaggagccggatggaaaaggttagtactgccgtgtttagttctaaaataatcctttatatttctagcttttctatcacatcgaaacttttctacacacacaaacttttaatttttccgtcacatcattctaatttcaaccaaatttttaattttggtgtaactaaacataggccccgcgcgttcactttttttttacacgtcgtttggtttgatggcaatgcaaggggctgccacgttgaatgttggatgtgttatagggagtagtagtaggtttttcttaggtgaaaggcaaacacatgctacatcttttggccgcattgttctgtagatacgatatttgatagtgattggggttgaaaacagtcatggctattgatgatcaaccgacgctcgtttctggtttttaccgacgtaaccatatagaaaaggtaaccgagataaaattgaaaatgacactaaaacgtattctaccaaccgtttccatattttacccttttctcatgaagatttaccgattctgtgatatagtaattactgtatcatccgacccgcatctgaccatggctcatctaccaatcgtgtgtctaatttttctccatgcaagctagtttttgtccatgtcggaccaggcaagtaacaactagagaactagtcggacaagggttgtacacaccggtcgtatgtatagccattttcatttttgaaacccctaatagttttgctataaatctgtcgtcaaattttttacttacaatttgacgttttttcaacctaccaattagcacctgattaaggcaaggcactgataaccaagtgaggtattgtacgcatctttttatctttgccactgtatagaacgaaagtgattgaacgataatactacttttaatacaggtgagaaatcttctgtgatgtctatttcgtatgaccagcagtgttttaaaagttacattaaagttacactatagtttatatgtaagttacaatgtaattacactataattgtataaagttatagtcctatataactaaaattatatttgtaaattcagttgatatgacatgtaagtatactgtaattttgataaaaaatattgtgtaagtaaatatgcattcgttattttctttaaaatataaaattacagtcatatataactaaaattatatttataaattcagttgatatgacatgtaattatttaaaatataaaattacagtcctatataactaaaattacatatgtaaatttagttgatatgacatgtaagtacactgtaattttgataaaaatgttgtgtaagtaaatttgtattaattattttattttgtagtccgttggatataaatctaagtatagaaaaaaaatatgggtgatttcttgttaaaaatcacccgacaaatgtataggcagttccatccctaatatctattgtctctgtttgacccatagttttgaggtgcaacaaccgctcaaccaaattcctaatttaattattagctagctgggagaaaatttgtaatttacatactgtaattttaatttgatttggtcatatgcagatatattaaattaaataccatgtgattttataatccaatatttctgacattcattacccgtctccaattgataccgacatgatttcatcactatagtttcatttctgatttttcgatattgttccgttttcagatttatcgttttcgaccatgttttgagagaaaaaataaattatgaaaacggttaaggttgttttctgatgtacatattacagcatacatactagactaactttgaattaagttgtgtattttgttgtaacggattgccacaccgataggtatggctgtcgggttgtgcgggtggcacagaccttattatacatacttcgaaattcaaccaccgaatgacatctacttcctccgtttcacaatataagtcattgtagcatttcccacattcatatttatgttaatgaatctagatagatatatatgtctagattcattatcatcaatataaatgtgaaaaatgctagaatggcttatattgtgaaacggagggagtatacttttaagccagtgctaaacatttggtgtagatctgtaaaactccgagcaattcatacgacaacccctcaacttttgcgaggagccaatgagccactcttttcttttttttttttttggaaagaatacactcctgtccccgatgtagatgaaagatactccattcttgttccatacaaggcttcataatgtttgtgcgattttttcttttcttttcttttaaaaaagaaacctgagaatgatttgtggttcgtacatgtgttggtgattgcaacgggccctgcggtttgagtttgattgggcgtaacaataattcatgtataggcgctggaggaacagtggaaggtgagctagatgccatatgtagcattgtagcgtgtcaagcgtgtcaatgcggcgtcccatcggcatatgcaacttgttacttgtaactgccggagacacatcgacaagctaggcagaaatgtgcgcaaaaatgatcaatcaaaggcggccgatcgaggcatatctgattgctcatacaccaggaaaggtttgcattggttcgtggtaatttgccattgcaaggaatgatttcaatgtgtccttggatatctttgcagtcctataattgctaccgcccttgattggatgatgattctcgaataattgaaaatggcactagcatttaagtttataaacttttaaccgcttctctttttacggtaaaaatttataaatccttaaaatatgttatattatttaagtgtattcatcatagcaatttgtgattcaagcgagacacccatagaaagtgtaagttattcaagaacaggaagtatgatgaaagaaagaaaaaagacacatcggattttagtgggggtaaaaacaagatgggtatttctcgcccaccacccgaccatattattttaagataaatttgtttggattataaattcgggtacttgaatttttatatagttattgaaatcatatccgggtgctttttattgatacgggattgaaagatggtatccgacgggtaaataaatattacccggtaaactatccaaatattgccggttagcaggctttttgtttagtccaaaaaaaagccatagcccacgaaacttacatcaactcataaccaccataaatcaagcacaaaacgggagtgctagtgctaaaactagtaatggtgtgatggagtaatagatattatctatgttgctgttgctatgccttaatctagttgcattagggattgaatggcgattgaaaatttaccgtatatgatcgtccctttgactcaatattcggttaccgatatatttcctccgtcccaaaatgtaagtatttttgaggttggcatgggtattaaaaaagtagatgagaatgactgaagaaggtgtgtgattggttgaaaagagaaagtaggtgaaaaagaatggttgtgattggttgagaggagaaggtaggtaaaaaaatagcttcattttggaacaaagtactggctagaaatagctacattttaggacggaggtagtaatacgtacctgcttgcaattgctacatattcatttcatatttataatcgatattatctgtatttgaatccgtatttaataattacttatgtccgatccaattccgatcataaaatatgggttaagatataagaaggatcgaaacccaacccgattcatccctagtttttataccggtcatccatgtaccttttgagtttcaagtcaactgtagtattattcaaaatagtatcaactcttagatgcttcgttttacgagcgactatgaagatgattagagttgctatcgcctactcacaatcgcagtacgtctcagctcacaggttcagcatgacatccttctctgttagtcacgttgagaatgctagtaaccataatatgcttaaatagagtattaacattgaacatatggagcccagcgtttgacgacatacttcgagctttcagattatttatttatttttccttcaatctctttgactctagtaatattaaacaagtgaacttgcatcagattattcttctttcctccagccaccattctttggaaccttgaccctcgacacccccccaccccccaccaatgttttgaacaaccccaacatctttaaacaaaggaacaaactgaaactactcttgtatttttacttctatcactaacagtattcccacggtctttgaacaatcaagtcaaaaataaagggataaccatcactgccagcctgccatgtcaacatcttctagttcctcctcactagagaaaaagagcctccaaacaaaaaatcatttagcaatttgattggactaacagctactatctccgtcccaagacataaaatgttttaaaattagacatgagtattataaacataggtgaaattaaatatgaaaagattgtgattggtgaggatactaaaaggtaaaagatcgtttacattttgaaacaaattttgaatgctataaattgtaatatttaagcacggaagtagatttaacaaacaaattgtaatattttaaatactaaaagtaaaaggtcgttattgattgagaaatgaatagatatataagttgttatattttaaaacaaaatttgaatgctagaaattgtaatatttaaacacgtacggaagtactcctacttgtcaccacctgtaacctcggccccatgtcacatcagctgaaatattttggtcagtcgtggcttatggaagcttcagattgaccagaaagggagcagaggaaactgtgccgagaaaagaaaaatgcttctgatcgcgagaggttttcaggattaattcatgggaacatggcgtgtgtttcatgatgttcacaagccacccaactgtgacgacgttgctgtgtaaaaaagctactctcgcagtcagcaggcgagaagccgagagcgacactgtcttccttttccagcatgccatattggtctgcgtcaaagtctcaaatatgatctaagcgagaaaaaaaaaacttcctttttcacccgattttaaaatacatgtaccatatcctcgctccgatcggattccgggtaaatcggtcagatattatttgatctatttttacccaaatttgtgtgtgtgtgtgtgtgtttgggggagggggggagggggctaataaaatttttttagagtacacggtataacgcagacactcacaacacacgcatactcacccctatgaacacacgcacgcaaaccctacccctatgaacatattcaaaggctgaacgaataaatcctggagattgacgaagtcaccacaggcgcattacaatttttatttgttatagtataatcatttttaattaatcaaagtgagacaatcttagtcaacagtgacaattattcaagaacagagagagtaaacagtgctagtgttgtgctccctctgttcttttatacttcatatttattttgctcgctatatggttagtttgaggcacttttgatgaaaaatttaatgcaatttccatatgagaaatttaaatatcatcagtacatacgttgtcaaaatattgatatattaattgcacgcattctagaatgatgatagggtgaaaaaaggggatgttgaagagtcgacctgcaggcatgcaagcatgaaaggtggcgactttagtgacggtctcgcaatcgcaaagatgaagtctcagtttctaccttctcgagaaagacgtactagtactccctcttattcgaaatgtttgacgccgttgactttttagcacatgtttgaccgttcgtcttattcaaaaacttttgtaaaatatgtaaaattatannnnnnnnnnnnnnnnnnnnnnntatagtcgtcgatccaccacctgngcacag

SEQ ID NO: 4175 - DNA, 6683 bp, Oryza sativa
  unsure (1)..(6683): unsure at all n locations
gcgcgttattgcactcgtatagacactcnagctttgtcttctgctactacaaatatatntaacaatgaatcaaatgatagaaaaagaattaataattacttatattttttgaataagacgaacgatcaaacatgtgctaaaaagtcaacggcgtcaaacatttcgaaacggagggagtatatgataatggagactgatcaattatgtttttggtaatgtcactctgaatttgttgtagctagtactcattttcagtacttacatccaggacctgtcagtgtttacttttcagcaaatggtcccttttcttggacatgatctgctaagcactgtagtttctgtacggtcaattaaactggcctgggagatgtttattgcactgctctggatatctctgatgccacatcagccagcttgtgttacttcagaattcgggatcagaattctgcaagagtgaaacgaacattacggagtatctctgacgctgggtgtttgtctcttgtacagcatgttagtctgaatagtcagctgtttatttattcttttcttgtggtacataagtctgaaactctgaacattttttgagaactgaaactctgaacattgaatttcgtttccatcttctctttactttggaaaaacaaattttcagtctgctttacgagtcaatggtagaatcttctttcatggctgcgatattgatgagggtgtaattctgtagtagtctgcacccacaggccacagtttgcactgcaagtttcattggtttcaaagagcaatgagttgaagtgtagaactccacactactgagagttacataaagttcataatcttctggactttttggctgtgtgcttacgggcagagaccagagatgtaacctatttccattatctaaaaaaaaacataaagttcataataattccctgcatttcaagtaactcgtatgcagaatcacaccgatctcggctcagcatttttggtcttctgaaattggttatttgcatcacacgatgcagagaggccagaagttttacttccacaatctgtcaatctccaaacaaatagtaggaaaaaaaaaagaaaaagaagaagaagaagagtaggacaagccatatcattttgatgctgccgtgtcggcagcctggggtttggccggtggtcgatgaggaaaaagatcgagtcgacgatgattccaatcacattggataggacaggaggcgttgtcatcagctttgcgaagtgcgagttgcaagcagagaaggcatggccatggccatggcagggtaggcacagcctcgctttccttggcttgcgctgtaggcttgtgggcacgcaggagcatgttccctgtaaatgctttgcctttgccttttggtgttcgtctctcttttttttttcccctttcttggacggatgcttttctcatcctgaaacgtcaaggatctctcaacaggaggagggcacggtctcctgcttgtttgcaagaggtgaggttcagcatttgggtgacttcatgaggaggtttctctaatgagtttagctgaatttcgtctggatttggtgttgtgcaagaagtttaaaatcgcctcaaacagcagccgtccggccacagcattcggaagtttatggacctccagcttgcacgtatactaggtgtctaggttaccgggataagtttgtcggcaaaaaagttttgagtgtaattcactgaatttcatagaaaaaaaccaaattcccagttttggagcacctatattttgggtgcagtgataaaaaataaaaagagaggggtatcttgacatcaacaaccaggttagcattctgaagatactgctctccaactagcatgcataccaggtgtctgaagaaaattacaggtctccagacaaactaataattcagactggaacagacaagcagaaagatggtacggatgctttcctgaaacaatggagacatgggttgcaacttgcaagttgcaatcttactgaacgaggggatgaacggtttacacaatgtgcaaattaacgaagttgccgacattttattgaggcgacagcacggtttggatccaatgtagttactgccaaattacaggagatcatgggttctcttttttgcgcctgatgctactcaatttaataatactgtacattgcaattcgcatctcttacatgatgacacacctaagcgatagccctttctgttctactctttgatcttcattgcctgcagaaagaaacagcaactaggttcagaacccaacatgcaacttcagtctagcaagtagcaacctcattgtttcgcttatgctgattataaactgtaactgcttatcagtgcccaaaaaataatttgtgagcgaaacttttatatacgtgtcctcagcgatttaaaaacaaatgctagaaataaactacgataaaaaaaagcactaaaattaactccgaaattaagttttaaaactcaaattttggttgcggtttataagcttaagggaaaacgacgaggctgtagatcaaattcactgaagcagagatatggaaattaccatcatggggttgatggagcctacgattctgaggagcagacatctccttttttaagccgatcaggatgtcttgcattgtatgttctctttgccagttaccaagcatggggaatagacttggttcaacctagaaagtagctccttgtaagtactacgccaataaaatgattcaccaactactttagcttaaaggaaagcaagtggacatgtaccattccagtttcttgattcacacatgacatattgattcgagtctggaatcgaacagtaggtggtctgtctggatagtctgtatcacagaacaacttcaactgatagattcgtccctcatgaacagtctgcaagacaaattgaatgtaaaagatcattcagtttgagcatacagaagcaaatgcagttaatatctactaatgggtgttatacaacatacattaggagggccaatgatagttcctgtccaggaacgcatatatatgtcatcagcatcatccattccatagctcactgtcccatcaccaatgcccttctcacctcgctcaagctcttcaagcagtctaaagtttctgggaactgcagagatgtactcagcacagtaaagaattcaataaatgaattactagatttgttctgtatgcagctactcatgaggcttgaaatcccaaaaaagaataatatttaatctgtttagagaacataaaattggagtgtagtaaccgatccgacaatgttttgcatcaacacaagtcaaaacagctttccagaatgagcacactccattcacgtatttaaattatatttcgaaagtttcctcatgagctgtagcaccaggccattggcatgctcatctatccatgtaataaataacagaagaaccgtgttgtttgaggggaacaaaggcaagtcataactaatgtacagaaaacaatagagaaaatgttatgccacaaatcacaagatttacctattattactagaaggctaactaacataatgtagcaactgcataagcacaaagaaaaaaaatggagttgcaaagcattccttattaaagataattccaatagcatatttagtaatatttaaaatgtttgtgtcagcttattaatatgtagcacatggttcatgctgttcaaacccacatggcattcagtggcggagccacattaagcttgggtggtgcacaggaacccaagcacgcagtggctccgcccctgactgccctgaatggaagatctgtcagttctcaaacgctagaatgcacagttccatcgaaattttctaggttttcgatggtagtgcaccaccttgtttcaatggtagctccgcccttgatgccattttgcccactaaaatgggatggaccaagtagaaaaaatgccttcaatgtttattttttcagaaaaaaggcttccaagttcagatagagatatgataggacttattggcaggactaaagcatccaaattaaataacttgtagccaagagatgaacagaggggcctattatgcagaaacctgttcagcaccagtttcatgtcttacattgttcattgatgagatagagagttatgcatggagtgacaagaaagaaagtttctaaggtcagaactcacaggatctgtatatagtgaattgatttcagttactatcaattatgtatggggtcaagaacaagggaatgtgttctgtagttctgttttgccatggtccatctataggatggctacgataaaaatgcatgtttagggcatgcaaagctgacttagactcctgttcgattgaggtggattatcatattctcatttggttcaactgcttttagatgttcgggtgtttggctaaatgtttttcttttaatttaagatgcaaacggcaatattattgcattcagaaaagatagaacgattgtgaaatacataacagttggataccatgttttgtctaaccttaatttgatttgtaaagaaaatgcaatggttctaagtttacatttctgcaacaattaaaaagataagcacagtgggccttagccagtcattgcattgttgagaattccatgcttaatatttcttttttaactcgagaagtaccaattgggaagcaaagctgcactattgggaaataagaaggccatcttgtgtgaataaatgaagggtctttcctgccattatgaattaacgaaagagcaaattattgactccgaaagtaaactctggtttccgctctagatataacaatatattaacctggtgcatagacctaataagaatcataaaagttgagtctcccttaacaaaatgcatatgctactaggacagtctttttggtcctcattaaatcctaaagtagttccagtatcattttaggataaaggaatgtatcagtttatagtcatccaaaaaactacagtgcatggatagggtagattcaatatccatttattgagattattatgttccactctaaccttattccatttctgtaaagtactccctccggctattaatatatgacgtttttaatacatattttagtgttaaaaaacgtcatatattaatgactagagggagtactttcaagcaaaatttagaaaagaacacgataaatggtaagataaaataattacaaggcctcggataaagcaaaagatttacgttttttttttcagaattggaaccatttgtaagaagagaaaagaatgccaataaattgagttggatgtcttaggaggacgaatcatcttttagtggaaagaatacgctggaacaattcttattagttggaagtaatattcactttgtattcgcttagaagtctcttttcttaagagtatgaatgacttcctttatttttggttattttgtggcatgctagtcacaacacagtggatcacaaaagtaaaatgcatcaccctggttgtattttaatatcattagtatagggtcttgatgttagcaagtgagtaagcccgcctaggtcttgatgttagcaagtgagtaagcccgcctatggagtttggcgggggctaaggggccctcatggaccccggctagggacttctattttagtactttttggttttgtcaccgcccttgcagtgggttgttttgtggtggtgcaagttcctgtactttttgctgttctttggcgtgtttggatgccttacttcttctactaatgcaatgagcgcatcttgcgtattcaaggaaaaattatcattagggtgtgtttagttcacgccaaaattggaagtttggttgaaattggaatgatgtgacggaaagttggaagtttgtgtgtgtaggaaagttttgatgtgatgaaaaagttggaagtttgaagaaaaaatttagaactaaactcggccttagttgcatattggaaaaaaaaatgtgccaatctacaatttgggttaaaaaaaaaacatgtctatgaacaagtggggtagctgacaagccacagctgtggctgtaaagtattagtaaaccaaattcaaacacatgatcagacttgagtgacttaattgcggattttttattttgcaatgaccaaatatagggatcccctctctctctctctctctctctctctctctctctctctctctctctctctccccccccctatgaagtagcagtattgttcatcttgttatgcaaaaaatacccaaaccaagaaatggtagaaatgccaaaaatactgatattaggatcaaactcaggaactaatgataagacaaacttattgatatgcaataattcgcgattgaagataaacgtgagcaaccaacaaatccagctagtacccctaaatccatcgtttccatccatataaaattgctccaattcttagcttagccacaaaagaacaaacaattgaacaagaattcacagtgctaagagttcggcgaattgggtagtgatatatgagtttaacccccgagccttccactttgcagagcaatgtactccggaagcaatccacactcctcgaggtggtaacgactcgtaataacaaaaaaaatctaaatatgctctnnnnnnnnnnnnnnnnnnnnnnnnnnnnnnnnnnnnnnnnnnnnnnnnnnnnngcctttgcaantgtatttcgacaatcaatctcagcttnn

SEQ ID NO: 4176 - DNA, 5882 bp, Oryza sativa
  unsure (1)..(5882): unsure at all n locations
acgggattgatgacagnccnnnnnnnnnnnnnnnnnnnnnnnnnnnnnnnnnnnnnnnnnnnnnnnnnnnnnnnnnnnnnnnnnncaccccacccaaatccaccaccacaaaaccaaaattcggcaagggttccctggctactcaccgacgacgaccccggcggatccctcggaccccatcgcgagcacctcctcctccgccagctccgactcttcgccttgcgattccttccttccttccttccttcctcccgagctcgtgtagtggtagcaaccagccaactactgtactgctgctgctaaaaactgaccccgcgggacaaggaatatcccaatccccagcgtggagtggagtcctctcctctccttgggaggattgcagcaactggagagcggggcccgaggaggaggggaggggagcacgtcgtggggaagaagggcgaggagattttggcgcaaaccgcagcaatcaggagggactgggactggaggacgacgcggcggaccaccggatttgagctttttttttttttcctccaacaattggatgatgagctggttgacttgacaattgccaattaggcaacagtataggctgtcttagtttctgaaattggggagaagtttgaaaaggttggtagtttggaaaaaaaaagttaagagtttacgtgtgtaggaaagttttggatgtaatgtgatgtgatggaaaagtgggagttagggggaaatttggtgtgaactaaacacacccatagtcactttataaatccgctagttagtttattactctcctcgtcccgaaatataatagattttgcgtggatataacatatcctgcgactgtgaatttggacatactctttgtccaaattcatagtactagaatgtgtcacatccaaccaaaatcccttatatttcgggacagagggagtatcagccacagcgtaaatttaagagtacatttcgtaaaaccccatattattatgatccaagttgtacaaaattgcatattttggtatgtgacatataacttaggtattatgatcctaaagtttcataaaaccacaccgttaactaattcgacaacaatcttgtatcaaaattttaaaaggctatacttacaagatggagaaagaaattataaaattaaatatgatcgtagaactcaaaagtatgttagatcaaaatcaaaatgaataatagtgtaattttgtggaactttataaccatgacacctggggttatgtgccacgttttttagataaaaagcatgaaggcccagcttttagtagaaagcagataagattttgccggtaacggtaactggagagcggggcccaaggagaggaggaggggagcacgtcatggggaagaagggcgaggggatagagagagagaaattttggcgcaaaccgcagcaatcaggaggaggactgaaggacgacgcggcggatcaccggatttgagcccctttatttttctccagttggatgatgagttggttgacttgacaattcccaatcgatttagctatatatttatcgacaatgtaaatatggtacaatcgtagtataactaccatgtaactacaatgtaattttgaatcgttcgatttgctttaaaatttgtgcaagggtgataggaaaaaattacaacccacgcacatgtaagggggattcagtaccattaccttcattttcacagtattagcatttcacttaggtcaaaaagttacatgcaagttatactatagttacatataagttacactgtaattacattatgattgtactatatttacatatgtcaaactttttaattaaaatttaatgataaatgtatagctaatcccttgccaattgggcaacagtatagtatcaccctctcaggtgagttcggccctcacaggttttgcaacttctccctccggaatacacaaaacaaaacgatagattagtgtaggattaattaaatattagttagaaattaaaaatgaattaatacaatttttctcataaacttttttaaaaaatatatgtaccgtttaacaattcgataatatgtgtgtaaaaaacgaggtagtagaagttggtaagatagaggaaagaacacagctagtatagtccgctagttagctaccagccattaaatttaaactttaaaagtaaattttaaagtttttttatttttttaacatagcttatttttaagtattagtttataaatcattgataacatagatataaaaattttacttggttgttttgtttatttttttaaggcttatcaatcgtaactgaaacaatcagatttcagactgtaggtttgaacctgctcggtattgtaaaatatttgtaatgtgggaatttttttttctatttcttccggagataaagttatgtaaacgaatttctatggaatacatgcataacgaggtctcggtctgtgagatgagcattactaccgaaaaatcatgatggcactaagaaatatctagctatgtggtcgaatttttttttagcaatgtctagatctttttttttttgggggggggggttctgaacttaccaagtggttcaatttgagctatggaaattttttaggccaatttgccaaggtcacattgttataaaagctataatttagggataatgccttctagttactcctaggtaatttctagttatccagtactccagaatatagtcaaaggggaaaaggggaaaagacataaatgacttttaacaatacttatgtttccaagcaatcttatacagtagaatatggacagttagacaccattcgtaatatatactagttgattccctgcgcgttgctgtgggcttattgagttatttcaaacctgaaaagttagtatgaaccaactgctttttatcactatcaatggtgtcaaaagagactcgtacatttatgtattaaagccttttggtttatgctaagtactaaattcaaaatgacatattagtgtgaattggatttcatgatagtcctggaaaagaactaccacggcaaacaacatactgtagatataaaaaaaatgaaaaatgaattatttgaatatcattgagatagagcatgaactgttgcaaatggaaatatgtataacctgcaatagtgcaatttcatcttgaatataatctgtaaacaatttctgttaactgaattagccgattgaaatccccatcagtgcatggcatcgttcgtggtgtgtgtccagcagaggtttgcaggaattcggacagacttaacagggccggctcaccaacttggtccttatttctgtgtccagcaaggaagaagatctaacggtgccttgcatctgacaattgattgatcagacggctctaaaatcctgatgatgtggcttaacctggtgctttctttataggagttaatattgtagtgggtaccaactatataggaagaagggattgcaccaaaatcaaatcatgcccatggtcattttaatatgccataatcactgcccataaaacaaaatatctacatggccgtggtaagaggaagggctcttgtatttaaatttattaagacaggggtaaggcttgaagccagatcgaccatcacacaccttgtaataagagtcctaggcttttcttaaaaaaaaaaaagctaaaatatgcaaggtgaatccagataatctacagtgcaaaagcttgattctgcagctcaatggttggtagctcacacacacatagctggctagctaccaccaaatcggagttaaccactcgagacatgcaacggacccatgggatctgagttgacagttgttggtgctaattgctactgctacgaaaatatgtgatgtctttttccattattaccaaccatacattgccgttgtgcgtcgctgtcaggttgacaatgcaaccaagcgcctaaatgcatattccggcaaaaatgggttaaaattcctaggtccattttgatgtcaaaaatgggttaaacatctccatttcttcctccttatatttacttttcaaaaggcgttttgcggcctcctttggaataaaggaattttgcgatatttttgcaagaattgaataatgggaatttcagagggaaggaagaaggttggggaccatgatcatgataactagaaaatcaatgcacaagaacctcctgaaacgttaagcatcatctccttttttttgggctcgaatctcataccaaacatgcaaggacagaaaaagaagacaattcgatccttataatacactgatcttttcttcttcttcttcttcttcttcttcttcatcttcttttggggggaggggagagggggagggggcgattcaatgattttatgagcgtagaaattgcaggttatgtgttggttgtgtcgggtctccagttatttgcaggtttggtgattggtcataattgggtggatatgtttgttgaaattcaatcacaacaaaatcgtgcaggtggagtactggcacaagagagaaatgcaacaagaaactacaaaacaagcgtctagctgtgtgataagaggttggtctcatgctcttcgacagtacaagaactgttaaaactcgaaactcgttacaggttaatcatgtacatataagaactcgacgttgtttagtactaaagtggatggaaccagccactacacgaatacaaaaacttgtaaaatcatagtatattatttgccaagacagatcatagcagaagtacaatactgaagttctttgcgagacatgattttttcttactgaatgcctacactgtaaatattacagatgaaattgtgcagatactagcgtttacagaaatctggctatgcctttttcatgttaatattactagtaccaccagaaaaccatgatgaaatgtcgtcgtcgtcgtcgtcaccagattcaatctgctcaatgcttctcggaatacgaacggggcacgaaggccgattactttcttctgatacttctgttaggagccctttgtttctcctggacatttcgtccttccatttctccctctcaagaggatcttgagacatagcagtcctacccccaatgatgggaaaactttcaaggaacttgtaatccttctttattgggggaatgtttttgtcactgtggtaggccccttcctcctcggagctccagaagtctgaatcttcgtcagacaatggagccttattttgcagaatttgcctcctcgattggatgccatcttggataaatgaaatagcagaatgcttattatcatctaagtcacgttgtgattcaatactgtcttggttgttcaatgattttggtcttttccaaccacatttcaaacagaatgcattcctcttgaagttcaaataattacacctgtcatgaatcaatcgtatagttatcttggaaaattttttatagtaagcagaagataatcatgacactgaaagaccagacaaagccactaacatcattttgttgccaagttctcatattgatactaactattaagagaatgcaaatatgcagtgatatgtaacaaaaatgccactcacgagacacactcccattcccctggattgagttgacggtttgttggtttctcatggcactgaaggcatcttgtattctttgcaaaattcaaaaagttgcacctgaaaatataagatcagtacaggtgcaaaaagaagactattccaactccgagtcaatcttataaactagagatttgtgaaacctcaccttttgcatatccaatcaccctttttgagaggaagatgctcttggttctcatggagcagctnnnnnnnnnnnnnnnnnnnnnnnnnnnnnnnnnnnnnnnnnnnnnnnnnnnnnnnnnnnnnnnnnnggagtgcaaacacagcgcgg

SEQ ID NO: 4177 - DNA, 16066 bp, Oryza sativa
  unsure (1)..(16066): unsure at all n locations
atgcgattgatggccatcgaactgnnnnnnnnnnnnnnnnnnnnnnnnnnnnnnnnnnnnnnnnnnnnnnnnnnnnnnnnnnnnnnnnnnnnnatcatgcaacagccacaggcaataattttgttcctttttagttcttgctctgtttgttgtgaaaccaacttttctggaagcaagcaaaagtgcaaaactgcgaacattttctagtcgagtaaattgttaaagtggcgttcctggccttgttgtttcgttgataggtcggtggtttgcaacattccatttgttatgttaaacttggtggtgaccacacagttcagcaaattttgcatctttgatttcttgaatgctgttatcctaagtgcaagcaatgttcctcacctggccaaacgtgacaacgtactatactaccgttgaatctagaatttgctgggaagctgagaacgcactgtctccgctcttaaaaaaaaacaatctaaaacagtccccccgtccttagaaaaagccaacctaaaataggatgcgaaattttattatctcatactccctccgtccttaaaaatgctaggatgctgatatttttttgacggagggagtaatacagttctagaatttgctgcgaggatgggaaccaatgtttgctgtcatctagaatctacatggcgttaatgtatcacgggctcggtgtatttaggccctgtttagatctcatcctaaaactttacaccatgtcacatcgaacgtttgaacacatatataaagtattaaatataggttaaaaaataactaattatacagattgcgactaatttgcgagacgaatcttttaagcctaattgctccatgatttaacaatgtggtgctacagtaaacatttgctaatgatggattaattaggcttaataaattcgtctcgtgatttactgaccgattctttaattagttttttattagtgcccgaacacctcttacaacaccatatataatatctaatgtgacacgctaaaactttacgcccctgatcttaaacacccccttattctactgtcccatgaatccatgtctccctgacggcaagtcggcaacccttagaaggtgagcgagctagcgaccgatttccgtttttgacggggctcggtgtgtcaggctcggtggattcagcttcggtgacattgatatggcaagtcaccggatgacataccgtgcatgtgagccatccaaaacgaatccaacgtctgctttagttgggcccgcacgcagggcaaaaaatcgccgttttcatccccgtaggccgtagcggagacgtactggcgggagacggcgcccccaattcctcatcgcgcgcgtccgcgagccagcggggagagtcgccgccaccgtgaccggagaggtgacattccgacgagctcaccacgagtgtggaggcggtcgggcggccgccgcgtgaggttggggccggggcctgccgtgccgccgtggccagaggcgcatggaggcgaccggccagaggcgcgtggaggcgacctggagtcgacgaggtccagccgcctcccggtgtggaagaggtgcgtgcgcggccctgtgtttcatcaattttgctgtgtgttcccctttcggttgggtgctttggctctgttgctcgattagtgctagctgttggattagctagcatatgttcagtagaattggcgagatgtaattagctagcatattttacagttggggaatgtgggctgcacttgtagagcgaactgagaagtagcagtaggaaataaataccagtaggaaataaatacatcagggtcctcgcgcagccaccggccggtccccttcctagtcgcggccgcctggcgcggcggcagcctgaggcgggcgaagggaagcgaaacggcgaggcggcctgccgccttttcgggctggcgcggggacggctgccaactagctcgcgggggcggcttgacgcgggcgaagggaagcaaagcgacgaggcggctgcccggtccccttcccactcgcggcggcgcggtggcctagcgcctctccggcctggcgcggggaggcggcgaccagagcacgtgagattggggcgagactgaaggagacgtcgtctagcagaaagggtagcgcgtggggtgaaaacggagtcctgcaggtgggctagcgcaccggaccgttggattagttttcaacgcctcagattgctccaatgtcacaccgtgccatgccatagcaaagtcaccgaatctgaatccgccttatccaccaacgaacccaccccaacccacaccgcgcacgcgcacgcgcaatcgcagcatcaccagcatggcgtcccacgcccactgcgcccccgccgccaacctctcgccgtccccgggcccgtgcctcccgctgcgcctgcgccgtcgcgaccgcgagctccctcgcccagctcgcgccgcgctccagcgccgtcacgccgtcggcattgtgcggacgaatcgccgccgcggcgccgtcgcctgcaggaggcggcgggtgcggcacgaggaggaggacgaggaggagtacgggcacaacgaggagatggcgcggttggagcggtacagcgagggcgcgcgcgaccaagcactcctcgtcaaggccagggtcgacgacgaggtggaggtcgtgctcgtcttcaaggtagaagcactgcactaccactggcagagctgttctatccatcctaaaataacccaatctaataaagcatgcgatatatcatactacactgatttggatagtcacatttcagcactataattttgaacagtatagatgtgttatattatatattagatttgtttattttaaaatgaggaaggacaatgattctaagtctaaattcagtttaggatgtgtaggtttatttattttattttagaatggaggaaggacggcaattcgcaatctaaataccacagtttaggatgtgtcatgttctctcagatttgttcattttagaaggaagaaagaatgtccgggaggcgattcggtgactgatctttctttaaatatagtttaagatgtgtcataattctcttagatttgtttattttagaaggaaagaaagaacgtccggaaggcgattcggtgactgattttttcttttgtgtgggcacagggattctcgtcgaggctgagcgggagaacggcggcggatccagcgatgagcgtgctgccggagagggcgatcatacagacggtggacgtggtgaggggcccgttcaatcccaccaacatcgagtacctggagaaggatcttccatgggacgacttcaagagccgcctccattagcaaaaaatgtagctctaccaagaatgcggatcctttcagttggcaacaaggcatctaaaatctctcatgatatatcagtggaggtgctaaatcaacaaagaatatatatatctgcattcatatcagtgtgatcccggaggaccagctcatcatcatcaacatcatacaaaaaggccaagatggccaaggaaatatacttgtctgacaaggtagaaaggacactcgcatgaaagaaaaaagaaagaaagaatagtgtacggatctccatgtgaatccagacgtaaatggaattagagcattctacggcaatgatctgtgtgtcgcagatgtatgtctatctcttccagctgtgacttcgctaaccgatcatttccacgcgactgagtcgatctcgttccgggcagatttgtacagctctagcctcttgactaaggaatccctcttctccatcaaagcgggatcctcatccaacatcgcgctgagctgtttcttctgcgttatggaaataaaaagcaaatggtgtccaagttaatataaatgtgcaaatcaatgcgacacaaggataaaacaagaaaattttcatttagccacaaatacagtgtacatatattttgaaatggatggttaatattttgaagtagagtgcaatttactcgatattaattatgagccaactttctaatcactatgaaacacgttatctttttttagttttgaactaaggtagtataaaacatacctccttgcttcccacatgagcatagaaacggttaagcaagtttctttttgcctccttcacttgacagtgcaccacagcttttggaatggtgttcctcaatgtctcacaaaccatgttaatgtaagatgatacatttgaccctgaataaaacaatgatgatgtcatgaatatactttgtcgatttaaaaaattagttcgcataattgttgtcatcgaaattcacatatggtcatatcttgacatgtttgctagtgtcagcactcagcagaacgtgaatggcactagtaccctatgttacatcttagattctgcttattaagtcagtttgttaagtacttcgtgtgacctctgtgttgaggtcttagaacagttgactcaatcaattgccattaaagaaacaaaatagaatgttgaattgttaccgattcttcttaaatggttgtcctgatatctgtcattggctggagtgttattattagcccccttatctggttctgtagggagttttctgaaaaattctacagttaggtagctggcctccatctcaacaagacgaataactgtctttcgaccatcctcacgaaatctttccaggctttcatttgctgcagcagctatatctgtctgaagtgttgggaaacgcttcaactcctgtggcatccaagataaccaatgtaaacagtcaatgcaggagtgtcattgagtgatcagtaatatctactgaggttcactgagaattgaaaatcaacacaaacctctgttgctgcaatcgatctacgaacaagttccttcaagaccaaatgaacctagcagatacgagaacataatcaaccagatgtagtgaacaaaacagacgtagtgcaatatggcttgacatatgaaaatgcccccaaaagcactggaatcaaatgccttcctttgttgaataaacaaatggtacattccaattaaatctatagtatccctctctttccgcaattgagcacttgatgaacttaagcactcttatattcactactttgacaagaagctcgtcatggttctgcaatcttctcatatgatgttttagttgttcaacacagggggaaaatgtatatattggataagaaaaggctagtttatgtaagtctatatatcagtcattggaacaggatcctacttgcttaataattaaattaaaagtgcctaaagaagatctattgatgagaagtataccgcatcaactgaagcttccgctggacccctgaagtagtggagcgaactatctataagccttctgtacccttgctcaggggcaatcaagtggggttgataaccatcagcctctgaaatgactttccgaacattttgcaatgaaagatgcttatcaaatggaagctttttcagtgctgctggtaattggtggtcaaagacaccataaatacgatctccacctggccgactaagagaacaaaaaataattgagtgttattaacatgcctgtagattctttgccattcatctatgggatactatttatcaatatatatggcataaaaagcaacagcactcaagaaaagggcctaataaaatatcttacccgccatctaggtgctctttaaaaactcggtcaaacgcacgacacatgtccaatattgtgtacagttgtgcctgtagattatgataagtttatgagacagcatgatgtagacatggtttgggaatagataatgtgctagggtgccattcaaatgaatgttgcaggttgtggcacgaacaacatgaacctgaacacttgcagaaagttacaacaagcaaagtacggtttttcttaccccagcatcacctccaattggcctaccaaggcgatccaactcagcttcaatttcatcaattgttttgttaatcatggctataatacttggaatttttgctctgatcacagcctctaagtgctgaatgtgtaaatagaagtgtatcagcagtcagccttttcaatccagttattttttggggagagggaaagtacaccacaatagcaaaatgccctgacctgagacagaagcttagcaaggtactctgcacccattttatgtgccaagtgaccataatctgggctactttcaaagtactccttttctttgcgtcttgctgctagcatgtcgacattcctgttgatatcagcttgtgaccggttgacaattcccacccaggggtgttgcaaacgatactgcctcccttcaagtacctaggattacatggcgttgaaaatgagtgctgtgtccatagcgtacaagagttaagaaaaaatgacaagtcacatacatcaacagcattggtacccttatccatcaaatcaagctttgtcaacactccaaaggttctgtcacctaaaaatattatgaaataaattgtcaacagataagaatggaacaagacagatcactgcaatactgctgtatggcaataaaataaaatatgcataaaattattgtcatatgtgagaaatatttgaaatgccacagtgaagaaaatataaaatgtacctgaaggatcaacatccctagcaagcttgatagcatctgatgttgctatatcttgattagctggagatatggccagtatgatagaatttggctgaagtttccaaaaagaacaaatgtaggaacaaaaatgaacagttttaatcagaacatgaccaagcagaatttgcagcatatagaaatacattaagttatattagcatgaccataagacaggccagagaacaaaagaataatgtttctagacttgactcgtagtacccactacccaccccagaaaaaaaaactgtcaccacaaataaacattggacaagaacaatagtaaagcttagaattgatatggcagggtggacagtactcattaagtgaatgtagcacatggagctaaaataaacatggcactaatggcatgcaacagacttcttttaccttatcaacataagaccgaaccatgttttcaatatcttggacaatagattcttgttgcccctctgttaataaaaagttcgtgtcacaaacaatcacataaaaagagtacgcatagaaaactagaagcatccaagaaaacatacctacagcaaccttcgtcaatccaggaagatcaataagtgtcaggtttacaactgcaagaaaatgggtgcaaaattacattagtgaaaaaatttatgacaaggactaggatctgctgagcacaaaacgtctctatataacaggtcatatgctgcagcacaagcacaatgtaactactttcaaattatcataatatgattatttgttcctcagggttaagaaatagatttccagaatgattccttttatgtacaccttttgaattgtttctatagtcaatattttgatgcttaattttgttgcatataaagcagggtcgattattaatatcaaacatgaaattttgaagtgctaatataaatctgcagagatgcctcatacagtttggtgtgattagtctgaaaggaccacaatggaggggtttagaccaacatcagaactaagaacaggtggagagcagagcaaatatacattttttttaaaggaaacatatgccagctctcaagttttgaagaattataagggataaatcctgaaaggaatccaaatttaaaaatgtaaaagtaatagtagaaattatcagtctacatcctattgatcccaaatttcatccacaacatacaatttaaagtttacaggcatttgggggagctgagagcgagtcagcgaagcaggttctgtttgaatgaaacattcatagtacacatcacataccaaaagttcaaaacaagcatcaagacttaccatgtggagaatatatactcaaatggatgggaatatttgatatagctttcgtttttccagtaatgcgatcggtttcatcagcaatctctttcctaacagcagctgcaattatacaaagaatttaaatatttcaactgaacatctcttgcaatagctatgttaggacactagtaatgaaccgggaaataactttgctcagatactcactagtatcctacagtgattgtgacttgtgagatctactcctaaacgtcattagttccttagttcacactgcatatagcaatgtgtggatgctaattgtatatgttcttgtttttaggttgataggcaaacttcagtgaagtaaactataaccagggaaagcggtatcatcctccttgctgatctctcgtggaaaagtctactcgttggaattaagacaactttgaagtttgcacaacactaactctaataaatgaaattgaatacacaaatcaacctgctggactgcaaagcacaaatatggcaatgatcccttaccaaagtcagtgaaacgcttccgcggggcgtggaggaactcggcgtactcctgcccaccctccgtcttgtgcagctgcagcacaagaggcctcctcgtcacgattcctaatcaaaccgagagaatgcgcattaatccctcgcaaaccaagccgatccagacgaaatggcgcgcgaaaaaagaaaaaaaaacgagcgatccagcgtcggcattaccggatccacgaggcaggaagtccctccccactatgctctcgagcaccgacgacttcccggaactctggatgcatcacaaacgcaaaccgaaggggggtgagcgccatatccagatctggccgccatggctttggatctgagaggtaggtacgcagggtggtggcgagcacgcgtacctggcctccgacgacggcgacggagggcagcgcctcccagagggaacccccctcgccgccgcccccgtggtcgccgaggacggtgcacgcccgctggatccggttcaccagcccgatcaggctccccatcgtcgccatctcgggcaaagcccccaaccgcctacccgcccaacggctctgcgcgacgtcgctgtagtctccggctcaccggcggctcaccggagcacggcggcggcggcggcggtggagggtgggatctaccggagagtggagaagcggaggcgagagaaatcgaaggaaaaattttttttagtaccagcggattttgaaagcgaggcctatgtaagcttcgcgaggagggtggtggtgatgacgaacgctgcgtggaccgggtgttggtgcaccgggatgtgtgagccgggtcactgcatgtggggccagggttgcagaggaggactgcaggtgggccccagggagtgggagagcagaggaggcgtgggggtaggggaggtttgggtggaccgggtgcatgggacggaagccgttggattcgcgttgggagggagccgacggggggagtggtggtgggaccatgatgtctggtgcgtgacgcgtgagccgcaccttacctgggaggctggagcgtgcgctcacgttggatggggaatcgacggtcacggtgagatcggctaacgttcggaaacagccgagaggagtggcgaaagagaggaactacctccctacaaaatattggagctttcttatatcttactattattagcttcgttctaaaatataatattttttaaattatttaattaaaactaagattaagaaagaaaactttagtattatgaatactaagataagatgagaaaacatttgaatgggtgataattaatagaacaaatactattatgaatagtgcagcaaaccaatttcatatcatcttaccttatattatcacaatctcaaatatagttacttttgggttatgtaggtggacaagcatttgtccaagtataaaaccaaaagttctcgaggaattagaactaatggcccttttatttggaggaaaccataataattttggaggatttcaaccctatggagaaatttcctatgacctttgaaacaaaggattgaatcatatcatatcctttaaaatttctatagaatgaacaatcctatcagaatcttatgttttgcacttgtattcctaccataattttgtgtttttcctatccctccgtttttccattcctacaattcaaagaagctctaaaggaatgctctagatcaactgtttagatgccatacggtaagagagaagcataagcgtaactccaacaaactatctatcttactcttcgaagcaaaatttgacaaacttagataaaaaaatcctcgaacaaacttgccaagccaaatgagtggccaaaattctcacttggatggccaaatctaacaagttgatagcctcatcggttgtccatatccctagtaagtcgttttggcttactagggaataaaaattaatttaaaggtaaaatttttatacatttgttcgtagcgatttaagttaatataaaaagaaattacgttgaaaatatcttaaaatcaagttaaaaaattcaaattttggcttttgttttgactcattaggccgaccgatggggcacacctcccccaccttctctcttccctcccccatccctctcaagcacaacatataggtcccactgtcacaaactcaacggagggtgtagatggagaggttggagcacaaatgaaatatggagaggaaattttttttatcaacttgccaaatgtggagatggagagtttgatttgggtatgctgttggagatgctcttaggtgaagatctcatgtttatttcctaagaattcaaatagagctcatctcatatcatagggacttcagtttcaaaccctccaaaattatttccttcgttctagaggagccataaactcggaacgatgtggttccaagaggggaggaacgggaagggcaattaggatcaaattagccataattagtgatatgccatgccattctattgctcaatggaagcataggcattagctgggggagccattgcccattggtcaaagaaagcaaagagaagagccaatccaagagtaatatatctgcatccattttccattgttagatacaaactctaaaaagggggagataagtaaaccatttccattatctaatggggagataggaaccacagacataacatgacccagagttacgtgaatacaaacttattatcattattcggcagattcttggtgaagtacaacagagaatcagatcaataagtacaacacatacattacattacatactcaacacatcaacaaatggcacacccaaaattctggagtacataaatagatgaggcgacgcctttattccaaaagatgaagcaaatgaccctactacctgaatggatcgatcttggtaagcctcaccaacttatgggagcaaaggaactttaacagtcggtccggttttgattcgagtcagtggcattagatcttcggatcgcgcaagaggagccggtatatctcgttgttctgctccgacatgtactcgtacccaagattgtcagcacggctcttgaattcgtcaaactcctccggcggcacttgtatgccaaccaaaacattcgctccggtttcaccctgcagatgataatttacgtatatgctggagttcactaagatgtttaagggttttgcaagttcggcagaactaatgtaaccaatatgttaagtctcaacacaatttagatgtacatttttgtcaagtgaaaatggaaagggaatattgtacaggatagatggcaataaaatgacgatttcagatgcatgagattgcaattttcatacaagactactttacagcagggaaactgatgaataataaatctgtcacacacctgtgcacggtaatggaaaaggctgatattccagcgggggctgaatgcatccaaaaatttcataagtgcaccaggcctttctgggaaaatgaaccggtaaacaagttcatctgttacttctgacctgccaccaatctgaaaatagatggaaaggaaaagcaaattaaggtagccgcatatttgaatataaacaaattaaaagaacaccatcccttaagatcagctgcaacaaaatttagcagaggttcacaaaattaacttggacatatctgtgttttgggaggtaattttttttatttgaatcacaaggcaaaaccagaggcacggacatatgattgactgctttgtgcaccaaacaagttcttatttacaatgtagcagttgataatttcatcaatttatctgcagccttttcaactggaacatctctataaaaccagttgtaacatgtttgcatgcacaaattcagtaatgaattttatggcacttgcaatgctatcactgaggatgtttagggacctagatgaaactgtagacacgtttaatcactgttagtgtcatttactctaaaagtgattagatttagtttccaaaaaaatgtgtggcattgttataaaattggcagagaaatccaacttacaaagtatcttagatgatcctttgccaaatcattgtcagtaagatcaacagttctcaattttgaagattccatacgttccaccattgctttaagttcatcgtcagtgtagatgccaacactgggatatataaaatcaaagcaatcgtatagttagccaggagcccaagaatataaaagagcaagggacgccatattctttccataaataagtgtcaacagaaaatagtaaagaaattatatgttggatagtgagcccaaagatccttgatgttaatgcacaatgctattaacatattagtgtccatgtacctgtaaaggacaagggcatcttttgcattgcaatcgtatctgtatttgaattcagtaatattcatccggccaacctgcagagagttggaagaaaagaaatgaaattagaagttgcaaatttttacatattggtagaaataccgcaaggcataccagctctgcaaactttttgaagcttccctgctcctctggcaaaaatgtggcaagaactgcttctcgttttcgaccaacatcagccagctcagttactaatctgagccgatcaaagttcatatttgctccactagttattgcaacaacattttcccctttcaagccatagtatttgcagtaagcttcagctcctgccagcgcaagggcaccagcaggttcaagtatgcttcttttctcctcaaacatatcctgcagccatgaccaaaaaaaattatagggcagaaccgcagaagcattataagggtaagattggaatatagcagtagtccgatcatagattcctagcaccctataaagaatgtcaatggaataggattatacattagttgaaaaccaatgcccacaagcaactcacaaaaaactaggctagtgtacaacatttataagacatgtccgctacagagggttttgaacaagtaatctttttaaactatggagcatagtattcacagaccactgcaatatagaattttgatgcaggaaaccggtgtatatttctttttcttttattgaaaccagtacctttaatggagcagttgggatttaagttagttgagagaaacaggttagtgttcagttttaacaacaatctaaaatattatgtaaaacaagacacaaataatcgtgagttcatacctttattgaagcacaaatagcatctcgactgacaagaacaataccatctacaagttcccggcacaagcgaaatgtttcctcccctacaactttgacagccacaccatcagcaaacccaccaacttgctccagcatgaccctttgaccatgacacaaggacaatgccattgcatttgcatctgatggctccactccaattattttcacctgtagaagagctgctgtaaaatatacagaacattccatcccaacctgactagagtgcaacaatgcaatgaaacacatatattaattgcaacactgataacagctacaactaggtccgaaaaacaacttaataccccccaatttgggcttaaaactattgccatgctccatgatgacatttataaagaggtttgtttcctcttgcattaaaaaaacgaacttggccccaaagggaaagacctcccaaggtattataattaagaagcacctgaaactagaccgaaaatggtcatgaaagccagcccctccctgtggatcagtccttaacccgtgctttgaggcttaaagaaaactagtctagaaaaataggaagctaacctctgggcgaaccctttttacataggcagcgatcccagcaattaatccacctcctcctacaggtacaaatatggcatgaagtgggccttgcaactgccgaacaatttccatgccaatcgttccttgtccacttataacatcaggatggtcaaaaggaggtatgaatgtgcggccttcctgctcgcatctttgttttgcatatgattgagcttcatcatatgagtcccctttgagtacaactgttgcacccaatctctccaccgatcgccactagaattcaaaacaataggtttactatgtaatgagcaaaaggtaagataaatcacatagaaggacaggcttaaagtgatgaaatctgcagatcaagaaccttgatttcaggcgttgtcacaggcatgacaataacagcatcgcaaccgagtctttgagcggaaagggccactccctgggcatggttcccagcagaggagcagatgacacccctctccaactgttcacgcgagagctttgccatcatattgtatgctcctctcaacttgaatgagaatacctacacaacaagtaaccaaaattatatctggccagtaaaactgccaattgtactgtcagaagtcagaagagcaatatatgtaaagctacagaaaactaatgctaaagtagaaactaatgctaaagtagaaattgcgtgtacttctcaaatttcaatcaacatgaaactagcattcaataacattaaaaaaacagtagacaattatgaaaaacaataacaataacgaacaatacatgtacagtgcatgtgtatagagagataattaaatatgcaatcaaggatatccccttggtgctattgctatgtcaatattttcttattattttgaatgaacaggcaggagaactgccaattatactgataaagcaggagcaaataaaataaacagaaggcataacaccaatacatcatgctagtcaatgacaatgataatgacggtagaaagtccttcaggtatatcagagtatgaacaaactttcacgttccttgaaggcttgaaacgggtagcccatccatgaaacataataagttcaaaactttgataagactccaacaaaacccaagcgcctaaacctgatgactctacattcctcagtttaatattagcgcagatgaacaaaacattgtactccccccgtccctaaatatttgacgccgttgacttttttaaacatgtttgaccgttcgtcatgttcaaaaaatttaagtaattattaattcttttcctatcatttgattcattgttaaatataattttatgtatacatatagttttacatatttcacaaaagtttttgaataagacgaacggttaaacatgtataaaaaaaaatcaactgcgtcggagggagtattttccatacaggaacatcaaacaagcaccctacgagtcaataccctgtccagcactgaaagtgcactcatctcaaaatttcagcaatcaataggatgtaactatacaaaatcccttaaaaattgacacgataagaaccctgtaaattaaatgtccaaccaggagtattggttataagttgatgaaaaacatttaaaattaaaccaatttgagaacaaaaattcacaaagaagaacgagcaaaagcaaaacacccttaaacctctattaccccgagaaagtttgacagcaacgtgtccaagcgaaggtggacaactaaagaaaatatcccaatacttatccaacaatcaaagaatccagagaatccaaacattctattcaagcccactgaaaacaacacaacacaccgattccgaggtaaaaacccccccgaaaacccctaaacttatcgaacgaatgttctatctaattacacgattgtgacgatggacaatgccaaatcan

SEQ ID NO: 4178 - DNA, 8030 bp, Oryza sativa
  unsure (1)..(8030): unsure at all n locations
cccatcgcggcatccggtgaagaagcggtaaagccaacatccgctgcaacgcgcgtggaatgcttgcgccggcgcgcgctcgtcacgcggcggttgaaggtgaaggtgccactgcccgcgcgggtggcggcggccgccatggtggtgttgttgttggtgcacgggagtcggcggctgtatttggggtggggtgcgtcactagtcacagtagggtgggcaagggcaaggcgtagcatgggaatggaattgattatatgatgtggcacgggcgaccgggcggggcgggacgaacgactggatccttcacgttttaggccctgtttggataggaagcacacaaaaattggcctgtttggtgggagtttaaaattctgagaaacaattggttggtaaccagcttctaagaatctggaaaagctggaaaatccagtttctagcttatagttcattttttggattatacatttacagcttctcagaatcgagaccaaaagctatactgtttgagggagcttctgattctgggagaagttgcagcagctagaaactaatatttctgtgagagccattcaaacaacccattagactgtgtttagtttctgaaattagggagaagtttggggaaagttggtagtttggaaagaaaaagttgggagtttatgtgagtaggaaggttttggatgtgatatgatgtgatgaaaagttgggagtttgggggaagtttggtgtgaactaaatagggccttagtcttttttctaaaatataaaagttattttacatattgatccttaaaaaaaacctatataagtataagactttagctcggcaccaaagttattggcgcgcaggttaaatgagttgacctaacgatattgtcgctgacagagttgggtatttagctatttggcatcgaccaccagtgattcagtttcgtgccaacggttgtagttttggcatcaacacgtttaatgttggtaccaacgactctagcgttgagccaggatttgtcatgggataagtttctttcaattgtttaaaagagagggttaatgttttaagaggtgtattagcttttcagtgccgaccacctagtgacttaagttacctttggtatcaagacatcaaatgtatgcattatcaaccccagcgttaagttagaggttagtaattgttaggataaacttttctaaggtctatttacaaaataaattttataaaagggctaaaatgtcataaatctaggagcgggcgatgtggagtggggcccgatggcgggagatcgggggattcctggtccgcgcctttttctttccttttcttgtgtggcttttgtggcgtcgttttcctgcgcgggccggaaccatgtttaacacaagctctttttttttctttttagttttgtttaagtttaacccaaacaattgagctaatgaatgatgacgtgtgtggaagaagtcggtcagtacggccgtttgtgcaggagtacgcaggaacgagcagcactttagtacgtacgtacctgtggttcgatacggtatttttgcttgagtgaagcgtcaaacgattaattggccgacctaaaccgtctaatatcatattgactatcgggttaggaataacactattctctaagcttaggtatatacgctatcgttatgtaatattgtggcattattatattgcttccgtagttaggcaaggccgtagtagacatatttttattagtacttggtgagtactccctcaattctaaaatgtatgacaccgttaatttttttcacaatatttcactatttgttttattaaaataaattagtataaatatgtaaaagtataagttaaaattatattttatttaatgataaattaagttataatatatacaaatattttaaataagacaaataattaaatgttataaaaaaattaacggcgccatatattttgaaatggaaggagtactaaaactgatgtttacaacacgaacgacataatgtgtctaaaatatctctgaaactgaccaaccgcaaattattgtagtccgctccgaatctgaagtagaactacaattttttgcgccgttaacgcccagctgcacaataacactgggtagcttgcagggccgaatcttgttcacgtgacagtgcacgtttgcacgatattttacatgcaggctcgatggtttgttatacaggtgcacgcggaacacgaacagggtagcctgacgaattaagtctaatctaagattagcatcttggtcggtttcggttggcgtgttttgtcgtaattagcttttcaagtcgtatgtggactgtggagtaaactaccactaccatctctcaaaaagaggtcgtatataaccatttataccacgaagagagagctgcttttgtaacaaatctcacatcctcgagcagctatttgctcgacacacgatggaatgcacttacgccgaacgcacgctgttttgaacgcttcgcaaggtcatatataaccatggcaaatgagaatgcacatgttgataattacagtagattgcatggcaagcgtccatgtttatcatttgtgaaaacagaaagtttagttgtgatgcaagacgtaaagattcacgcattcattaacaccatggcacgttgggacggacaaaaccttgcccgggcactcatttagaacacgttttttagaaataaacaaaaaaaaagggggttcaattctcgcaagaacagaaagcttttcaaaatttccaacgaaacagtttacctgggctccatttggacggacgctgatgtccgtgactcctacaccgtttcactgatgaaacgtgcggttggccccagcctctggcatccaatcagcacttcagcagtacagctgcaacctacagcaaaaaggggcaacactggagttggattacagtataacgtcaccgcaaaaacatttccatggttttaaacaagtttgggtcagaacttaaggacatggatcctctgcattactgcacctgccgtagcaatggctgataggtgagtccgatcccccatgtcagcgacaattactacaggtgcagtaatgtagaggatccccactgtagaacttaaaaaactgggcagactcaatcttcaagtgaatttttgttctgtccactttgaagtttttacatcgatccagatagatgatgctacttgtttagacaagaatataaaaaacagcagtgaaatagatgtatagagtagctacttcagaaatatatgatccaccctaaaaaaataaatatatatatgatccagggtacggtgagcaccttgagagtagcagaatagaaatgtttcgagaatagtacacttcaagagcacgttcacattgtgctcggtaatgtacaggataacaggacacaatcccttgcatccctctgtgcctattcaagtgccaaaaatgccaaacatgcgatagcattggcaatatgtatgcttgagctctccactggtccacttcgtattaagttcacaactaataactactgtacagcatagaggtcccccaaataaatggttacaaactacacaagaattttaatcccaaaatctatctttctacccacatacatatagttatctaggagtatttgaaagtatacacaaaaggtgtttatggttaattccagagcaactcatcaatggtcatctcaacatgttaaagcaataaatccaagattcataggtatatcttactgcacagataaaaaaaaagaagaagtatctttctgttctaacatccaaggttcctcaatttattgtacgtatgctgggagaaatccactatcaatttatcatgggcgtatgcagggggacctataagattcatcaaagattaatcctaaataaacttgaaccaagagttacactaaagctctagctacatagtatgatgattaatttgctaatcaactgggatggccagttttcttaagctctagcaaattgctctgttgatttttttttttggttaaaacaccgtgttttcttgaaaaaaaaactagcataatttcctatgcaacacagatgttaacaagaattaaacagtacaaacgatgcaaattgcattgattcttcctagccatggcagcacaggcaacacattagctagaagttacaaacaaacatccaaacccacaacttcatgtcatccaaatgaccaaatcatgctttggaactgccaaaacatgaaacgagtcaattaaaattaagagaaagaaagaacaatgtgaaataaatcaaagataacagaaaatagtgcagacagcttagcttacacagttgcagttgccctttgttatgaaaccagagagcttttttttttaaattttttttgcatccatcacactgccatataaaaaattttcaatagctggtatatcagtatctgcaagcttagtaactcaaccattggcctaaccattgttaacaactcaacagcaatatgaacacccttccagaagctatgggatctaacaatcttacaagatagctttcatttatcgttcatacaagaaacgagaagtccacaaccatttagctcatgaaatccaaacaactgttaaatttaaaatgtccagtggcaaacaagtaacaggagtatgagcatagacaattggtgattacctttgccttgaaggttatgttagtcacactttaggtgtagcccaatatcttctagcatgaggtcgctgatgtgggctgtgtaattgtgccaatataattgttgttgctttaacatcaacaatgcccatggtctggtttgctcttcttgtttcagtggccatttgacagcttttttctcacctaatttttcaatacaatcatcaattagctccacaatcatccttatcaactgaggcatcaacaatcaagacaacaaaccgcataaagcaaatttattacctcagaagtggccaaccatgcccatagcctgtcaaaaagctcatagaaaatcagaacctttaaatttcaaccatggccaccaattggttccagcagactgtgaaacctaagcaatgttactatattaaatggagcatcagcttcacagaccaaatgagcaatatatcaacaagtacaatctctcttctctaattttgcttttgtggtcggtgaactgcatcgtctctctaggacctgctcttcttgactcttctgacttgaagtttgattgatgtgataatgaacgtgacctggttgacgaggcaaagctgcactgggaataaaaggactaaacactttaataacactcagcagacaagaattaagattattttgtctagaatctatacaagagacttggatagacaagtatattctagagcagaagagcttagaggaaagattagagcatcaatttcagaactcaataaattaaatgactaaataagaaatattagcttcatggttacaagaaagatgcaaaatgtacaccaagagggggttctcctattgtatatgtggatacttggctggctttagtgggcctaatttcaaaatatctaaccgcatgaaaaaaacaaggaacaattgcttatttgaccctgttttgaaaaaaacaatgaatatcgatgatatatcatgcatggcacattggcgcaacacaatatatcatcaataaagatgataaacagctacaatattgtatatatccttctagcgctggtccctttaagatgctaaataatgctatagcacatcacatgtcaccattatttgcaagtatgtatgccaattatccattcatgtaaaaatggaagggaaccaggtcaagcatctaaggggagaaaacttaaaactggataggtcagcacaatgaaaagcactgatgaccaatcctaagatgacaatgttcatgcacatctggacatttcaaaaaaataaatatcacttctagaattgtaagtgtatgtgtatgtgtaacaccacaatttgtatgaacaaaaacagatcccagttatccgatattttaaccattcttcgaaggaattttcacttcttcagtagataagcgtgatcaagtaactacaactatccctatacatacattacatttccatttatcagatgttcatatgataagctctcaaaagataatgaatcaaaattcgaccaaaatttattctaaaatttaaataaaatactgcaaaatgtaccttgtggagttttaaatccactctctcaaatgtcatctggccaaacacctgtcttaataagtgatgtttggtatttcatcacgtcatctaggctgctgccttttcttttcaatctccttatcaaggaaaaccaatattgtttccgtggcatagttcggagcaattccttctgcaatcatcttcctcaaatacttgtcagcttcctttaatctaccagcttttgcattaatattgatcaaggtattaaaagtgacaacatctggttttatgcccctcccaattatctgctcaagcaaagagtttgcttcgtcaaccttcccggcctttcccaattgattgatcaatgtgttatacatgacgatgtccatgtaaacacctttctttgacagttcactaataatcgagccagcaacctctgcttttcccatctgaccaaggccttgaatgatcagattgtatgtagctatatcattggggcagagctgtccacctctctcatgaagaattgcccatacctgtttcaaataccctttcttgacaaatgacgtcatcaatgaattgtatgtataactcgttcctttccttcccagagttgtgaagatctcaaacaacttgcaagctacactcaacttccctttcgctaaaaaaattgacatatatgtattaaccatgtcagcatcaaatgtcttggctcccataccttgcaccctctgccctctgtcaattgtgaatatagcagaactattcaaatgatcagcatgtttagcaagatgatctaggtgcggtgacaaagaccaatcatccttgggctcatcttttggtgtttcttcatttgcaccagtgcataccacgggattgaccaaactcatcacatcatcaatattgccatcaaagggaaaaattgatgttccatctttctctctgtcctgtggtccttgcaaagcagacatcatatttgatttccatcgaatagcatctggcaacacagaactatctctaatgaacttaactatctgctcttccaagtcccaacgtctactcttgttaaaccctatgagcaatgatgttactgtgaccaaatcaacagcaaaccctcgctcctccatttccttcattaactctaccgcctccgcaacttggtcccccttcccttccttgcaaaactccctcaccataatactatatgcaatcccatccaacagttggccttttctccttagatcataaaacagccggcacgctgcttctgctctcccattcttgaatagcccatcaatcactgtgttgtgtgtgcttgctgagcattgaataccatccgccaccattgtctcaaaaaaaccgcatgcctcatccagcttcttagctttgaaaagcccatccagaagcgaattgtacaccacagcatcccccttcaccccatagctccctcgcatctcctggaacaaacgcaaagcatcatccatcctaaaactcttgcagcacccatccacgatagcccggtaggtgaacacatccggttcaatcccaaatgacttcatctcatcatacaccactaaagcatcagcgacccttgcaccaaccacaagcgcacggatgagcgaattgtgtgtgcatatgtctggcacaagaggaggagaggcggtcttcatagcagcaaaaagctttagcgacatatccagcctcctccacttgccaaacgcgtggatgcaaatgttgtagaaccttatgttagaagggaggcccctcctcgacatttcgccgaacacgtgacggaagtcatcgtagannnnnnnnnnnnnnnnnnnnnnntatagtngtgtgatactatcngggcgcacg

SEQ ID NO: 4179 - DNA, 4546 bp, Oryza sativa
  unsure (1)..(4546): unsure at all n locations
naacagatgggtggtggaccgctgtttgngcnnnnnnnnnnnnnnnnnnnnnnnnnnnnnnnnnnnnnnnnnnnnnnnnnnnnncggccccggccctggccgccgccgccgacgcgaggccgcggatcggcgcgcgccacatcacgcacgcgaccaccgcgccgcgcgccgccgcctccccgccgctgccgctgccggcgtgcgtgcgtgcgtgcgctccgcgtggtggcgcggtccgcggtgaagcgacggtgcgcgaccgcggccaaggcagaatggctatgttgttgggccgttgcgcggctcgttggctgggccgcgtgttgggctctggtgaacgcgtggtgcagttaggccgtgatccgtggactttgactcgagtcgtgtgatctgaagaaaatcgcgggggaatatcctcgcgattcgcgaagattcaagcggagccacgcgttgctgcttggtgagcagcacactcgcgcttggcttcttactccactcgacgactgatggaataagggcgagtactgtaatgccccatatattatctctaatggtatcacctatctattttataaataaggtgtagatcctgtgtcagtaggtattagttattgttgtagtcacaatagtaaaaaacaaaagtgggtagtaagctggaccccacaatcgctcgctacgagagaaatcatttgtttattccttatgactaggtagtaagaataatgcctggtattagttacttaccggaaatgctacttggcgatcgctagcttagagtgaccgggtagcccccccctcctcccttaccttttttggcaccgcattacttttctattttagtaaatatatgcacctaaagtttatacaactcaagtttacacatctaaagtttagagaccaaaagtatataagtcaaaagtttatatatccgattcaaatttgaatttaaattcaaatattttttatatatatagtatttctatacatctaaagtttatacacctaaagtttatatatccgattcaaatttgaatttgaattatatcctatttaaatttgaatttgaattcaaatatcctattcaaatttgaatttgaattcaaatatttttcatatatagtatttctatgcatctaaagtttatacacctaaagtttatatacccgattcaaatttgaatttaaattatatccaattcaaatttgaattcaaatattatatatatatagtatttctatacatctaaagtttatacacctaaagtttatagacccaaagtttataagtaaaaagtttacatacccgattcaagtttgaatttgaattcaaattttttatacataattttttctaacttttgtttttttaaattttttttgtggtgtactgtaataggaaaggaatgggaggaggaaggggagaagggagcgggaggtgggaccgatcgttgggcgatcgcccattaggccccccgttacttaccactcccacaatgtatacaacctggtagtaaggagtattttattccttactacccactttagatgcacattatggatgccctaagagtgtcatattggattgagtaataaggtggagaaaagaagtgaggagagagataatgagccacccctaaaccaagagacaacctccacacaaaattcaagaagggtgtgagagtattagatatattggtatttgtgaactagatgtgatgtatcgtatgggttgtctcttagttcataagtgaatagaatagataaatttataggtgttagtcacatatatcatagcacttgcccttaactagggtatttgccactcttacaagtggttctagatgattttttattggacccatatgttatagacacatggagacccatatgtcatggacaacgagagagaaatcattaattggcacatcttaaagtgacaaataattaaatctcccacgactgattgtcattcaatagcggttttatcgcgggtgcatttttcaagtttttaaacggtaagaaatttaaactatatttctatatattttcaaaaatctatttttaaaattttgaatatccaacttattcgtttgtgttccaggcaggagtactgcatttccgtgccgaccggcgaccggcgaccggactgggcaccgctctgtttgctagtggacggcgccataccgcttgatctagataagctttccaggcgaaacggcagagatggaagataagcaaagttggatagatcgatctgtggaatcgcttctcagctctcacacgtatgcacataagtcaccagctcaccatgggcctatttggctttctaccctactaattaattggtagtcctaaaatctagtcaaattttggcactaccaattttttgatagggcaaagttaactagtctatgtttggtttaataccaatataaaaccaaaatttagtataagagtgaagaagattctagaatgtagccaaattaagcgtgggccctattaattatttggcttcaattcaaactaacatgtttactattaaatttaccaaaattttggtagggtcacgttttatcttcgatataaaacttcacggcgtattgttaagaaagaaaaatcttccagtgatacctgtcggtagtcacgctatatttcaaaaggaaaaaagaaacaaaaacgtgcatcatatcattacatttccagcaaaagaaaaaaaaaaggacaagccaaaaccatgcatgtactgtcggccactatacaaaggagagggaagagaaaaacttggcatcctcttcttcccgcttgcttaagtgcaaccatcgcggttaagtacagtgctcgacaaggcacctatttacgtaggacgttgcacacacgtatgatatcgccgtcttgtaagctttatacaagagagagcgcgcacgcattgaccaactttcaatccccggtcttcttcgcggctaggaagatttttctttcttaacaacacgccgtgaagttctatattatagagcaataagaaaaataatcttctaaacgacgtctttgaaaaggatacgatattgagaatgctgccaccacacgtattagggtgacaggatgtggttttcatctaaaaaaatccattagagggtaggaaagatcactcaacaacgcctcaagagaaaagctgtaggtgcccgtgagcgtcggcgttgctggcccgaagagactaggctttcacctgtaaccctcctaccccttgtgtcgagatcgcttactgtacacagaagccaccatcaactacactccttcgatgcacagacactgcgccagcacctcaccaccagccgaccatcaaatagaagctcgacattcgacgcgttcaaatccatcaagataagtagaagagggagagggtgagagaaaaatagaaccctctccctcgcactagttttcaaacgtggtcattttgtgatgccaaggcaccgcctcaagagaactagcgtcttgatcgggactcaccataggcctgcaacgtccacgtcacggcgctattgtcatagccaccttgactagactgcacgtgtcatcataggccgtctgtctacatcgccgtcacctcgacctattgctccttagcgccactggaactacagccagagcaccgtctgccactctagctcagttgccgttggttgcggcctcccgtcgcccacgcctcaccactctcaacgccgtcaccgcatcggcctcttaccgttgatgggtgtgccaacctctacgcatgtaggaagatcgaccaaatcttctgttaatatagtagtagtgactgatatgtgaatccgaatccatatgttagtatgtactattgtaccaataatactgcagataatccctaccaatttttcagtgttcgagaattgaaaccggaaaggaggacaagcgaccagaggtgatggcgcagagccaacaagtggaagataacctgctgatcgatcgatcaccgggcggtgttaggttgcctcgttgaaaagcttctggaatttgtactgtctagtccatctggcgtgtactttagaccggccttttcccctgtctcgatggttccgtgatactactaataatccaacatgctaatctctatcagtacaaagattaacgcgtcactaaaaaggccagctcattcaagatgagcatcccgttgtcttatcaatcgatcggttcatcctttgccgtgcatatccgtcaggtactagatcttgttctctctttctttcttcttttctttccattattccatacaattaagcagagaaaattgtctcgacattcaaaagcttaaactacccacgaatacggacagcaagtagtagtacattcaagtcccattttttgatcaggtggttgccgaaaagcgaactgaagttggcacaaaagtactactcctatgtacgccactgactcatcgtgactgaggacaagacaaaccgtacgcgcatcatccccaaatcccgagattttcacagcgaaagtcagcacatcaaagaggcacgcagcccacaccn

SEQ ID NO: 4180 - DNA, 22708 bp, Oryza sativa
  unsure (1)..(22708): unsure at all n locations
gccgtgtaatcactgttataagncactncagcnngtgccgataaaggccgcaaaaaccggccctaatttttttttttttttgtgattgcctttcaggtatttcactgacgccctttgatttttttttattaggcgtgtttatttgtgagtaagttgtttaaagagatcatgaactgcatgtttctacaggttcttgatttgattataggattcatctaattctgaatcatcatcaattccttttcatggttgttctcctagtctccttatcccagaatgccggatctttacttagtattttacatttaaaagaggttaatcacgtaagcatgttgtttatacttaccaatctgctcctaatcacaccatgtgttcccataattcagggttggtggtactgggatggatgtgaggagcaaagccagagtacaaacactctctttacaccctgatatatatatcctttaatccttctcttgatatctgaaaacttggagcaatgacccagtaattacctgaaagttgttgtgacttgtgattactgcctctgatcagacgttgtctggacctgttgatgacccaagcaagcttccaaagtggaactttgatggcttcagcaccggtcaggctaccggtgacgacagtgaagtcatcctccagtatgcttcttgtttgtactctttgatttgattacaccttggtgtgtgtgcattacactgatgtacctttcacatttttgtgacaagccctcaagccatcttcagagacccattcagaaagggaaagaacatcctggtagaagaattttttcccctcttttctgattcatagttacaaaaagcttctggcatgaatttttgttcatgattcctttttaaccatgctgtaaatgtaggtcatgtgtgactgttatgcgccgaatggcgagccgattccgacgaacaaccggtacaatgcagcaaggatcttcagtcatcctgatgtcaaggctgaagagccatggtcagtatatatctttgttattcagagatgtaatcctgatgtcaaatggaacttatgttggttgccaaatcaaaaatcaggtatgggattgagcaggagtacacccttcttcagaagcacatcaactggcctcttggctggccactaggtggctatccaggccctcaggtaattctgaacttcttatacactttcagtattgcatctcaaccacaacaaatttcttctcttgttttttcaaactagagaaatttatcagttattattgtcctttttatgttaaaataccagttgttacctaaatcattaacaaggaagagaagaattacatttacatactgaattttattcatttcacttgctgataacctgaccagcaatgtttgctagtcaatttttttaaaaacataatggaaatggtttacatcttcggcactgaatcttgaacaacgaaaatggtgtgatagggtccgtactactgtgcggcgggagccgataaatcgtacgggcgcgacatcgttgatgcccactacaaggcctgcctgtttgccggcatcaacatcagcgggatcaacgcagaagtcatgccggggcaggtagaacacatttctgaattctgcacacctcgcgtttctgtgccatttttttcccgacactttgtccatgagctgatcatgcgtttgatgtgcgattttgtgagcagtgggagttccagattggccctgtcgttggcgtctccgcaggggatcatgtctgggtggcacgctacattcttgaggtagactgaaaaaacaaacgtacaaaatctgaacacatggatttcgctggaaaattttgattccatcatctttttttttacattttttaacctttggaatcctgcaaaattcttgcattggttttttttttttgggctgataagacatgctcttctttggattacagaggatcactgagattgctggcgtcgtcgtgtccttcgaccccaagcccattccggtgaacacacacatttcaccaaacattttcaatctgatctgctcactgattctcattgcacataaacatgtcatctctgaatctgtatgaacatacgctgcagggagactggaatggcgccggtgctcacaccaactacaggtaagcaagaaatcatcttcaaatcctgcaaaataagataaaaaatcacctgcatttctgcaaaatcccgtgctgcaatgtgagtatgtgacctgcggttgcagcaccaagtcgatgaggagcaatggcggctacgaggtgatcaagaaagcgatcaagaagcttggcatgcgccaccgtgagcacatcgccgcctacggcgacggcaacgagcgccgcctcaccggccgccacgagaccgccgacatcaacaacttcgtctgggtaggacaagatcgctcgtcacactcatctctagtgaaaaattttagtcttaataggtaccaaaaaaaaaaaattgagccccactacgttactctctacagttagtagaaaataatctgaactattaatctcatttgatcgaagggtttagatctatttgtactacaaccctaattagcggtagtaaaaatatggagggacattattataaaaaaaagacgcggagaggtatataatcgtcatttagcagtgattaaatctttttcctttatttttttgtttttttgatggaatatgaataatactagcgtaatggatggccacatatcgatcttgccgggaaaaaaataaataataaagttatccctaattactatattatgtactagcgtaatagacaaccacatatcgatctagccggaaaaaaaataaatgataaagttatctctaattattatattatggtatctcttcaaagatggtaaaataactcaatttatagtactctgcttctgctcctcctttgcttaactccggcgacgtttttcttgcttcgtttcatccagggcgtagcgaaccncggcgcgtcggtgcgtgtcggccgggacaccgagaaggacggcaaaggtaaaggaggcgtcgccattgatcgatgggagaaatttctgctgcttatttttgatgttcgcgtgttgattttcggttttggtttggtttgtttcgtcaggttacttcgaggacaggaggccggcgtccaacatggacccgtacctggtgaccgccatgatcgccgagaccaccatcctctgggagcccagccacggccacggccacggccaatccaacggcaagtgaggaggagtcgcctcgcccgggttgatgaactgctttctcgcgttctgggtttcatggaaatctgtgtgtgtgtgttctctgacgctggtgctgttagaaacttccaataattcagaaataactgcgatgtgctctcaaatttctcatgaggccatcacctgcagcatctcatgaaatagatctattgcaatgacaataccaatggcaacgcaaaattttatggtacctccagataccatctactctcctcaataatgacaataaaattgtttctctgggttaatcaaacatcgaaaaatgataatgagagagtacagattagaaggtgtgagcgcatacctcaggatctagagttctaattctgattggacctgtggtagagcggacttattgtgattagggtaaccctagtaccctactgtgtggtgggttaggctaccttggacaccccaaaacgacaccacttcagatgtcttcaaacaccatctttactacacttcttacattttcgacattggagagaaacaatttcttgatttttttgtcacttttattgatgtgagccgccaactcaatacatagaggagaaggctaagggcgccagtttggcttgtccaaatgtggcgtcgaccatcccgtaaggcgatggagacggctagaacgggagtggcaaggttcagatccagacgctgagggaaagatggctaggaagctctgatagtggtacggtggcgagcagaaggatgtcaatggtggcttccaccatggtggagcaggagggtaaagttgagaggaaaccctcacaatggttccgataaattgtgtcacttctagggacataactacattatcaagatagggggtgccaagaacttggtcaagaaaattttttagctagagttcatctatttttaccatttatgcaaccttaaattcaaacttagtcaccattatcaacttaaattcagtcaaaaacatagtaaagtaagtgagtggcattcatctttatttcgttctagctccatccctggccactttcataggattttttttaagacgtacataaacttgacttgaagctcacggtagacctagtcaaccagcttgtacttttatgggatgcaacccagaggatcaacctgagcacaacaaacctgaaccaaatcatttggatagagatgcccatagatttgcaaattgtcacttccacatgaactcgaggtagataataccaagccaattaattgttaaatagacttacaagagggcccaaaaaaacaggttaaagaaccgaaaaaaacaagctaacaattgaaacgtatactacggctaatcagtgggcatgatccacatcccgatcttcgcatctggagcttcgatgagattaaccacatcgatatctcctttctcttctaccttgcacacctcgaaacacttcttatgtgcgtaagggacgtaaacactgtccttttccaacccacattcatcagccgcacgtgaagcgccgaagtaggccggagctagcaagaacgcgcggccaccaatgtcgtccacttcatgccactgctgctcggagaaatccattttgtagacgatgaggtcgtagacggtctcgaagtcccggtccagcaacaggcgcaccatgtacaggtcatcctcggcctcgacgaggaaccccagcgcggcacccagcacgccgtacccaccggggagggggtcggcgatcgcgatggagccgaacaccggcgttgtcggcgtcggggtgaattccagcacgccgacgctctcgggcgtggcgttgaagtagaacttgccccggcaagcggcgatcgagcgtatcggcaccttctcgcgctggccctccttgcccgggcggatgtcccactgcgtgccgacgtcgtactcgtgcctcacccacccctcaccctcgccgccgccgccgccgccgccaaaacggcaataccagagtacagtgacatcttcttcagtctcgacgaggagcacgatgcagctttcgctgccgtaaggcttgccggagagccggcaggagcaggtgctcggcaattcacggggaagatgaggcaaggagatcttgccgtcgggatcctgggggttctgcaggaacgtgaaggcgtccgaggccgagcggactaggatccacccctgcggcgtcacccaggcgttgccgttcgtcaggccggggatgtcgacgccgccattgttgtcgatggccgttgcgtccgagatgctgaacagcactggcttgtccgagtcagcgccgtgcttcagggccaggcatggcacgggggcgacgcgcggctcgtccatgcgatctgatctcccaatttccaatgtaacaccccctgttctctatggttaaatagacaaccacatacccaagaaatccgagtcgaagtgggatttcggtcggagtacaaccagatttcgtgtcggtcacggagatccctaagctgcgtcaactgcgacctaatcgtataatctgcctgtgactggggtctggattgtttgtaatcatggatggtcaagaatggcatcccatgagaatgagagatcataactagaaacggcattacagataagcaaaaaaaacatcgatatatcgcttatataaagtaccctcttcagtttcagaactgacaacattatcgccgcacactttaccggacctgcagcagaaacgcagtattggcaagaaaacgagaacagttgatacatacacgtttattcggggagagatgtaaaaaggctatcaaacaggaggccataaagaaagttcatgggtagcctcaaaagcattctagaatggctcttgaaaagtttatgtgatgacggtgggagcagatcggccagtgtactcttgcatctttgacagcttcagtgcaacatcaacctggataaagcagatggtcagatttgctgaattaaagtctgaagaaaaaggtccgcaaacttgctcggaaaacggtccaaaaggcaaagccaatatacagcgcggatgtcttaccagaggagcaagggcatcctgcgaatccctgccggtcttggaagaatccttctcatactgctcgatgtagacacggatagtagcaccaacagagccagttccagagaggcggaacacctagaatttgaggaactaatggtcagttcaccagtatttgttgcactcacactctgcgataaacacccgaatttgcaatgccaaattgtgctacttcatttgctttggttcaagaaacaaaatgaaggatattataaggtcaacaaacaataacagaatgggaccataccagccgggaaccatctccgaagaggtaccggacaccctgatgcttggagacagaaccatcaacaggatccttatactcaaactcatctgcggcaaccacatcagaaacatctgaccgaatctccttgatcaatctgaggatataaggtacagtttagagctagtactgaatgaaaatattttagctaactggaaaaccactaggcagtagcgaccataaaataacattaatgaaatactacagagctgtgcaaagtggcaaagaacaaaacacaacaatcagatgtatgcaaaattattcattcatttaaaatgaaatagactgatttctatagcagctggcgaagtattgatcgctccctaaatcatgggttagtgaacaatgtacgtacttgttaacatcagaaagggacgactgcatgctgacaaggtttgccataagttctttagcagctccagcatcaacattcttcaggaagaaaaaaatggcatggttagcatgttgccaaatgtatatacatacacataaatgtacattgaatatttgtgtaaagtacctcatagtcatatcgtgtataataatggcgaccataagtaccccagtgctggcgaacaatatcttcaacagtaacaagcttatcgcctccaaggttgtccttgttcttgaaagcaagaatagataaccatgctagaacagcccaaataccatctttctcacgaatgtgatcagaacctaaacaacatagtaggtataagcatcctggtgagctagtcatatcctgactgcagtgtgactcattatttaaatgtgatccacttgattttcattgatgcatgatattttacccaaaataagaacattccgttgcgtatggaaacaataaaaggccattgccctattcctttagctaagccaagtttgtggaatatcctaaattctcaataattagaggtgccacatatcaaaatgcatgaagttacatgcattttattcactgctatatgtcattgtgttccatagatcaagttcatagtaattaccagtgccaaagctttcttcaccacaaattgagcacattccagcatccatcaagttcccaaaaaatttccacccagtaggcacctgaaatatggttttcatatgatatgcttgtccggcattttgaaaatcatgtgactgacggtcctaatacttacctcaaagaacttgagattcaaattcttagcgacaacatcaagggcagctgatgtgggcatgctcctgcaattttatcaatagatcaacataaggtagcacagcggtattttacatcctttcattaaaagttctgacttagaagtttactgcaaatatggtcagttaacacctttgatggatgagaattacattattcttgcatattgacataatatcagaaagcaagtgaattgaaacatcaatgccacgatcaaaagaaacgtccagtttctgttcagattcttggatcctagaccagtgacagctataagcagcagacagccgccgatataggtatgtcagatgtcagtcatcttcatccagggttccatctaacagttattgtttgataaaagattcaagaatggatggtaggcagtatggggtctttttttttcatctgtttgttttatttgtgctgttttatcaatcctggatcctttgcttcttcttttttgtagtacaaattctagcaaacactagctacggagtccagtaccgaagaggctagatatcagagcactaacattccaggattttcagcaataaacataaccagtcaatccccatcgggaaattgatcttttctaatatcctaatattagcattgtatgatgaacactgaatttcatgcttgtttggatgcacattcagaatgaaagatgcgatttaccacagtgaatgcagtatgcaacttaaaagcccccattaaaaaaaattgtaaaccagaaaagtgcaggggttatctgcagcttaatatgcaggattacattgtacctggcaactcccttaaggccagaagaaaagtaaggaatcgactgaacagcattggctgcaataatggcaaccgaatctgaaggtgttacgaagaatctagaaggcaaaggacacatcataaatttctcatagcacttatgagtatatacaaaaacttcaagctatctaggctgaagaataccttttacccagaatcatgttgcgatcagcatcaccatcagctgcagcaccaaattctgggggttcagcatttgaggattttccaaggcccatccggtcaacaagttcttttgcataggtgaggttaggatctggatggccccctccaaagtcttcctgtaaaaatacaagtaaagaatgaacaccaatctaaattctattttcaaattgtgatgatagaagaaaacaaattaccttcggaacacagttcaacaatgagctttcagcagcaccaagctcttccacaaagatgcgtgttgcgtaagtcccagcaacaccatggagagcatcataactaaaagtgcaaaccaaaggttcagatgtgcaacaggcagttaatatgaggagagggtgagcatagttcaggataaaagcgagtaccagaatgtaaacttcggagatgccagaagctttttaattgactcaaagtcaaagattgtcctggaattaaatacaaattacaaattaaatcacccatttttcgcaggttcttatgaagctacaaggaaaattcacttattgaaaagaaaacatcgaacaatacatatggaaatagcattcagtaaattcaaatggaagcaacttacttcattaactttatgtaatctatagtagagtcaaaaacatcaacatcaaaagggccttcaggtccactgaaggtagtgacacctacaacagaaatatcgacctgcgatgtgggcaagaataaaggagtgaaacatatatttcaataccctgggagcaaaacaaacaacaaaaactaacaagtcagcgtcaactcttacatctggaaggtcttccgcgatgagatattcagtaattgtcgttgtattagagaagatcttatcagtaaccgattcaggggcaggtccaccattttccatgttatatttgattccgaagtcctgccaagatcaaatgaaaagttgctgataaacacagaaaatcgtgccacttgattagcagcagagatacatcataactgtgatacctcagtaggaccaccagggttgtgactagctgttaaaatgaaggcaccagtagcctttgatccctattttttgatgatttgataaagcaccagtaaggtaatttgttaacacagagaaaataagcagtgagtactaacagtcacactgcaaaaagttaatctttgtaaaataaatcttacatctgcaccaactctttcacggataacagcagatacagctggagtagacatgaggctgttttgtccaacccaaacacgtcttactccattagcggcagccatttttgtaatgatctataccaagcaaaataaatgtcaaatctccaaccacaattcaaagttccaactttcaagagcaatctacaactgagatagattacaaccactaataaataaactacatagttaagaagcactatgcataggcactgcacgatacaaaattgtgtactaggtattatgatcaattttatgatgtcgcatttttgttttggtgtgacttctggtaaacaattgaaaccatttaacttgacacaacatagaaaaatgaacaatatttgacctcaataaacacaatactattactatggtacgtctgcactcaacaatcaacatgtgtcacatgatgtggaggcatgtataactaagcaagacgagtctaatcatgcgtgggttccatcacatagctcgataaatgttgaagtatgtggctatacaaatatttaaagggaaatccgtagaagcaactgcaaatatataacaaaattgacaataaggatcacaaaattgcacaagaaccatgaggcctaatcaatcataaattacctgaacagcatccttcgagaaatagcggccatcaccagacacaacaatggttgcacctgtaagaaaagaaatgatagaaagatatgaaaaatgacaatgaaatatcagaaaatactttaattacggaaagtggtaatagcatttctaacttacaggggatatgcagaaaatggtatgcataaaaccagctccatgataatttatcaaatcagtatggtatctctaaaactagttaactacattattttctttcttaccagatggttaaagttaccacctggaaatggattagggatagcaaattcagtcatatatgtttccagttttcctaaccatattcaaaatatgtacttcaaaacgaaattaaatatttgattatttttcaagaataaagaagggctcagatagattattgaagcaggacaggtgttcatctgataagtagctaaccttttactttgtcggcaggaagggcattaaatgtggattgcacaaagttctggaggtaatgaggctgctggaatacagtaacctggtaacagttacagtagcacagatcaggttgtgagcaatgtgccatacacaacatttcaagcgcaggagttaggcagtttgtgacgttagcttgaaccctaaaaataacaccaactggccaccagatcccatttaataaacttgctcatcaatttctgcactcgtagcagcatgtattaacaacaattttttagcaacggtgagtaagaaccaaattctcctttttcatcctattttaaaatgcacacgaatacaagcttgatccacattttggcctggatccagactcatcagaatagactgggcactgatacatgcaacatgctactaattgggcagcaggcatgcccaatcaaaagcagcgaaacattctagaatcttatggacattcctcacgatgactaacaagctaacaactaacaaatccagagcagcaacaagccggattgagatcctaagccagagggcacacagtcactatctaccttcggtatctgctcgggctcaaatcgctaacaatgagtaaaaataaaaaaaaactactcggcaagatcccgatacaattagccaaagctaatcaatgagagcgaaaaaaaaatctcctgaatcaaatcccacgaacgcatacaattcagatcaatcgaatccggcatcgatccaacgctccagacgagactaactgatccgactggtcgcgggacaaacaaaatcaaccaccgcaacgaggaaccgcacattccagactcgagacggcgagcatcggagtcagtatcagatcccagcccacgccaccattcaggcgagagccgaaaaggcccccgcgccgcgagcaaaccgccgacgagatccgcggcgggaacccggagatcgggacaacctttacccatccaccacgcgtcgcgcctagatccagatcggggccctagtgacgggaaaccggagacaatcggatgaggaggaagaggtggtggtgggatgggaaaccttcttgcggaggccggaggtgccgggcttctggccgtcgaagggcgtggtggccttcttcgtcaccgagaacagcaccatggctgctgctggctcacgccgccgccgccgccgcgcgaggaggaggagtcggtggttgtgagatcgggagcggaggagatggagaaggagggagtggtggtgcgggggcaagagcgacaagggcgtgtggcggtttatagctggtgcgggagaggatcattccgttgtgccgttttgtttttttatcccttttcttttccgccgcttatatttttggggcggtttttaaagtgtttttttctttcttcagcttattatttctcttatgattatacttaggctacatatttttagcatatgcaaaacgagaaaaatcattagcatatgattaattaaatatttaataattataaacttgaaaaatatatttaattgattttctcttaaaaaagatttaattattttttaaacagtttctgtatagaatttttttttaaaatatgtatcatttaacagcttaaaaacgcactaatggaaaacaggaatattgaagtttgaagttgaagaagagaactagatcttatatgttagaatttgaattttaaaacttaactttatgatattttttaacattttttatttattagcattattttaaatggacacgtatatataaattttgtattaagtcatgcaaacgtaagtgaaacgatgggcttttttttttcttttcctttaccgtggacgtaaagaaatagagaatgccgtggaaaaaactgtgctggtggctggtgccatctgtaccgtttctggcttttaagaggccgtatgttggtgttttccatcgtatccgtgggcagcatatgcactttttgcaatgatttttcagctgattttgtcgattgctaggttttggcagtgattttacttttcataattttgtccgaaaatactggtgtacagccttttcaaaatggtgctcacattttatacatgcatgtcactggggcacgtgcacactttctcatgttattttttgcgcttatttgttgctacctctgtttcaggttataagactttctagcattgttcacatttatataggtgttaatgaatttagagatataattgtgtatagatttatatatcgttaagttgtcatgttacaacctactcttttttttcatttgtgtggcatgattagcttggaaaatactcctatttcacaattctatggttaccagtttgcaactatatggtggataccgatttacatatagttgatgttctagatgacataagacctaacagtagttaataagaaaaattatggtttacagttgaagttagatacctataaagaaacagtaacattcttccctgttaaagagaactgcacctacttgtgctttgcatctaggagataaggaaaataaacgacggagataagaaaaactaacatgatttgttattcagttaactaactctactgttgcatgttgcaagggagtatttcctccgtcccagaaaataacctaggtgaggatttaacaccatctaaagcaatgaagttggacaacctcatatctagattcgtagttatatatggtgtcaaatcccaacctaatttgacttttttttaatatgatggagtactttttaatatgagcaaattctttttgcatagttattcttgcctagctactctaggtgaaaccatatatcacaaagaacatccaaaatttcaaatttgcctgtgatgtaatagcaaatgtaaatttaaaaaataaatataacgacacattagtagatgaagttgtagatgccccatctttaaaagagagagagagagaagaagaagaagaagaagaagaagaagaagaagaagaagaagaagaagaagaagaagaagcaatattctctcactattaaaagagaaatgcacctacttgtgcttttcatccaggggttaaggaaaataaacaaaggaaacgagtaaagatgatatgatcagcttgagtgtctatagtctctgctgttatatgttgcagggaataattgttaatccgagcaaattcctttttttaataataaaaatggattacatctccggcttctgtcataagacacacagccataaatttaatagtaataaaaaggtaagataaaagtaaatcaaaatgagaaataaggtgatgggacaagtccccaagcaaattcctttttacaaagttattcccgactagctagctagcctagctgaagccagacatctgttgcagcaatcatccaagttgccataatcttgaagctcgcctctacctgtacagtgttagaaaatgtattttttttttaaaaaaactaaggcagcgttcgagagggtgagagagtgagtttgtttgtttcgttttccgcgcgaacgtttcccaaactactaaatggtgcgttttttgtaaaaattttctgtaggaaagttgctttaaaaaatcgtattaatccatttttaaaatttaaaatagttaatactcaattaatcataagctaatagctcacctcgttttgcgtatcttcccaatcaactcaatccccttctcctcaaatacatcctaaatgtagtgacatattagtattcagcaagtttatatgtaccgttgctgtcaaagttccaagataacgacagcattcataatcaaaaccacgcatagaaaggcattgagcaagtatcccaacctcccatcatcacgaaggcaaaatggttaatctccaaaaattagccgctggtttttgttgcctaatcaaacttttcctccgagcattgacgcacatgtaaacaacgtcaaaactagtactccctccatacttataaagtaaagaaaattgtttaggacaacgacacaatcttcaaaatacaacttttaacttcttatttctataaaaaaatatttattgaaaagtgatatatgtatgcttttatgaaagtatttttcaagataaatctatacatataatttttatatttctaaactcaacaacttgagagttattcataatttatattctaaagatttgatttaaatattatcctaaataactttctttattagtatgaagcagtaaaatcaaaagtcatcatccaggttccacttccagagggcagaggcgatccaatcctgtggtcgcgaactccccatctctttccattttccagaggcgttttcccaggtttacacgtggcacaagtgattgggacgttgccctatcaatcgcggcatccgattcggctatggtgggcccagaggccactggctcggctcctcgaggcgcgtggaggcttgacactggatgcaggcccagcctctctgttatcctttcgccaatagttactgggcctcgccagcccagagatggccgcgtgggcctggcccacttagccgtcagcccaaaagatccaatccccggtatacattaatcggagaggaagaaacggatgcgaccgaaacttcgagcggcgcgagggctcccggcgtccgcgccgtccgccgtgagccggtgctgtccacgacgtcgtcttcgtcgtcctcctcttcgccgtcgccggcgagccggccttgcgccatcagctcgctgggggcaccagacctaccaccttggcggggtcctgctcgccgccgctctgccttctttccttttacggtgccgccctctgaatctctgattcagttctacttcttcatcttaggccattattacaagcgttgaagtagtaatttgggttgatctgtatgcaagtgtgttttatttgcatattaatattgggactgttcagtgatatactgatatgctatgctagggacttgtccgttttttttttttttttgaggtttacagatgatgatcaccatgaatccgaacaaggcattagccaatgtttatttgggggttatatctaatgctttttttataatcttctagatgaatatggttataagatgtgcatgaatctgtttctttcattctcataacctggcatctgtatagcagataaaaatctattcccatggtcaattcagaagccctgcaactacaccatctgtccgatgtaagcaaccagttcaatgtgcctttcatacttaaacagctgctaaacgattccactgaactcatcacttatcacttatgactaattaatcaacaaaccaatttactcggtaataaatctttattcatgttacctgcctacatatgaatgtgcaggatgttctacgcagcatattgtcacggttgcattcagagagtcctcgcggatggcctttctttctcgcaggtggcagcagctgtggagatgctgctgtccgaaattggtcttgaaaagaggcaccatgttccagcccaagaatacaagcatgaaacgtacaaggaccaagtttgccaggagagtgaacagtcttctgcggcatctatgttcacctcctaccctgaggaagtttgttgtcaagttcgggctgcgcaggaagcacacctgccatgtcgatgttgatgtcgatggatgggttcgcttctgcgccgcgtcgagagcaaggcacatcgctttcgatttcactcctggagcgaagaacattttcaagggcttgcctgatgacaagtacatcttcccactgcatgttttcagtggcccggacagctccccttctcatgtcagatctcttaacctggcctacgtctgcctgaacacaacaaccactggttttgctggctttgcaaacctcaagaagctcaccctgcacaaagttttgtttttgagtgactcccaatgcctcatgcagtcatgctgccggaatgcactgctcttgagtggctgagcatcatctgctgttcctacaccgagctaaccttgtgcaagccgctgctgcggctgcgttatctttgtttgcactactgcaacctggaaaagattgagctggaagctccaaatctcacatcgtttgacttgatcaatcggccaattccgttggcactaagtgaatctccaaaggtgatgaagtttaaactgctacataagagcgtgcgctatggtgataatctggattacatatgcaccgagcttcctgctgttcttcctggtgtgcagaaactctccattacctcagacactctacatctatgatgaggtttaatttgtctctttctgaaagcaattaaattcattaatcagttagacatctgttcgtcatctcatccataatcgattagactatcatggttgtgtttcagttgaaaaggttcgccaaaacctcagtcagattcatcaatttgaggcatctgaacttgtatttgcctctttatgggaacggcaggtcagttgatgggattcttcgtttggcctacctcttggaggtagctccagttctagaggaattggaactgcacgtgagtggctttaacaacttcataatatgttgacagtttcttaagcatgcattatatgtagacatttttgtggtggcacagcatcatccttgttattttcaattacctacttttctttcattcatctgaaaccaatctttttatttttttccatttcctgtatgtttgttattttcattcatctaaagctacaactacattgcttaaaattggaataccatacgagttggttgattttgatcttatagttgaaaaatacaaaagggtaacaaagtttctatctattggaaattggagactaccatgctttattaccttattatttggtgatacaatacaaatttgtttatatttcgaagcctgttgaattctttattggcataatgttctagaaccattccttcttttaatatttttaagccacaattacaatttgacctttgagcttactttaactgttgttttgtaattacaaagtcatgacaatatggaagtaatttcatatgcatattcaatggtatcatcccatttatgtcacatagcctatatatactatcggattgttttaagtttgagtcaatttcacctaaccccaggtattatgatctaagttacacaaaaccccagagatttcggtacgtggcacataaccccaagtattctggccataaagtttcacaaaaccacactattgatcattttgatattgatttaccatattttttagttctacaataacatattataagttatttatccatcatataaacattagatccatgtaagtaaatgtttttcaaaatttcgatataggagtatgtcaatttggttaacagggtggttttgtgaaactttaggatataatacgtgaggatatgtgcaacgtgccaaaatccatgtggttttgtgcaacttgcattataataatagctggggttttatgaaattcactctttaaattttgaaatatgttggcaccttataaaaattattggcaattgcgatgaccctattcttaagctgcaggtgtacatgctcggctgtgtttgcaatcccatgttcccaacctccctccctcgttttccgcgtgcacgcttttcaaactgctaaacggtgcgttttttgcaaaaagtttctatacgaaagttccttaaaaaaatcatatcaatccattttatgaagaaaattagcaaatacttaattaatcacacgctaatggaccactccgttttccgtgcggagagtttagttcccaacttcccctatccgaacacagtttgaaatagaaaaccgtagggttagagtgatttgatgtatcccagtttctcatcttgaaatctatgattataagagaaaaattttaaaaatagattaaaacaatctgttatataaaatctagtagattaatgaaggtagattcgttaggataacatctgttctgaagacaacatattagtgcattattattattatcattttctaactattgttggtgatgatgttgttgttgcagctgctcataaaacaccaccaacctgattgcaaacactctggttttgacttttgtgtttgctttttttcattccaattattttttccttcttccacaaattcatgcgttccaaacattggatgaattactgacggaaacattatgcgatgagtctcacaagtgcgctgaattgttgcgtgcagtttgacatctctgatttcgtcatcagacaggtgatcagagcggatatgccaccgtatcggcatgataaagctcaggagggtggtcatgtctggagcctgtcattggcaggggctgatagagctagcacactgcattcttcgttgtgctattagacttgactgtatgatcatggatccgatggtaagaattaagggcctcccggtggttgattggttggtggaaagaggccgcaggattgccaaagagcttcttgagagggaggagtctcagggtgttcttagggtgtgtttgaggataaggggctcgaggagattgggaagatacgtaaaacgaggtaagctattagctcatgattaattgagtattaactattttaaatttcaaaaatggattaatatgatttttttaagcaactttcctatagaaaatttttgcaaaaaacgcaccgtttagtagttttggaaatgtgcgcgcggaaaacgaaacaaacaaacatactctctcaccctctcgaacgctgccttactgttctgtgagataaattagggacattcaatttcttgccacttttaagatgtgataattaattatttgccactcgctatctatgacatgcggatcctcatgtgtttatgacatatgggtcaagtggcaaataatttacccactcgtaagagtggtaaatagttaattattccaataaattaagccgcatgaaatatggtttttgacgtcaggttgtcagttcattctccaagttgcgaagtttttgtgtttgactaataatttattatgataatgaaatgatgaaatccaaataaattgcaaaggattaacacgcgtggtgtcctatctgtccaccatggtcctgcactgtacctgtaccgtgcactcgatcgtagtacgtgctagcacaaatgtactccctctgtaacaaaataagttgcagccatgattttccgcgctcaactttaaccactcgtcttatttaattttttttgaaaaaaattaaatacataagtcacgagtaaagtagtattcatgttttatcatcttataacaactaaaatgttaattataaaaaaaattcaaataagacggacgatcaaagttaggcgctgaaactcatggctgcacttattttgggacagaggtagtaccacgacaagaccaattgggggaattgaggggtccatttggccggtagcgtcgccgtcgtctagcccgctgccccaatacccgagagattgtgcccagtcacagtggctacggacgtagtacgtactccactaaccacaccagtacaccacaccgtcgtcggtccgtccaccgatgacgggaggatgcaccacccgcaccgtggcagcgagcgcgtcgcgtcgcaacgttgcatcgcggagtcgatcgtgagacgggtgggccaagtagcaacgtgaagtgtgagaagcgaacaattggttgcagggtgtgtcttttttgaattcgaagtaaaaaaaccgcttccttattaatgtatacttgaaactctatcaaaaaactaaaaaaaacagcggactttagattaacgtagtacgagaatcagctaatactgaccggtttgtgaataacgcttttgtgaaatttcatcagattatgtgaacttgattgggtgcaaggattgcagcatttacggttgacgaatggaggcgcacgcgcacgggcccgaggggtcaaagaagggggcgatacgtcaacaacttctctgactgtacacgttagcaccactgtactgcagctgtaaaagtcttaaatagcctaagtatatattaatttcatgaacggatcaaactactaccagcacaagtgttttctttatagaccagcacaaacggttagaaaactactactactatactacgtatatacaacaacaggtatttcacatgatcaattccacgcgtacgtgttattctctacccaaacataaccaagcagcccgcgcgggcggagcgggagatgacgggtcgtgggcggcggtgggcgggcctgcgcatggcagcggggaggcggtggaatggcgagacgttggcagcagcgtctctttgggggacagcgggtgtcgcagaggacgataacgtcttaactcttaagtgtcgacgaccaatcctcggcaaggagaaggcggatcctacgaaggtggtttcgaggcatcagtgatcctaagaatggcggtggcatgcgaatctgagcagagacctcctcggttgcggtggttgccgccctaggggcagcggtgacctaagtgtcgatgcaaggtggatcaggtgggtggatctcgttggtgacagtggctctaggggcggcaaaggtctgggagtctaggcgaaagatgatatcctcggcgttagtggcagaggattcaagcagagatggtagcgggctaggagtccaagtagcggaggaggattccgacgccggcggcagccctatcgttggcagaggcttaggaatacgacgaaacggaaccataacctttcatcttgtgtctggtcggttagttctgactggatgacgacagataaaggtgggctaaccggcgacgcgtggcattagttcacttaagtgtatgaagatggcaccaatggagtttcgcagtgacaaagcattaggggtggtggtgactagacgacttccactcatcgattttgactgtttcaaaagaagatgtcggaatgcagggatgtgccgaacttgtaggtttttcctttttggttgtgtgttctctttgttgaggtgtgagtccaaatgcttttatatcgttttggctatgtatatctctcgtgatatagaggccagtttaatgaaaatacattatctaaagaaaataggaaaaagtacgaattacccctccccctgaactatcgcggttgaccgaattacccccctgaaccataaaaccggacattcttcacccccaactatgcaaactagacgaattaccccctctcgacccaatccgcggtggttttggtctacgtggcgtcgcgtggcagtccaatcatcattctatttataaaaaaaatgtcgaacccacatgtcatactcttccacttttcctctctctctctcactctctgtttcactcttcctctctctcacgggtgggtcggcggcggcgggggacacggagtgcgcggcgggtgacgcagaggcggcggnnngggangaacgnggcngcggnngcgggggaagcgaggcgaggctgnggtggccaggngagaccagcgccatggcggaagaagagaggcggcaggcggcaccctcttcctcccgcccttggcccggtttacctgcctagcattcgcgtatcgctggccaacgaggagagtgtgaaaccggcccgtaagccaagccttcggaggttggaccgggtgcaaccccaccgcc

SEQ ID NO: 4181 - DNA, 7669 bp, Oryza sativa
cgtccctgtgcgccaccgccgagaagaagcccgcggcccacggcgagtcaccgcgggcccggtaggcttctacttctgtcgccggccgccgtcatcctcgggccccctccgccacctacaacttgctccgccccctgcgcgccgacgtactcacctcacctcaccgccggcacgcttctccgccgcctccgcctccgggccgacgtcttgagcgccaacgtatgcgccatcctcgctgactgcccacgctgaccgcccgtccccgcgccgtcctcgccgacagcccacgcccatcgctcgtccttgccatgtgcgtagcgcgagagagaaaagagcgagagaatagaaatagaggaaaaaagtatgataggtgggtcccacattttttattaaataaaatgctgactggattgccacatgtgcgccacgttggacaaaaccgctctggattgggtcgagggggtaatttgtccggtattaaaagtttaggggtaattcggacgaccccgatagttcggggttaattcgtactttttccaaaaaaaaaaaaaccaagcatccccgtgtacttagcatgtccatttgagatgatggcattagtggcccgtaccgtgcgatgctacattttgtccctgcctccggcggcacttgtcacactcttttcacgcgcgcattcttatatagttgaacctactaatccaaatccaatccaagttgtcacaaaaaaaaaaaacaagttgtcactttgttccgtgccaaattgactggtggaacgccccacggccccagcgaccaaccatcataggtcaagaaaccgtttaacccgcaccctaccaattagcgcgcgcgtacgaacaatcaagaacccagtggcacacgagtacgagtaatctagtaagtacactatggtactcccgatccgcgcgcccgaattaataggctggcagccgtcgccgttcacctcgttggacttggaccgcgtcgtcgtcggcgtctgctgcggcgcaccggcacggcggcacctcgcttagggcacccactataagctctctacaagagatcaatatcagcatatttttctatttagaagatattaaatgaagagatagagcaaagctgtctactaaattagagatagtctatagagaaaaacgaggcaatgcataagagagctatagatacccatgtagatatgctattgaggtggtttactattaatctagtttagaacaccttactttactattacggatgctcttaccgcccatcaattttccgcgccaaccccacgacgccgccgcccgctgccgggcgccggcctcggtggactcgcggcgcgacccaactaaaacggcggcacatggaacaccacgaattgatcgaatggcgaggcgaagcgtggccgcagaggccgaggcgtcgcgtcgcgtcgccgtcgcgctcgcgcaggtgtttggctgtggcctgtggtgcgccgcggtcgccgtcgcggcagattttccacggcctccacgtagaaacccattgattacacactctcccaagtcccaagtgcgtggcgtggtgcagctcctctcgaaatggacggcccattgcggagaacatggccccggactgggcctcttttcccggcacctttttcacggactttctgttattaacaacggcaggatttactcgctactgtagctttcagctggaagtttccaatgcgtaataaacttgactcctatggttgaaatggaatcaatccctccagggaaattgcatccaaattgacactagatttggatagtagtaccacttctcctaccataccccgaatctcccagaccatagtatgctggagccacccaaaaccgtcccgtccatctttgccactagtaaataacgcgcgtttttcttgaagcgttaagttgaaactccgaaacgtcatccacgcagaaggggttgtgtgtactcctacgccgcacggaaacgcaaccacacacttcttcggtcgcgcacctaacaaagtacccgcttctacgtcgtcgagcgtttaatgagtagccctcctcctcggcggcagtgatgacccaatcatccccccgggttcagaagccacgtctcgtcgtgcgtttaagccaagtataaggtagatgtgactaccacctctaaatttatctattttattcactcataaattaagaggcaacacatacaatgtatcacctctaatatacaaataccaatatctctaatactctcacacatttcttgaaatttgtgtggaagttgcctcttaatttaggggtggctcatcttatctctctccacttctctcctccaccttatcacccaatccaatgtagcgtttttagaggcaacatatgagatattatagtacttgccctaaagagaggatattttccactttctctgcgcactatttttaaacggttaaatggtgtattttctaaaaaatattttatagacaattcgtttaaaaacttatattaatcaacttttaaatttaaaataattactacctccgttttaggttataagacgttttaactttgatcaaagtcatactgctctaagtttgataaagtttataggaaaaaatattttcaaccaagataaatttattataaaaatatattaaattattgatttgatgacactaatttagtattatcaatattattatttttttaataaagttagttaaacttagagcagtttgactttaacaaagtcaaaacgttaacctaaaacctcatttttcgtatattccttcccaaacactaaaacgagaaaagtagctcgcggcgttgctgaagtacgtgaacggttcctgcctacccggccgcccaaagaaaaaaaaaatttctgctaatcggctgcgttggtcaacacggaaaacgcaatttcaccggaaaaaccttcaatgcgaggaagaaaaagaaacaaatacactacagtagtagtacgagtaaaatagttctttttttatactgctagtgctgttggtaggagaaaaagaaagatggaactggctgacatgcttgttacagcaggtacaatagcaggtataagccagttataaacatattttaaagagttaaaaaaagaagagaagagcagcgggctacagatctgtagccagctacagcacggactccaagatataatgtgtgtatgacaagtgggaccagatattaatagtatagtaaataactattgtatgaattggctattacattagctataaatgatttggatctagtagtggactatactattaaacttgctcttagagcaaggctaataatacagccgacctgctggctataaggttctttatagccttatcttagcctatccatataatagttagctcttcacaattaatacaggacccacttgtttctctcacagagttttttggttcttgtgtccaagccggctgttagtttacagtccgcttcttctctctctcctctcttctttcctccaactcagcatttaaccggcttatattctacaattatactcgctcttattgccagccagaataataaccgagtgaccggttaacccgggggcgcgggcccacttgtcagcgagccctcccagcacgcgcagcaaggcgcatttgttgtctcggctggatggctggcagagacagtcaatccaacagggcactctcccctaggcgtagcattgccagagtcatcgtacccagtcgcattccccttccccatcccggccaagcaaacgagatcccattaccattcccattcccacccgtgcgggcggcgccacccattcccattccctttcccaaccgcccgccaactcccggaataaatcccggcctcccaaagacggaaaaccccaactccccgaggcccattccgcaaaattcgcacgggagtttttagggtttttccgtttcgcccacctctctctctctctcttctcccccatccaccaccgcccacacacacacccacacacacaaccaaaagcgaaacaaaggcgcgcacgcgccgccctcctcctctcgcttcctcctctgcgcgccgccgggatgcgggcggcgtggcggccggcgagcggccgccgcgtggcgctggcggcgatggtggtgctgtccgtggtggtggcggcggcgatggcggacgacctggcgggggacgcgagggcgctgctggcgttcagggacgcggtggggaggcacgtggcgtggaacgggagcgacccgggcggagcgtgctcgtggacgggggtgacctgcgagggcggcagggtggcggtgctgcggctccccggggcggcgctggcggggcgggtgcccgaggggacgctcgggaacctgacggcgctgcacacgctcagcctccgcctcaacgcgctcgccggcgcgctcccgggcgacctcacctccgccgcggcgctccgcaacgtgttcctcaacgggaacaggctctccggcgagttcccgcgggcgttcctcgcgctccagggcctcgtccgcctcgccatcggcgggaacgacctgtcgggctccatcccacccgcgctgggcaacctcacgcggctcaaggttctcctcctcgagaacaaccgcttctccggcgagattcccgacctcaagcagccgctgcagcagttcaacgtgtcgttcaaccagctgaacggatccatcccggccacgctccgcaccatgccgcgctcggcgttcctggggacggggttgtgcgggggccccttggggccttgtcccggtgaggtctcgccttccccggctccgggcgaacagccggtgtcgccgactccggcgaacaacggcgacaagggcggaaatgggggtgaaagtggcaagaagagcaagaagctctctggtggcgccattgcaggaatcgccataggctccgccgtgggagccgcgcttctcctgttcctccttatttgcctctgctgcaggtcgggacgcaccaagacgcggtctatggagatgccgccgcctccgtcttcggctcctgccgttgtcgccgccggccgtaaaccacctgagatgaccagcgccgcggccgtagcacccatggccaccgtgggcaatcctcacgcccctctcggtcagtcgacttcagggaagaagctgatcttcttcgggtctgcggccgcagtggcgcccttcgacctggaggacctgctgcgtgcatccgccgaggtgcttgggaaaggcgcattcgggacgacgtacaaagctgttcttgaatccggggcgacggtggcagtgaagaggctcaaggatgtgaccctgaccgagccggagttccgtgaccggattgctgacattggcgagctgcagcacgagttcatcgttccccttcgtgcctattactacagcaaagacgagaagctgctcgtctacgacttcatgcccatgggcagcctctctgcggttttgcatggtgagaacttgacagttgtattttgttgtgattcttaattcacaatgaaatgttattcttgtgtttgttagtactatgatgcattgttatttggtggtgatgataagagtggcgcttgattgttttgtggctattactttttcctttcctcgtttgactattcatctgccggttttagactctactccgattctgtcttctctaggagacttagtcaggctcggtgttgatgtaggttttctttatcatgttggtatccaaagtacctgttgtttattgggtagtgattcttaattgatgttactcattcaggattgactacgatttagtttgtgactgtttcttgattcccccctgttctggttaaacttttcaattgttcatacttttcagaaagttcaaacataattgatgacattgcaatccttgaggtgcagaattggttgtcttattttttttatatgcacaaattccttcaatgtgttgactcagcttggttagtgtgatttttctttacattgcttatagtttctggggatggtacatgattaattaggatggtatctgatgtcttgatatcatgctggaactaatatttgcattttaagttatagccatatagttgaatactaatgttttcatcattactgttgtgactcctgctaatcatgatactggtacttagacttgaggatagaaaacttatctcacaccatctttacttatttgctaagcagggaacagaggttctggccgtacaccgcttaactgggagacgagatcaagcattgcgctggctgcagcccgtggcgtcgagtacattcactcaacaagctcatcagcatcccatggcaacatcaagtcatccaatgtcctcctgaacaagtcgtatcaagcacgtttatcagacaacggactttctgctcttgttggtccatcgtccgcaccatcccgtgccagtggataccgtgctcctgaggttactgatccccggagggtgtcccagaaggcagatgtgtacagctttggtgttctcttgcttgagctgctcacaggcaaggcccccagtcaggccgctcttaacgatgagggtgttgacctgcccaggtgggtgcagtcagttgtccgctcggaatggactgcagaggtgtttgatatggagctcctgaggtatcagaatgttgaggaacagatggttcagctactacagcttgctatagactgcgttgcacaagtcccagatgcccgaccttcaatgccacatgttgttttgcggatcgaggagatcaaaaagtcaagcgaaagattagaaggtagagatccgcagcagcaggcctcaaatctcgaagcgggcgatgatcagacttctaagccagaatccgctgaggggctcaatccttttgccccttgatattgaataacatgatggaggaatcggctaactgctgtagcccacatttggttcatggatttgatgaatcctatcttcaattgagtggactactttcatcttttggcaatattgaatttaccattggtgtcaaccatatggttgtctttcgattgcgcatgatgcttggcaccctctgtgctgtggtaggtattctggtggtgtttagggatcaccaccccaagtttgtgattgctttaatcgatctgcttattctagctgatgattaggttggttctttagctatccatgtaattacaccgcaatctagtgcttggaatttcttgcctgagaatcatatttcatgagttcgctccctgatggagttgttgccgattggcatggccgatgtgattgattgctgggtctttctttggatggtttggtgatctgtaaaacatgcatctcctgtggccgcatctggttgacgccttcggttcgtgaaagcaacgtgctctcgatccggtggcacgggtcttgttttcggcgagatgttttttgaatcgcccctgtttgttggtttcgtcctttgaattcaatctgcctgatacgaatagaaatgtgactgttgggctatcattattgatcatggtccataaatagatgccactgttaccctgtacgtagggtggtccaaaggaaaaatatgtacaggaaacgtactggttgagtgatccaaatgggtcgtgccgttttggcttgggctacatctcataaaccacgatctatagcagtggttccctagctcccg

SEQ ID NO: 4182 - DNA, 797 bp, Oryza sativa
  unsure (1)..(797): unsure at all n locations
tggcttgattgccattgaactnccnnnnnnnnnnnnnnnnnnnnnnnnnnnnnnnnnnnnnnnnnnnnnnnnnnnnnnnnnnnnnnnnnnnaatgccacatgttgttttgcggatcgaggagatcaaaaagtcaagcgaaagattagaaggtagagatccgcagcagcaggcctcaaatctcgaagcgggcgatgatcagacttctaagccagaatccgctgaggggctcaatccttttgccccttgatattgaataacatgatggaggaatcggctaactgctgtagcccacatttggttcatggatttgatgaatcctatcttcaattgagtggactactttcatcttttggcaatattgaatttaccattggtgtcaaccatatggttgtctttcgattgcgcatgatgcttggcaccctctgtgctgtggtaggtattctggtggtgtttagggatcaccaccccaagtttgtgattgctttaatcgatctgcttattctagctgatgattaggttggttctttagctatccatgtaattacaccgcatctagtgcttggaatttcttgcctgagaatcatatttcatgagttcgctccctgatggagtttgtgccgattggcatggccgatgtgaatgattgctgggtctttttttggatgggttggtgatcttgtaaacatgcatcttctgtggccgcatctggttgacgccttccgttcgtgaaagcacgtgctctgatccggtggacgggtctagttttcggcgagatgttttttgaatcgcccttgtt

SEQ ID NO: 4183 - DNA, 818 bp, Oryza sativa
  unsure (1)..(818): unsure at all n locations
ggcgcattgattgacgcttcgcttnnacgcnnnnnnnnnnnnnnnnnnnnnnnnnnnnnnnnnnnnnnnnnnnnnnnnnnnnnnnacggggattggcttgtgccgattcgtaaaaagggaagaaagaataattgatcggctacagaagagggataatctaattttactagggacaggcaggcatgtgcaaagacaaaattactcacatccaaagccttttgagcctccttttcgaaccaaataatcccgtggtcagaagcggcgatgcatgacaacaccacatgctcaaaactgccctctgctggcactgcccttctgacctgcggcggaagtctcccacatctgcatagcagccaatgtggatacaatgccaattaaaatcaagtgtaaatataacagctaatcttcggaagcttctaactaatggctaatgccatactagcacacaaggattttgtttttttaattttaaaaaagttttaatttttggaattttggcccttaacctgcaggtctccctcttcaccatatgaaagactcttactggagcggagaagtaagatgcatccctaaacttctcttctgacacaaacgtgtctctcaagccaaagaaaacacaacaagcacggcaaactggaaagcaagaaacagaaaaaaaggggaatcacttgggctaaaaaaaatggggaaataaccagcggaacaaccagtaaacaacgccctcggaacacaatggaaaacaaaaagaactttagctggtttaaaaaccacaaaaatgaaccgaaaaagcgtcgccaaaggccctggagaacctggca

SEQ ID NO: 4184 - DNA, 810 bp, Oryza sativa
  unsure (1)..(810): unsure at all n locations
nnaagtgggtttgttgccagctnnnnnnnnnnnnnnnnnnnnnnnnnnnnnnnnnnnnnnnnnnnnnnnnnnnnnnnnnnnnnntttccctgcctcagggcctcaattcccaacctgtaccagtgatccttgtcatcaatctcttttgcagaagcaactgcgatttggatgttaccactctcaagagcaaggttaaatcttgtcttctcatctttcacaaagtggagggcaacttctggaaagcctttctgttgtaaataagaaatcacagcttgcccacacagctgggaattcttgatcatactcatcacatgatcataccgtttgcgtagaagggccagcttgaaaatgtactcagatgcatcaactgtgaccagcttgttcttaccatcacgatctagacagaatatattgttcccaataacccttgttatgtatataggaacatcgagggttttaataatcccactatctccattgggaaggcaatacttgatatgattcagggtagtgtaaataaacacaccattctcatcccaggcaccacttttcacacgaatggtttcgtgcagtgtacagcgatggacgagcttcttgtttgctataaccactgcatgcttgctcagcagtgcgacagattccatatcactagaccaaacaacatatttaacagaaggtgcctggagctcaccaagattaacctttgctgcagatcaaagatggtcactcggtcttcggctttgcacagccggttaccagtcccagcataataaaatgcatccgtggccataggaagagggcttttcttta

SEQ ID NO: 4185 - DNA, 14480 bp, Oryza sativa
  unsure (1)..(14480): unsure at all n locations
gggctttttttacgatttcattctaagatttctcccgcaaactttgattgctattcttctcaggnactgcaaacatttgcgtgcacgaaaacaacttacccaccagttcctttttatgcatcttgcaaatagtcagccctgccagcagaatccttgggaacaatgtagagttcgtatgagcctccatccacatcagagcaaatcaggacagcattttcagttggactgtaagatagtgtcttgggtgaatggttcaaagctcactgatccaggtcttcttattggagcaagctgaacttccttctgtgtggtgaattcaaaaaaacgaagaaaacggtccttcacatagaaaacagtatctccactcacagagaaagctggacgttccctctccaatttaaacacaatcataccactgtcatgaccagcggcaagaagattcatctcagggtgagcagaaagaatccagaaacgatcatgttcccgcctgaacgtttgaataccggttcgctttgtggcatcccagatgcgaatgcttttgtcctctgagttggacacaatgatgtcttgcttagcatggaacatcacgcatgacacattattcatgtgtccccgcaaagtatcaacttcccaagccttcgtgtctgtccaaaaaaatagcacatttagattacattaattcaaatacctcaatagcggtttgctgcatatgcatatagttttgtgtttggccagtctagcaatatgcagaagaatgaagtgctatgcaacaagaatgaccacctttcattccaaccaaagtgacaaactagaggtcaggagctagttactaattgagtaattgtgaagcatgtttcttgcattcagcttgttcggtaattactacttctgtgaaagtatgataaattgaagaaaacaaaaggaattcataataaaatcaaatccatagtttgtagtaataatatatggaaggacaaatgaataaaaacacaaatatgcaagcgtttatccatggaaaatggtaatagaaaagtttaaggccttgtagcagtattaccattcattctccatagcttcacttgtcggtcatctgccccggaaacaatgagtggcaatgtggggtgaaatgatgcccagttcaccccacggtcatgcccttccaacacatattttacaactgcatcaacacctccaaacagatctgtgttcatctgggtgagacgcaggatgtcatctgcaggtgacaccgtcttcttcctcaaagcaccaatatcccaaacacggacagtctgatccagtgatgctgacacaaccaggtcctccttgggatggaatgatgcgcacatgacatagtggttatgtccagtcagcacagctacacatgtgcgtgactgccagttccagatccggattgtctggtcatcactagcacttactatccatgggtattcgtggtggaattgcacggtgcgaatatagtcaaggtgcccgtgaagtgtgaagaggcagcggtgtgtcttgtaattccacaccttaatcttgtaatcatcacctgcaatgcatcacagaaatcttagaatagttcagaagttcaaccattccgcatcccaatcatattagtccaccgagcaatacgaccggacaccagtatgacttcgtttcaagtttcaacagatcccaaagtccaggtttcaacaaattccaaaggtccatgatggcaccttgccatcgctaacttgctacttgtatcagattcacactacaaaagctgattctctctggttgagggctacacatcgactcattctacttcctatcatatctcttctacggaaggattgcaaaatcgatggagatcccggtcataaatagaaacaaaatgtcacatgaaggtttcaaactaacaattcaccaaacagttcatcttaagctaagagaatagaaccagcaccagatccaaccaacgaggatcacttgcacaaccaccactgtacacgaaacgcgatctaatcgcaaaccacgtacgcgtggtatctacctcgagtgtcctcattgcaccatgaaatggatcacgcggaaatctaacggccacgcgagacgtcctccaaatccgaggaggaggatccgaccaaacacgcgtcgacgccacacccgaccccgcgagcggcgaaccaccacaacgaaaaaaaaaatgctcgaggcggacgagatctaggcagggaggaatcgatgtttacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcatccccttcacccgggtgctcttcgtctcgaacttggtcagcatcttctctagccgtccccccggcgcgacggcggcggcggcggcgaaacccctcgccgctnaggcgcgcgnagaagaaaaagggggaagggggggtggtatggcgttgggtgaagagnacgaaggtgtttttgagatctcggggtggnaggaggaagaagtggggggagagatctgggtttcgnacncggtggtgaggtggtggaaggcttggccaccgttggattctggagacggggagatctgggccgttggttccggtgtggccgtgttgtcagattggggtagacttgtttaggggtgagtcagcttggtccgtaaggtacctgatgaatactgtagcttcagtacgaaggcagcgtttttgacttgtcagtagcagtagagaaaaaaaaaagtttagggccatttgaatcgcatggttgaaagaaatgtaggaatataaaaaagacaggattctgataagaattgaagtgtaaaacagaggattgcaatatacatgaatggtcgtttgattagagcgcagaaaaaaaacgcatgaatcgaatgagagagatagactcaaaggacattttctaagaggttggagctcttgctaaaattttcctctaaaatccacatgcaatgtgtcattccataggaatttcataggttttggaaagcttcaatcatttgaatcaaagtaccaaatagaaaaatttcctataggatttgaatcctatgaaatttctacataaatcctttgtttcaagaggccttaccttttgtagttatgtcatttatatttaaaaaacaggatatatcatataaaaaattataaccatgctagtagaaaaaaggaatttataaggctggttataaccatggtttatacttatgctagtagaacaaagagtttccatgtcttaaaatgtcacaacagatgcaagcaaacaagcacaaccataatacttgccgattttggcaggtacagtagtataggaatgagcgttggttactgcaattgtttctccgatgaatcaataagtgcattatcgattggaataagataacttaatggacgatccttcccgagtcttcatcaacaaccaagagaaaacgatagacatcagaaaaggttaaaggtggtaaacaacataattccataaatggaaggggacaaaagacctagacagtatatcactatattagatctaatcttgtaaatactttatttgaaaaacaaatctaaaatattcctaaaataaaatagaagggcctcctcaccatcgacaagggtgctaaagacagtagggaagggaagggggactagatgggttgtgaggacgaaagccttcatgaattaaattggtgattcatggtacgctctcgctatgacatattccagtttaccatccaaatctatataatactttatctatagatatatccacctagtttatttgctataaaaaatctagcacatgaagtttaaagtgcatctaggctctaattcaatttcagtaatcaatgactagcgattagagatgactaacacctttgcatataactctttgggcctacatgtcatgtcagtggctagatattatggaacttggtccctaagctttctaaaaatcttgaataggtccttatcttcaaccacaaataagaggagtgtaataagtggcgcgctcagccaagagccaaggcatgcccaggggacctccgtggtcccttcgggtgcagtaggcacatcatagagtggctagaggacgacgggcgacgagctcctgaaaagccgtggccatgatgcttatggtggtgggtaggcagtgctcgggtggtagaacggcaatagctctagcaactacatgcatagggaatagggaaaccgtaagcaggctagggattttctcacttagaagggcttttcccgcacttagtgatggcgggaggtagcagtggtgcttcggcaagatatgaacaatgttggtaggcgcggctattcgggaaggggaaaacgagatcagtgcaacatggggaaaaaggtgatgcacatggttgaaaggtgatctcaccgaggacgttgcgataggctcttgtgcttaccagcaccaatgatggctcctttattcctgacaagagagagagccatgagctccctcaagttggaatagaatggggcgagttgaggaaaaggagtgcaacaggaaggtttatgcgagggttgcaagctcatttcatggcattactctaatatggcgacctcaagccgtgtggtgatggaacgggattgtcgggggtaccgtggtatcagggaggagccaggaggattgatagcttgaaatctttggtcagcattgaaagatttggtcggtttgacttagtcggcacaagagggaccgtatacgttcaacgattagcgagaaagaaatagagtaaattccctgtgtacccctgaaaactcactcaatccctttcatactcctaaaatttacccgatcccttctgtacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaaaataaaatttttatttgaaattttaataggacaatggatttttttatcaggagcattcataaaaaaaaatgttgtgaacattggtatacctatctttatatgaatgctcctcatttttatgacctttttttaaaaaaattaatacgtatttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattaggaaaaatttcaggggtatataagggattttctcaaagaaatatggtgagagatgagtgttcaaaggcgagtaaaaaaaattctacaaccacattgcataataaaaaaaatcaaataataatttcatataactagactagaacaaagcttaagaggtgaaaggagttttatgctatgatttagtagtcgttgagacctatgttactcaaaattttagactcaatctacggggttttttttttgcccacgggttggtgggtacgggcgtgtaaagaacggaccatacccatgtacctaacggctaagagttttcgcccgtcaatagactcatgggtataagagttagaacatgattagctcctaatagagtaaaaatccgtcgggtgtcgggtcacgggtccccattgacatctttacttccaagtcatcatgcatggaaaaaaaaaaccaaaaataatttagcgcatatgaatttatgtacatcattttgaagttttcactacttcattttcttcttggatgttgcgtcgatgatgaacaaattgaatgaagttaaatttctatttcaatggtagaatttaataagtttctaatccatgttaagctaatcttattgaagtataatattttctataaggtcatcgggctatgtgatgtattttgccaaaagtcttcacagtttatttatgggtgatttaactacaataagtgggaaaagattatttgtttagatcttggtttaaaattctaatttgactgagttgctggggcatcacaataatggtaaagattataaaatgtttttgtgaagtctgtttgttttacttcggatcgagttgtcttagccccaggccccagcatgctttgtacctttcctccatgtatgaaaaatagtcatgagtgttaacatttttatgtattgttcgtatattataataacatctaaaatttactaaaatgtacttagtatttatttgtgattaggaaaatcaattttgctttgataaaagtatttttccttgcatttcatttgcataaaatgttgttacgtgggtgcatggtttgggattaaagacgtttgatttattatatttgcgtatgctatgttttgattttcatttatatgtaaaataaactattaaaatgagttttaacattttaaggcagctaaatgcgtcccctccccggtccagtccccggcattctcagcggtgacgagggaaagggtacccatcttaggatttattccaattacatcctcctattatcaatctaggatatttctcccatggtgtttcttgaatcaggtttggttaaattcttttgctctttttacatctcttgttggaggttatttcgtttgcaagattcccagttcgccaatgaagcaatcaatggcaccacctttaaggttagggtcaccgatttgctgatttatcaaaggagtgaagatagtggcctgtgttccttgatttctttgtgtgcatgttggagttggttagagttgtctcactatccattgttaataagagattaagcagcaaacaagagactaaaatgtggtaaatttccagtagcatggaaggaatttatccgttcactaatgaatgattaccgcgtctaagagcataggggtttgacgccgaacaaagctaggcctatatttttcagttaggacaatctatatatatttttaacttttctggcatgaacttaatgtgtctaattgtactttgcccccaaaaggcctatgcccaataccttggatgtaaagtgttttttttagtcatttactccctccatctcagaatatagagagttttaacccttgacatggctattaaggagaagggtagaaagacttatttgccatcttaggatagatgatgtgcatgtactgactataattaaaacaaggaatagttaggtaatatgggtagcttagtagaaaaaatacaacctattactaatactattttgctatatttgagacaaatcttgaattctataagttgttatatgctacatttgagataacttttgaattttatatttgagataacttttgaattctatatgaggttatattttagtacgaagggagtatgggaaaatatgtaatgtagtagaaacctaaaaactacagttggattcaaaaaatagcacccgagtgtaaattttttactcttaatgacgtgaaaaaatctcatacatttattttttttatttttagatcaatgataattataagtttctattacatatgtgcatttttaggtgcaacggtagtttgctgggggagaattgctgttttttttttccagtacccaagtttacactgcgccaacaatacaagggaaatcttttcccagcatttgggtaaagttctctctcctacttgggagcaccggatttttttttctcacctatataactttttctcagaagttaacacatgacatgctatggaattgcatagtttactgcccaaaacactgtccaggctacgacattgttctgttgtgccgcagcagaagcaacgaaaaatagaactgaagcagtacgttctaaggactaaggacttgtttagatgggactaaaacttttaaatccatattatatcggatgtttggacactaattataaatattaaacgtagactattaataaaacccatccataatcttggactaattcgcgagacgaatctattgagcctaattaatccatgattaacctatgtgatgctacagtaaacattctctaattatagattaattaggcttaaaaattttgtctcgcaaattagctttcatttatataattagttttgtaagtagtctatatttaatactctaaattagtgtctaaatacatggactaaagttaagtccctatattcaaacaccacctaacaaactataatcctgcaggtcctagtttaggccaaagttggcaatgaacaaccaatttggaactgaacagcccgcttgaagatttacaacacacagatcatttgctactcctaaaaggagcataaacaagtatcacaattctttgttaaccaaacaatcttaaggtgatcaacattgtgaacatacagtgtaacaaaagcaagcgtggacggtgacaatcacaagcaacagaatgaacaaaataatgcgagaaagtagctcaataggatgacaatgaaagtaacaccacgacaaaaaatttccaagagtgaaagtaatattggtacatcaattgtccaggggtaggcgcataggccaccatgagatgatcaaaagtccatatatgacaagtgtaacagctgcctcaaggcaaacaaaaatcgagggaaatgagggggagaagatacaaaaacacgaccatgtatacactcctcaatcagtaaacatgcagctaaaatgtgagatagagaatccctagaattttaagagactaaaagaaaatgggggagctctaccttagcaccacttatctcaactgtgtgggcgagcagacgaggcctgaagcatctgcaccaaccacggcaagctcacatatggtacaaagctgcccttcgatcgaaggaacaaaccgggatccacagtacgggcaggaaacatccttctggccacggtagattggaacatatgtggcgccacagacaacaaatggatttctgtagtcatagttcagctcagagctatccttcttgccactgcactgctgctgcacctgtcgagccctccttgcctgggcctcattagggttgttctccagaagcatccttgcaaagtgctctgcagtagcgaagttcttttgcttgtagcacagacccatagcgcttccaagcacaagcctcatatgaactctctgaagcttgcagttagtgaaataagcagccaattcttgttggcggttgacatcatctctcaactccttcctcttaagttccatcctcaggccaagaacatactccctcacaatctcgatcaactctttcacttcatccacttccctcctcgagtctaccacgataagagggatggtatgcaagatgctaaggaactgcctcagggcttctgggaacttaccatctgtggtggccttataggcagccttgagtctgtcttccatttgtgggaaggtgaaaacaagtgcaggagggcctctcacattaggacttgcagactcgctccaacctttctcaacagcaactggtatgatgggggcagttgcaagtgcatgaagatatgagtggctgcccatgtgcagatcaagaaacaggggcttgaggggagcaaagttttttatgcccaactggcgactaagcaacctcattgcagtgtcaaagttccctgctgctgcatgctccccagcaagagaagatttctgagtccaaatcaggctgacaggcatgcctggtggaggagcaacgaagaccgctgagcgtgcattgccagcattttttggggtctctgcttcaggcggaagttccagatcttctaggtcccaaccaccttcctcgccatcctcctcatttgcttcaccctcctcagcatcaaaaccgtcaccaccattcgccatcgcttcgcttgcatcaacaatatccaggccctcatcaccccagtcagcaccagcagcttcatcgtcttcctcaagttcagccttcccagtagcatccagtccaccctcaaagataccacgcatcacccgaagcaatggccaatcaccactggctgtgagaggagcaggggggatcaaaagagagcgagcttttccttcaggaagagaaggaatattttcacccagctcagcggcaagcctatcagcaatttctgtgagcccatgggtggtagcagtaatataggcaagaggtagctgtccagcattctctaggatctcaactctcttcatagcatcaccaagatacagagcattgtggaattgacccatcaggttattgttctgtccagcaattttgcacatgaaccccaccttgtccatgtaaccagtaataagatataggaaagcaagcctctcaaaattcttcgtacgttggtatgcatattccacaataccaacatttccctgcctcagggcctcaattcccaacctgtaccagtgatccttgtcatcaatctcttttgcagaagcaactgcgatttggatgttaccactctcaagagcaaggttaaatcttgtcttctcatctttcacaaagtggagggcaacttctggaaagcctttctgttgtaaataagaaatcacagcttgcccacacagctgggaattcttgatcatactcatcacatgatcataccgtttgcgtagaagggccagcttgaaaatgtactcagatgcatcaactgtgaccagcttgttcttaccatcacgatctagacagaatatattgttcccaataacccttgttatgtatataggaacatcgagggttttaataatcccactatctccattgggaaggcaatacttgatatgattcagggtagtgtaaataaacacaccattctcatcccaggcaccacttttcacacgaatggtttcgtgcagtgtacagcgatggacgagcttcttgtttgctataaccaccgcatgcttgctcagcagtgcgacagattccatatcactcgaccaaacaacatatttaacagaaggtgcctggagctcgccaagaattaacctttgctgcagatcaaagatggtcactcggtcttcggctttgcacagcaagctaccagtcccagcataataaattgcatccgtggcaataggaagagggcttttctttacaatttcgttcttaagattcctcaccaaaacttgattgctactcttctcaaggactgcaaacctgttgcgtgccacgaaaacagctgacccaccagcccccttctttgcatcctgcaaatagtcagccctgccagcagaatccttgggaacaatgtagagttcgtatgagcctccatccacatcagagcaaatcaggacagcattttcagttggactgtaagatagtgtcttgggtgactggttcaagctcactgatccaggtcttcttattggagcaagctgaacttccttctgtgtggtgaattcaaaaaaacgaagaaaacggtccttcacatagaaaacagtatctccactcacagagaaagctggacgttccctctccaatttaaacacaatcataccactgtcatgaccagcggcaagaagattcatctcagggtgagcagaaagaatccagaaacgatcatgctcccgcctgaacgtttgaataccggttcgctttgtggcatcccagatgcgaatgcttttgtcctctgagttggacactatgatgtcttgctttgcatggaacatcacacaggacacgttattcatgtgcccccgcaaagtatcaacttcccaagccttggtgtctgtcaaaaaacagcacatttagattgcatcacctattatccctttaaataatgcaatggtgatagtggaagtgaatgttccacaccccacaaagtttgcagcacatcttttttacttccttgaagttctttagtttgttaatatcttattctcatctctaaatcaagtttatcacagaaaggtctacggtggtaaaactgacacatatatatgtagagtaatgtaaaaatcattagtgctacttgtacctagaataacaaagatgaagggtgtgttgaatgaaaaagtcataattcatttgtttcaaacaatattagcacatgtacaattcatcttgcctgttgcaagtagcaatgcatggttatttagctagttcaaatattttgattgctggcatgcatatactttttattttttttaagtttgaacaatatacagaaaagtaaagtgctatacagcaacaataaccacctttagtcctactggcactagtttactaactggaaacatctcttgcattctgcttgtttgctgacaagttagttcagattaatgtagacatgggggaaacgctaattagttcttctgtcaaagaaagacaaatcaaggaacacaaaataattcataataaaagcagatgcataattctgtagctctgttctatgaaaaatgatggatgcaaacaaaaataatgaagttgtttatctaaggaaaaaaaaggatgtagtagcagtattaccattcattctccatatcttcacttgccgatcatctgccccagaaacaattagtggcaacgtgggatgaaatgaagcccagttgaccccacgatcatgcccttccaacacatattttacaaccgcgtcaacacctccaaacagatctgtgttcatctgggtgagacgcaggatgtcatccgcaggtgacactgacttcttcctcaaagcactaatatcccagacacggacagtctgatcaagagatgctgaaacaaccagatcctccttagggtggaaagatgcacacatgacataatggttatgcccagtgagcacagccacacatgtgcgtgactgccagttccagatccggattgtctggtcatcactggcacttacgatccacgggcactcgtggtggaattgcaccgtgcgaatgtagtcaaggtggccatgaagcgtgaagaggcaacggtgtgtcttgtaattccataccttaatcttgtaatcatcacctgcaatgcatcacggaaaacttagaagagttcaggagttgttcgatcttattttatgacagttccaaatcatatgggccactgttatgccaacaatacagatgaaactggtgtgtgacttagtttcaagttccaacaatccaaatgttccatgattgccaaccccaccattgctatggtatcagaaatacaaccatggaagctgctactcttcagttaaagctatagatcgactctcatgtttgaaaagattgtaaaatcgatggagatcctgccatcctgctggtcataaacatgaaccaaatggcccctgaaggttacaaaccaacaatccaccgaacagttcagcgtaagcagatatgataaagctcgcaagcactagatccgactaacccaacccaccaaccaggatccttgacaaccaaccaccactccaaatcaaacgcgatctaatcggatcacagagacaactagaggcctcgagacgtcctccgatccagggcaggatccgagcgaaacaagcaacacgccacgaagcccatgcccgccgccccgcgagggagagagatctagcgggtctactcacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttcgcttggccctcccgcccctgatcgtcgtctccggcgacggcgggcgcggcggcggaggcgaacccctagccccggaggcggagacgagcggaggagaggggaggcgctggatctggggcggggtggagggaggagagagagagagaggatggcatggttgtgagattgccacttaagcagtcacttccgatcttagccgttcaaggtgcaatcaacggcggatgcatttccctgttttcctaaacaccagaaccgagagaacggacaatatgccactctatacgtggggattcgataaaatgccactcaatatgatgcaccggatnnnnnnnnnnnnnnnnnnnnnnnnnnnnnnnnnnnnnnnnnnnnnnnnnnnnnnnnnnnnnnnnnnngcgagtnccattgccgcgt

SEQ ID NO: 4186 - DNA, 5473 bp, Oryza sativa
  unsure (1)..(5473): unsure at all n locations
cgcgtttttgatcacctatnnnnnnnnnnnnnnnnnnnnnnnnnnnnnnntatcaggtgaaataccactttgaacctatgttgatttatttttggatgaaaagaatgcttgttgtatcaatcaaattggccagacgcccattttgatttgatatcagcgtagttggcccattttgatttgatattagtgtagttggcccattttgatttgatattattgtagttcaaccggctaaatttcttgtggtaaaaccaaccccctaagtttaagtcctagtcttgacgttagtgcttataattatggctagttattattttccagtgatagataatgaacccgccaacaatgaaatgctcgtggtgacttcgtcaatcttaccgacccaatctttcggaggtgctcatagaggtaaggtgagtgccgtgtgcacgttataaatgcttgtgtttgtactgtgtttcaaaaaaatatatgccttaccaaattattgataccttaaaagtactttagttcctattaaaaagcactttggttagtgtttggtttgctattaaagtgttccaataacacatgtctatattgcttttttaaaaaagttagtgctcgtagtgaacttgccacatcacctactctcattataaattttacaaaataccctttattaaatgtattaatattaagaaacaatcaaatctaaatgaatatctgtcaggattacggataagacatatctcgtatcctacaattaaccaagtatattagatcggtatacctcatatcccaagatatgtttctatatgcgataaggacatatataaaatattataggaaatatccttatgagctggagactactagagtcctactcgggaaggactaggactattctatatcgtgcagggttcattgtttccgagttcaacttggagactaaggcaatccacggtataaaaggcatacccctggaggggttctggattatcgaatcatagcgccaacacgccgaccatagttttcgaagccgaaggacccaagctgaagccgccgggagatctcatcgaacaatctcgactagggtctcgtcggtctcaacgagttcgtatgttctctctgtattctgtggtcttccatatcaatcccatataaactgaattagggttattattttacgaggggccttaaccaatataatcattgtattttgtctattttaatgtcgtatcgtatagatcatcgtaccaacataccctaataccctatttatctggtctacgggtatcccccgttgacaatatccatatataaaatcaaaataaggggaatatttcctatagaaaaggaatgagtaacacatttcatgaaaaatttattttagaaaatattgtaatgtattttcttttatccgtagcaaaacatatatattcaattagtagataaaaacaaattggcagtactgaaatttgcatgtgttgacattgctaatattttgtcatggtagcaaactaaataagcccaccatcttgccaaaattttgtttaaagagtggccacgtcttaggcaagatagtaaatattaaaccatggcatgattgaatagctgcttttaaaaagttaggaaagtatagtagaaattaagcaaacaccctatgcttctgttgtgtcaatgatttcttaagacagatttttgatggtacaccaaagcttcagtgtagaggattaggattagtgactttaattagacatgttgttttgcgtcgtgacggaggttcaaacgtcccaacgtcaagaaaactaacttcccaactttagcaattgattgcatgctgctctctttgaagtttggaccatacatacatacatacatacatacatacatacatacatatatatatatatatatatatatatatatatatatatatatataataagctaaaattggaacgatgtgatgaaaaagttgaaagtttatgtgtagaaagttttgatgtgatgtaaaagttggaagtttgaagaaaaaagttgggaactaaactaggccttaggtttaaaaaaattgcaagtcaagatttaaaacttttaacttagttttaaaaactttcaagtgaagattttaaaccttaactcaaatttaaaaacttttaactaaaattttgaaagctttttggatttgaaacaaaatcagatcaatatttgaaaaatatcaactcaggtatgaaaacttttaaatcaaaattaaaaactttcatcttaaaattcagaacgttcaaataaaatttgaaaactttcataccaaaattcaaaatattcaactcaaatttaaaaaaactatcaactgaaattggagatgagaatatttaatttctaaactaaaaaaatagtgaaaaaagtcaaaaaccgcgtctggtcaattagctttggaaagagtacgaattaccccctcacccaccccgtactatcgtggttgaccgaattaccccctaaactcaaaaaccagatatctctcaccatgaacttttaataccggataagttacccccctcgatccaatccattgtaagcaaagaagtcatctaaactcgaatattggatttcaaatcccgtctggttttcgcgcctcgatcaatgaaatctcactctaatactgaaactttcaggctctcgaaacactcacttcatagcacataatatgctatggtccttcaacccttcacaaccaagactatcgacgactcaacaagaaaagaaattgacaacattaaatattttttacataataacaaattttattgaagttaatcaattacataaaaacgataaccatcaatacccttttacagtatcatatgtcatacactacccgaattcccgaaaccatgttcaacgttcctttccattcagacagatccagcaggctcagcctcctctcggttgcacagcacaacactaggcataaaatctcatcatcttcttctcgttttccacacgcatgcttttcaaactgctaaacggtgttttttttaaaaaaagcttcaatacgaaagttgcttaaaaaatcatattgattcgttttttaaaaaattaacaaatacttaattaaccacacgctaatggacggttcgatgaacgcatcaggttgggaagccaggcttccgaacgcagcctaatccagcggcggagtactgcccaggagaagcgttctgaacacatgccccctcctgaaacggcaggaacatggacgtgggcacgtaacagcctgtgaatgcagccaaacaccgctgaaaattcccaacaaacttcgcccgtttccaaaggctgctacgacttcaccataaacaaaagtcacctacccacagcaagaagcactcactgatgactaatccctgagagaacttatcagctaaacacaatcaagtagtgtaatcaacagctggaacagattttgcccagcactccatccatccgttccgaaataaactacactaaaataaataatgtgttatttatatgacagtaccttgtcgcaaaataaagatatttctccacatatctcctcctatcaaccagtcacaaccattttctttcacccatttttatcttcttaaccaattacacccttcctctaatcattcttacatattttcttaatatctatattaaccctataaatacttattttttgaaatagagaaagtataacaaatattgatatatccttagtttaatttattttaaaacggagatatatcttagtttttttttttgcgtgacagcctgacaggcaagcgtgagacagaccccgtgaatgtgtgatgccccccgagtgcccagggaccctacctacctccacctgcgacagctgctgctgctgcgtgaaggcacgcccatgacgaacctaggacctcgtcttcagtgtcgccatcacccggcagcacatgagcacacaacaactttgatcatcatcatcaccattgttatgcatcttatccggtggagattggagaaactgattgagatcctcctcgttgtcgtcgtggatggaaggaggccttctttctttctccgcgtcagcaggctgatcgctcagtttcggtccaaaagcaaaagagagagagacatcgcattctcagattctccgcatcgtctgtggtacaggaaatttgcgtggaaaaattggtcgccgagcaggtgagcgagcgagtgaccgcgatttcggtcgtgttcttgtccgtaagtctgtccgaatttatcagattgatgctgcagattgcgttcaggtctttcgacagtccaactgtaacatccgcggttcatcacactgtaacttcacacgccaacagctcagacatttctaccaggagacgaaacgaatagattgacagctcaagacacgctaagcaacgatattggaacacttcatcaacaaaactcgggtcacctttggaagctagtaactgtacaggattttcaccggaactagttcaattcccgtgagaaaatcctccgaaaatccttattccataggagggatcaagctgaagacgatgggcattgatcatccttatggatcaagctgaagacaatgagcattgaccatcatcaattttgcagcaggaacaacagcaaacaacagggaagcagtgagtcctttgcagttcttgcttgaaatcaaccactacaatgtcaaaagatctaggcagaagctaaaatgatcaatgatcaatacagtcatacactgaaacaagaagcacaaacccggacagtatctcccccgaatcaaaacgatcaactaaaaattgcattgcaatttctgggcgtgcgtgacaacagatacaggatacaccaccgggaagcaaaggctgctccggcgacaaaagggtagcagcaacaccacgaactgaaaacacaccacctccggcggcaaccggcaatcgccgtcgtcgtcgccgtcatcgtcatcgtccagcacctacacacgctcctccctgaattagaacaacacgaacggagaaagaactccacatgaaacaacagcagcagcagcaggaaacttgagtgaaatgttagcgattcctctttcggccttgggcttgggcgtcgtcgtctcacacgaagccgacctcggcgaactgcgggcgcggcttggccgtcgcgcccgggcgcgtcggcggcggcggcaccattccttccgggagagggttcttgcgcgggcgcccctcgcggcgtgggatcttgggcggcgcgtgcgggtcccgccgtttgagcgggcaggcacgcccgccccgcacgggcggggcggcggcggatacggagtcttccaaccgcgcaccaactgggacgggaactggtgccgccgcggcggttaccgccggtaagccgggggggcaaccttcggggaccgccgcggctcttcttggccgatgaagcggcgtaagnttccgcccatctatatcgggaaggactcctcttctctn

SEQ ID NO: 4187 - DNA, 4205 bp, Oryza sativa
ccttaatctggcgcggatggcggcctgtctagacccgttttcttcgccacgaggcgttcgcttccccgttcatttgaccaaagagaaggagaagacaacccaagaacccggtcaattccgccacagatctgggcatctggccaggaacagctagggtttagaaaaagagcgtgcctcggggtaggaggggaggacgaggtcgccggcgcggtggccagtgaaagtggaggtggccatgcctggctggctggctggctggctccctccctctcgtagggttggggtggcgggggcgaggggcgctgtctccttccggcgttggtgttgcgctgtgcgcgtgtgggatttggggccgccgcgacgcggatctgagaggagaaggggggttgtggttgtggtcttgtggatgtgggggggaatggaatgcaagtacagtttagacaaggaatctgtcgggtggtaccgggccggacgaccggtcgcggctgcacgctctactcctcctgtgactccggtccggtttagggggtgtttgggataggaacttcttttttttttagagagagagagagagagtttagcccctctctcccaaacagccccttagtctattcgcaagcttaaattctactccctatgtactaaaaaaaactcaatttaaaagagagaaaaaaacagctaatgagaagctcctttgtcgtgcagtcttgtacctagctttgatcgcttgtcttatttattttttaaaaaaattaaaaacataagtcatgcataaagtactattcatattttattatcttataataataaaaatactaattataaaaagttaggtacggaaacttatggttgcatttaaaatatgacggatgtagtagttggtaataatttggataagctaggaaactcagcttcttctagtttctaattcattttatgaattctacaactataatttcttaaaatctaaataagaacctaaattgtttaagagagcctctagcagctgaggattttagaagaaactgcagctacgaaaacttctgcaaacataccctctcagtccggtcttagtctccggtcttactccggtctgatcgggctggttcggccggctcggttcagtgagctggtgattagtatactagtaggattaatatatacagtgataagcattgtttgagtggtaaagtggtttggctaattggctcgtatggtcgcatctggtttgtggtttgtgaaagtgtcaactgggcaaaggatagtctcatcagatgctggcgagtttggcggtcgttttcacgtgacttgtgacggtggtggtgttgcgtggtagcaacagctggttgatcctttttttgttactagtttggctaatagtggattttatttaatctctggtttctttattaaaaaaacttttaagctctgaaggggtcaatatcgtttgagtgcctatttactttgatcagcggaggctcataatttgcggtaactggtgctctctttgtacagctttaaattcaaaaaaattttgagttagattttcctaagagcaagtactagaagcctctaaacacaagcccaatatatcatgtaaacttagataataacgtggaggagagaaaaagaatagagagatgactagagtatccacttcttatgcaaggaacaacctccatagaaactctaaaaataatagagaaagagataaattgattggtgaaaaatatattgggactagtgtcctacaggcaatatactgtatatgttagtttttaaatttaagagtatataatatcgataaataagagctgatcactgcctctactataaaacttgatctaacttaataaatccatagatctagaactatgattacgttgataacatttgaataaaacattctgctttcatttcaaatgaaatttaaaattttaaatatctataacatgcaaacttatttttttctgtggatctgagatatgaatctataccaaacatgatataggtagccgaatgtccatgatatttactataactaaaaccttgaatgttcatgccaagtgtaagaacatctttagaccttttcaactctgttcataccgttttatatatagatactcgcacacaatttgcgtttttaatagtattttactcacattagggattagggatttatggttagtctttgtctattatgcaaagaatgtgttagagaacgcatatccatgttacatgtgcgtattattataaaaaaaactttagtcatttcattttttttaaatccccgtttgctctttccaaataaatgcttctactcatttattggaaacaaatgctaattctgtcacaaattagaataactcattttcccgatgcagtataaaaatgatgcgcttatttactggggttattttcttcatttttttaaacaactatgcgcatgtaaaaagataaaaagagatttatttaacgtgcagtccattacttcagtgggccgcgttctgcgcgagaaaaggattggaaaaagtacaccgaaggtccctcaacttggcaatgggatacaaaacatccttgaaccgtaaaaccaaatatgctgggtccgttaactatacaaaactagtcatcagaggcccttccgcggtttttatccgtgttttagtctacttgacggctgagtcagcgtgggacctacgtggaccccacatatcagctgggcacgtcatcaccctctccctttctcctctctctctctctctcactcttctcttatcttctggcgactgggcaagccggccggaggcgacggcgcagggcggcccaaggggcacctcttcaaccgggcgccgtcgccgcaccagaatggcggccagagcaggcgaagcggcgacggtggcgggcgagcacggttgcggagaggcggcgtccgcgggcgagagcggtgcggcatcggcgggctggaacgatgcgacgtcggcaggcgaaagcggtggcggcggagggagcgtgcctgctcattggcgacgtcacgggcgcgcagctcccggatcttgtcctcccacctctccaccctctcttttccttgtggatcctgcacacgccaaattcacaaacaacccagattgcatcgattgattatgctgctcgtcatcaagcaaccaaccaaaccaattattttattagcgggtgtgtgtgtccatggccatggctatggatggtggtcttacgagcagaggcgatcctcgaagtcggcggcgaggttcttgaacagctcatgccccgcctccagcatctccgacacctgcattggcattgcaatctcatcgatcgatgaaaaattcagaatgacaaatagcgaaatcaatgaatggagagaggtggacctggcgagtgaaggcgtcaatggcgaggagaatgcgctgcacgtgctcatccgtctccgcagaagccgccaccacctcttcctcatcggcgacggccatgtcgtcctccgtctccgtcatgggcccggtggtgatgttgacggcgaccccggaggaggccgccactccccctcccgcgctcccctggctcaaccatctcctcctctccctgtcctccgttgccctgcacgcatccatccatccatccatcccaaaactcagatcagattgagccatcaaattttcgacccaaatcaaaaatcaaatgcgcctcaacaactgaactgattgagacagtagatgaaatggaacaagtcgatcggaacggaatcgcgtggccttggttcgatcaaagcaacgaacgcagctgacgaccgaatccaatcccccagaacgaacgcagctgcatggactcgcggaccacgaccgccgccgcctctgctccatcgattcccgggtgcactcgccgccaacacctcacccgccgccaaccacgaccgcgcggccagcccagccccgcgtgagcgccgcatccacgaccgcctgccgctggtctcccgcgcggtccgccgcctgcgccatcctttccccatgccggagagtgtgatcggggaggacgagcccgccaccgcgttcacccgccgccgccgcctcgcccttccgccaccctccccttctcccgtgctgcatcgtcggacgtcggagagaagagtgtgtgagagagagaaacagccgaaaagggagaggagggaaaagatatactgacatgggggacccacg

SEQ ID NO: 4188 - DNA, 22611 bp, Oryza sativa
  unsure (1)..(22611): unsure at all n locations
cgcgacgttatgacacgattgatatacggcgaatncagttgggtacaaaaggcgccccacgctaactcagccaccacgtaggccaaatccgggatcaaaaccgtctttttacctctggttctgtacagttaagagaccgtgtatatctggttttgcggttaagatgtttttttatcccgttgacaagttgagggaccttcggtgtacttttcccaaaaggattcggcgagaaaaacaagagttcgtaggcccatcagcccatcccatgagcccacctagaaaaaaaaaaccctaaaacacgcctgccgttttgatcggcccaagccaccatcgccagccaaccacagactagaggagaaggaacacttcgccggcgacggcggcggcggcggcatggccttctggcaggcgcgggacttcctcttctgcggcgtgtgcggcaccctcctcaaattcgactccgtccgctccgcctcctgccccctctgcggcttcaagcgcaaggccaaaggtcgtcgtcttccccatctctctccctgcaaagccctgggctgtgttcttcttgcggctgatgccttcgttctctttttttacggcgcagatatcgaagggaaggagacgcggtacacggtcacggctgaggtgcggccgattgctctaccctctagctcgcgcgaaaccctgggctcgtctgtttcagtcgcgaccgattttgtttcccctcaagtatctaaaatccataatgcgattcattcagtgtagtaatcctaggagatatagtttagtttgatttacgcgaggagtatatatggttgtgcggtggagcaatccagtcttgtggtttaggtaaaaggacggtttcactgtgtcgtgcttcagtatcgtatttcatatagaggaatggcttggtgattattgaatctacatggcagtgcactttagtagatttttagttttacaaatatccatgctgccttccttgggataatgcaatgcatctcttgggagctactccctctgttccaaaatataaggatttctaggttgtttagcaagtactctactaagattaggtcaaaagattttttttttctttattcattgcagttgtcaatttttgaactttgattttcttagattcccttctgaagcatctgattggctctgcgatcattgaagtgatgggaatcagtgcagaaatgcttatattgtggtacaacatttgaatcctagaaatccttatattttgaaacggagggagtattggtctgagattttattttatgtgctgagatgactcaaatggcaatatcctcatgctttcacatgcatgaatcaactgtggtaatggaatagtatgagttgtaggcaaacatcttatggagcagcaaggtaagatgtatagtgattttctggcttggcatttgtaggctactctgagtctctgattaagtcctatgctccatacttgtacacttctagtacttaacaaagacatagcacctaaaaggtgccaaatgaacattttaattttatggaccacaggtcctgcctttttaatgaactgtgcggtttcttgaatcttgtcccaaccatttatatcagatatgaaagaagatttccatggctatttatatgtagttgacattttgcatgctgttgacaggatattagaagagagctaaaacttgatccatatgtgattcttgaaacaacactgaaggaggaagacgtaattgtcgaaagagctacagtaagttaagctttttcatcaatatatagtctgatagtattttgtagttctgcacatattcataaatccttttctgcattaggtaaataaagagtgtgaaaaatgcaaaaatcctgaacttcagtattacaccaagcaggtcagctatcgatccttgaacatttgatgttcaataagcttaattttcctttttctagctttgatgcttaactactttatgaaaaatgtgtaattgcagttacggtcagcagatgaggggcaaactgttttctataagtgcgcaaactgcaggcatgagttcaatgagaaccagtagtcaccttagaatgagctttttgatcacttctacgattgtggtctaaaaaatggccatgctttgacatgacaagtgattttgaaatattttttttatgcctttgcttgaattatgacaagtaatggtgtgttcgggagaagggtttaggaacctcttccccgtgcatggaaaacggggtggcttattagtgcattattaattaagtactttaacgcatggtttagcagtttgccaaaaacattgtatgtgcttggaaaacgagggagaagaagttggtaaagtgtagtatagaacataccctaaagaatcacattactttgggccacatgtccaatcctcaatcatgctgtttttcgcgggtgctaattgcacataaccgaagtgtttctgttttctaaagattattaacctgaaactgcattttggaccttacggtgctcatatgagctctcttacttccctcaaatcctttatgccctcaacctatgccatttcaacctgttccataaatcatacatgttcagcttctaggagatatggcattgtttgctaactgcaaaaatgaaaaggtgtataagaaaggctcgtatggtttgaggggtgtactcttgtcagcaccaggattccaaattttgcgataaatgggtgcgtatcagtagcgctgtgactcccggtaagagctcatcttgagaggttttctgttgtcgtttcaaatcattttctgttgggactttcaggttatgaccaagttatcaaatccagtgattagtttttttaaggagaattttttcttaactagttcgagatgaagctgggacaaattcgcagtcccaattcctggtctaatggtctatatgaatttctggctatcttgttcttgagctcgagactgcagcttgtttggttcacgttctggttgctcatgccgtgccgagcactcgtgctacctccgtcccaaaataagtgcagccattgatattcgtgcccaatatttgaccgtccgtcttatttgaaaattttaaaaatatttagtcacaaagtactattcatgttttatcatctaatagcaataaaaatactaattataaaaaaaatttaaataaggcaaacggttaaacattaaacgtgaatagtataaaattgcacttattttggaacggagggagtagtattagctaaagctgattgtggtaaagagccaaagaggtcagatgagcagtcatgctcatgcgtgatcagaattcagaaggatttgaaatcctttgctcagtttgttccccttttcccaactcctatttctcgttttccgcgcgcacgcttttcaaactgctattttggtgcgttttttttaaaagtttctatatgaaagttgtttaaaaaaaatcatattattctatttttttaaaaaaactaataactaaataatcacgtgctaattgattgctatgtttttcgcgcggaggagtttggttcccaaccatccgaaacgaacacaaggtccgcaaaatgaacacttgtacactaaaattttggcgaggcatactcatttcagattgccgtagggatgcgaaatgcatcgcgagacccagcatttgtgtacgtgtatgagaatctcctacgtggatggtcactgtgaaaggccttagaggcaaggggttgtatgtcagttttttacttgcaacgtttaaccacttgttttatttaaattctttttgcaaatataaaaaacgaaaaattgtgcttaaagtactttagataatcaagtaagtcacaaataaaataattaataatttcaaaaaaatttaaataagacaagttgtcaaacgttgcaagcaaaaactcaaaatcccttatattattatatgacagagggagtagtagcaaacctacattatacatattacctcataatttattggttgttaacaggaatgaaattagacgtaatagccacctccactgcaaaacttaggcattcaccattctctacgagaaaagaactcaagaccgcgcagtctcccgagttccctcgattggtaaagatacagtgaatccattgactaaccaagcgaaccaaacagagcagtatacttgccccgagaaaatttgagcactgctatttaaccagatttatacccagtgaatggtattttgaagtgttgatagttccgagtacagggatacctccgagatgacaggaacttcattcggtcattcccaatcacatgccacaatgaaaaattgctcagaccatctacatcttcaagggttctatttgcatacagtaaccttgaccaaatcttggtggcacccaaggccgatgaagtgcggtaagagaagggaaaaaaacagcgctcctaggtgacgcattccaacttatggtcaaggatgtttcatcgatgatgacacgggaattgttcgaaaacaagcaacatcaaaactgtactcggctccgcgaaatgtaggaacaacctcaataggaacaagcccatgcctcacactttcatctgcaacatttgtagttactactggattaaaccatgaaacagcatcacaatatgacatttgactgctcatagaagaactggaaatacttacatgtacaagatctacaccacgcgagcaccttgtaaattgtttggttacttcaaatgaataaattccgatataacacgaactgctacgtctcagatttcgttggtggatcatccttcaatcctttggtgagcaaatcgtaattgatagagacaagttgtgatagattctgcagcaaaagaagttagaacggtgtgcagaatataggcacaaatgggctaacaataagttttctacccctacttttaaggattgatactgtcaatgaaacgtgacaatcacaaatttaatgagaataaaaaagaatatgtatttgttttgttggactgctagacactaagaactttggtttgtctttgtcgacactttgcccaattccttttttccactcattgtctcgctggcccacatgtcagtgagccatcagtgataaaatattcagtggatttttagattatgtatcacaaggatctaggtgctattttataatgaacattgtactatcgtttactgtgtggaacaattttgccacattcaagggaatcatcaaactacattttacaaagcacgtgcttgtgaagttgtgagcatataagttgactgacggattactagtatgattcataccaatagcattaaatatctagcgaagttattccaatggtttgagctatattacagtactgtgtctagcgaagtagagatgtgactactatgatttgaagcatattgtaactgaaaaaggtgttattactgcttggtaatgcaaatactgaggacctgttcgtgagtaaatacaagggaaatgtaaggagctgtgggtaaacttttctgcccgtaagtgaaggacatgcattacacattacacgttcattttaaaaaaggatccatcatggttactcatgcttcaatcaatcacattatgaacatgaaacaaaataggtggactgtgaagccgtaggcttactttgactgagaaattgtaaagaaaaaaaggaataggttatccaccgtgataacaccatcatgcttcaattattttaaggatataaatatgtgaaactgtaggattaccttgaatgagaaattgctgaaagaatagttgacatttgagctagattcaaactcagtgaagccactagactcatccccctatttgcacaatttgcacaattgtttagtaaaatgactgaagaataaaaaggcagacaaacaaattgtagttttcttttcctctacttatataaatgctgatgattcataccatatcatcttggtgattgctcacacagctactgctgccactaaggcttccattatcactggaatcctcaaattcgtatgcttcatagatgttttcgtccgatggattccaagaataacggctggtgaagtagctcgtgtcaaatgcactatctgaggaggggacaaaggcagcctgcatatgattccgtgttatcctcggtacacctttacaatggagatgcaactatgtttaaagaataaatagttaaccatatcccaccttttgcctagcaagggtatcccagctaatgtctttaaaaaattgatgctgcttaacctgaagggaataggattataagcatcaatcatttatgtatcataagaagttttgaataatccatacaacggatgaaggtttctaaaaccctcaaaagtcaaaatacctcagaggcgccatttgcacctagccgttggtgagggtcttctgtcaataatctgggtaaagcagtcataatatcacattagttacataaaaaacataaccacaataaacttcacaaaggattttgaaattgagcatgaagtagatagggagtattgtaataatatgcttaaattgcatgcgtaaagattccaaaaatacaaatcatattgaatagttctacctttgagcaaacagatgctataaaccatagaacacaactgaacacatataatatagcagtgtgctactgttaccctataagctgaaactggaaaaaagatagggactgacctatggcaatataaaatatagcgagtaccaagttatcaagcaagaaaatgtaatattttagagcagatgtgtccctgcctagtttgacccaaaatcctaattaaccccaacattcatttgtgttatttggaacctgaataatacagctaacaatctgacgtacattaattcacaatgctgatacgagcaacttttgggtggtgattttacagtacaaatgagggagctcacttcaattgttattgatggtgatgatcatggcaaaaaccctattgactttagtatagaaatttcatgcttgtcattgggataacacaaaggaaaatgcagtataaagacaacaatttattatataattggtccattgaccctaaaagtgacgtaaaagctgtgcaatctagcataatcatctatcacattaaaacttggaagcaagaaatagtaacatgcaatcctgtaagactgaaacatgagttactgtgtattcagaatactcgaaacatttcttacttgtcaattagatcctgagcttcagaactcatctcttctgggacatgtggccaaggtattttgcggttcagaatgttgtcgaaaattgtctacaccaaatacaacaagaatgtcaagttgccacagtttcaatacagcaaaaaacaacattgacttatatagcgacattttgcattaaatagatgaaaacccatgtgttttctagcagaccaaaacccatgtattttctagaagacctctttctctcatattctcaagagatctgaacgggagctttgcatgcttaatgaaagaactttactcaacgtcacataaatggcagagaaatattcagtacatgaaagtctgatacctgggggtgttctgcgttgaatggaggtattccaacaattaattcaaaaagtataacacccacagaccaccaatcagcactagtacctgcaaggacaatcagtactcaagagagtcaaaacgagaagacaatgcagaggttgaaagaaaactatgtcgggcattttaccatgtcctgtccccaaaaggatttccggtgctaaataatcaggagttccgacagcagagcgcttttgtctccgtgctcggtgatccatttcctcaaattcgctcatctgaggttcatcatctccatacaacgaagacccgctaacagcaggaccagatagatcatccgtgctgttgatcagaccaaccttggacaacccaaaatctgtcaactggagaattaagattgataagcaggacatatagaaggcattaaaaaggaacatattcgaaaaagaacgaaaacaatatttattgctgaattacaggttaaatgaaatgaaaactcagaaggaaatatgtgtagcattatcatcaattcattaagatatggattcacttaattagaaaagagctagctgaaatcagcatatatttgatttatgtggaaaccaacatgtcatgacatgaaagtttttatgcattgcctgattgtcatgtggggacgtcactactcactaagtccggcgccggcgacgacagcaagatacggaacagtagtttgttagcatcctttttcttagctaaattggtttgttagtttagccctatgatttgttatgatcttatctcttagatgggtatattaagctgtaaggaagttgattaatgcaagcagaatttgagatcaatctcatttcattgttcctgcctcaagggcgcgtcgcggatcacggcaccgccgcgccgtcgaggtccagggccacgtccgatcacctctttcaaatacaatcttcgccgagttcctccttccaatttgctaactcgtgacattgatacaacacagtttgaaacctcaaaaagtttcaaaactccaaaaactgattctcctcagaactctcataggatatgtgtttattttatctctcactagatgatgccattgtggcaattgctatgaactgctacatcactatctcatttggttgctggaaccaaaaataggaatatatcttctagtcatcagagaacagaaaagcgcttacctttgagaggcatgtgaatgattttttagtttatcatgtactccctccttccaaaagtctaagtcctatttcattctttggtttttccaaaagtctaagtcctatttgtagtcattatatgctatattaatttttttatcggaacccaagaagtcattttagtactttataggttgcatgttcattggttttgtcacatgatgaatgagttaactacatattggtcttggtgcaaaaagaaataggacttagacttttggaaggagggagtatctaacattgaacataaaacaagaaaaatggagagaaaacttaacgatcatgcgcacacataaatacctttatatgcccgtcatgagctatcaataagttgtcaggtttaagatctctatgaactatgtgcatagagtgcaaatattccaaagctagcacctgcagaataaaatgattatcagacaaaggaaaagtgaaaatggaagaaataaattgttagtaaaagaaacttacaacttctgcaaggtatatacgagcaacatcttcatccaagcaccctaaatttctcagtagagaatacaggtcccctccattcaggtactccatgactagatacaaattttcccgggaggtaaaagaatagaagaaacgaaccttaaaagaacataaccaattcagaaccacagtatagctttcaatgatgaagggtcgcatttgcaagttcactcaccacaaaaggattcctcactgtaatcaagatatcacgttcagccaatatactctcaacagcatttttccgaatcatatctgccttccttaatacctgtttcaaaagtaagcaactattgttagaccacatggatgccccatccatcccaaaccgaaaaacaaaagctaataataaagggagtttagcagtcaagcccccaaactattgctttacatcttagagctatcatgctgagcagaggcaaggtgttgtgtgctcagcaaaaccaaaattactataccaatttatcattacttccttttttgtgaggagtcaattcatcattcatgtgaactaaagtcacttcaatctaaaacctatgatggtcaagttgtcacaagtaaagcatgaacatgatgggccgctccactgtcattctgatcccatttttataagtaagctatgactatcaaggagactaatgcaggtaaaaataactacttagagtccaatatcatgtccagtctacaccatagtctagaaaacaaaaactaccaaaccaaacaggcaaacacaccatcaaaattttgccactaccaaaactttggcattgcccatatatttgtctcttgttggcacaaattggcaccaaaccaaacctaccaactctaccctaccaaaatgtgatagtgccaaaagttgccaaagatacggcattaccaaacttttggtagggtatcgaaccaaaatgtgatagtgccaaaacagcataatgatttaacgggagcaactaaatggatcccattggaaccgactccatattagttaactttttaaaagcaaacagtcatataattttaacatatcctgtaatcacataagttacttatctaacaagacgcagatttgattaaaaaacaagggatgcctaactaatgaaatcgagtgcagtttctttctcgaatgaattttagaacaagtgatataattcgtaacattgaccacatgtaccaaatgaaccagcggaacaagtggtacagccaggtttttgtagtatggatagtgtactacagtactataaatatgaagaggtgtactacaaatatgaagatgtgtactataaacatcaaggtgttaatcttttttgtggtcaactagtcaaactgggagcaaattaaaaaagcaaacgcgagaaataccatctctctaatcttccttctctgaacattgaaggtccacaggtatttcctttcttttgcaaaagttttcaatccaataatttgaccatgtcatgttgatcacaaggggtccttgataataaataatgaatgacttccagctggtggttctcatagaaatgtgttgtttagaaaggtatgcataaatgtacgaaaaacctcaaggccctttctaaagtatcattgcaataatatcacaatggcaggggttatcaactgaacaaaactaccgccgagtatcgacaagaacaaatattcttgagtgtgttttattgagttttggggaagaagactggcaagtcaacatatttacatcaaaagcaatttcctttccccttttttgcatgctaaaattctggtttgcgtctgaaagatagtcatatagcaatatttttggtttttggtcaagaatgcctacaacattacaggtacaaccaaggaaagcaagtctgggtacataagggaacaaatatatggcaacaaatacctttatagcaaagaggtctcctgtagttcttttcttggccaagaaaacacgtccaaatgctccacggctgataggtttaatgatttcgaagtcatcaatcgaagtacgatccttgactgggtgaacaggactagctcgtaagctacggacaacatcatcttcttcatccattacagtactcgctgaatcaactttgtccatatcaaccgaatcacaaagcagtaggtacttctccctaagaaattatataaatgtgaagggaaattacaaatggaaactaatataagtgctaaaagtgacctgcaagaattattttcatgtgcttatttagtataatgtcaactaagataagccacttgtgtagtgaactcagcagagactcaccggtggagtttttctatacgtgtgccaaatgtctgcaccgtgagagcctcatgcttcctacgattgacaatttcttgcagatcttctatgcaggtaaccaatagggagagtgccctttcttcatctagaggagtagttgcaatgcaccgcgcaatatcagcaagttcaacaatctgcacagattgaaggacactgttaatcagcacttcttgcattatattacattacaaaatcatttactactggtagatgatgcatagtgatcctaacctagattattatatggtaaataccacactgaggaccagtgtgaaggggggagtccgcttggaaagggaggtaaacatgacaggagtgaactttttaatctttcttcttgcttaattcttaaaagaaaacaaatccccttgagctcccaaaggtgcagctaagacattggagatagtagatgccatctaatcagcaccatctctaggtatacttggtaacaaagcaaactaaccaactaacagcatctctaatgaagggcttgattggtatagcttgctgcagctgcagctgtaactacagtaccaataacaggttttgtgatgaagctgctatagtgctgcggctgtgcagcagcagcaaagctgaaccaatccggcccgacatctaacgtgtggcagtggcagctaagcccacaatcatacatggcacattcgttccagccacccaaccatcatatatacgcatgacacagtggttgattggaaaaatagtggcattattaccattccttttcaacaaacgtattctgcacaagagaaactaaattttcataaacaaacaaaatattttaccatggccatagctttgctcactttgcacattgtaccttgtacaaaaataaacaccgactattttctatagtttagcctagcaaaataatcaactatctaatatatgtatgtgtgattgagagagcttacctgaggaagatcatcgctctcattaattgcacttcggccagctaaaagcatgtctatgtgattagatcttggagttgttagtggagatctaggggtcatacttcctgctgaagatgtagccattccatgatcagattttggcccaaaacgagtcttacatgtcatggaaggaaggttttttatgtcatccagtgaaatagtgctatcagcctcctggaggtagtcaagcatatcagctgagcctcttctagaccaatcagagagttttggagaggggccatcagattcttcattgatgcttgaatttgatacttttgcaacatctggactgccaacagcatttggaaggtctttttgtgtataagattctaccaacttttcaagtgcttcagcaactctaattagacgttcatcaacgcttacacctttttgatcacatctgtcagcacttgcacatattgctgagtgattttctacataatgagtagggacatattcttcacatatgcgacacattattgaaccttcttcagaaatatttggctggtcagaccagtgaccccatgaagttttgtgttgatgcttgggaggaagagattgatgtgatgtagattccactggactgttcaattcagcctggctactaactgcagggggtgtatctgttttcttattaggtgattcctctttaataggggtagggtctttagggggttttgggacaggtgatggaaaaggtttccaggaagatatacgctccctggttggagactcaacctcctttttaacatctgttgtatcaagcggtgaaagaaacttaacaggctttatctcctggcttctcttccattttaaattatgttgctcttgactgtacgattttcgtacatcacttttgctgcctctggttgtagtgtcatcacctggttgagccaatatctgcctatcagcagattgtatgatcttatcacgttgatccataacaacttcatcctccgcaaagccactctctttgtgaaattgaagcaatcttgtacatctcgtaaggataaaaagcatccgagtgtacagtttcttcagcacacccattgggagctcctgacgatgatcatctaaatcttgcactatgccttcacattgaagccaaaactcccccggtgtcattacacagcagctacgtgcaagtatgagcaaatcttccaaagtttccttccactcaggatgagaatctgcgtacttttccattacaccaaccaagtctcctgcaaatactgccaaatctgaatttacctcctcctttgctttctcaaatctcacctgaataacttttaacacctcctgtgttgatgacagaaaacaagattaattttgctccataaatagcaatatgaaggtcattaatcactatccacgaagaccatgaattgagaataccttcaagttgtaaatgccccgaggcttccaaaaagggaatggtcggacccccttggagttcaactcatgcgaaaaactttttatatctgcagggactctcttccttggagcactggtagcctgcatgatggccttaaagcgtggagattccgattcctttggtgtttcacagggatcatatgcacactgtggattaagatgacagtacagataggaggagtaagaaaagagcaaaagatggttttgtcattgcttgtttaatttaaaaatgtgaaatgggcttgtagaagcatcagtaccacattatctggtatgtgagttggagtcctcaaatctccagaatggttccgcaatgcattcggtttaactgtgtatgagatagattgggcacacacatatcagattttcaagttacaaaaagacacacagattatacattgttagctattgttatatgggataaagtagaatgtgctatggacaaggctacaaaaagaaatgcattttcatatgagaggagcagaaactattaaacaccggaagcacatattatagaataaattcagccagttgtagcaacaatatgaatctttatagtaaaacatttctcagcaaactactacagagtttgctgcggactccaagaagttcgttttttttaagaactagcaaattaaactgaaggatatagctccgatagacataaacaggtatttaagtaagtaatctgccacaagtcaaatgaacacctcactccagtcatatatccaatgagctgtgtatatagaattagaagctgtgcgcacaattacattaacttcaatcatgaaatcgcaggaatagcttatgatcaactgctaaaaatagcaaccaattactagctttgaatttaaattgtctacaccttttaataactaggcgggcattccttacttaaatggtaagaatcattcttacgttagcaccggtggttccaagtttagcatctagacaccatgcggcaaaatgaaaatcatgggcgccaatctccttataactcaacacatctaagttgaaattattatgtttttactgtttttaacaactaccgtcgacacggtaagctctgaagggagcttgaattgaattgcttaatgctgttctccccttactatcaatgcaagagcttggcaatgataagctaatccccctatcttccaaaaacctgtagccggcttgcaggatcatgatgcaaaaacctggaaaacaagtttaaaggatgttcagcttgcaggatcaacaaccttttgcagagctctttccttccaggctcgttgctgtggcgccccgcgctggatgttcggccgctttccctttcccccggctgccactggtcgaatctgcccatgagcttccagccttcctcccgccgccgccgccgccgccagccgatgcagccgacgggtccgcctgcgcctgcccacgcgatagattactgctcccgagcgcggcagcgatgcggtgcccctcctgcggcaggggcccggatctcgtcttaatccggttgaggcccagcgaggacgccaggatgggcgacagcgccgcggcgacgccccgcccgcgcccccatcccgaagctgcgccgcggcggccttcctcccgtccgccgacgggctcgacgaggccgacgcaggcgccggccccgcgccggccttggaggcggcggacccggacgcggagccgccgaagagcttgtcgcgcttcctgggggtctccgatttgggcttcttcttgtcggatctggacgacgacgacgacgacgccgccgccggcgaccccgccgcgggcggcgcggaggtgggcgtccccgggctgttgctcccgtccgtggggctcgacgactccgacgacttgtgccgggacgagaagaacctccccttgaacaccatctcctcgccgcccgccggggaggcgttcggtcgaacaggtggtgggggcggccgagcgagcgagactgcgagtccacaaggagagagagagagagagagggagagcgtggtagtggggacaaggccgcagatgtagagagaggagagaggagaggagccgaggaggaggaggactcggccggtcggtcggggcgcgcggcgcgtgctctccctcctcatccccttcccttgcggctcacggctcgggcctctgggtgggacggtacgagagagagaccgcggcttgactggggcagtagtgggtcagctacagtgctactggctatgctaatgctacagcagctccactggggtcagcgagggagtgtggtggctttggtgggccggaggagagggggttcgttgcagcggggaaataagtccactttgactcccttcggccttgtttggtttggagggagttgaaggggactggagaggtttgaggagaattattccacatcacaataggtgtagaataaatgtttttggcttggttatcaggttgggtaatgaaagttgtctgttgtaaaaaaaaagccgtggaataaatcacttccaatctctcactcttatgcattaaccgaacatggacttaactagtgaccaaatctgattcgtatccttgaaacataatacaggatatctcgacccccaactattaaaacaggtgcagtttaactctctcggcagttttggagggcgttttcactaacgtggtagtattgacctagtctgtggcgtcgacatggcgctttggttctattataattaaaaaaatatatatgtgggatccatttgtcattcaaaaaaaataggacccacatatcatcctctctctcctctttcctccttcctctctctcctcttcgaccgtctgcaaggggcaggagttggagcagccggtggactttcgtccgcagcacacgtatgctgcatccggcctacttgacctcgccatcacgctcctccgcctcacgctggacccaaccaccatgttctacagctccgccatccacgtccacacctcccacagtctccagctcgccacactcgcgctgctctctgagatgctgggtagggggctcctcccaacctcgcacacctgcgccgccgccgctgctccagccctgctcctcgcatacggccaaaggtggaaaaggggagacaaagggagagataatggagagagagggaggaggaagaagggggaggagagagatgatggcatgtggcccgatagggttaatggactcttctgtcagatatggatcatgtttgaggagacgaagattctaaaagctagctggtttggtaggtagctatagcctctaaaaacatgaaaaaaaatggttcctcagcttgtaattttcagttattttctaaatagattgtatagttatacatcacataaaatatgtacgctttaaattggatcatgctttaaattgtaagtgagtttctagtaatggtaacttctcttacaatttctagctcttaaattggatcatgttttttttaaatattttcagcttctctatataattcaaattgtcaatcatactctattacaatgtcaaaaatctaaaacgacagagtagtagtaatattgaataaaatatgatacatttgaaagggtatagttcgaaatgtacatttgaatccaactcgggacaattcgtcggtatgctgtgtggacgggattgagagagacctgacgagtgggtttgctgttccggcgtgggggccgggggagtttctggtttccagcatcgaggattcgagatgctgccattgtgccatgctgctggtagcctgtgctagtcagcctgttcactggtgcagtggtgctgctgatgctcagctcagggcccggtctgggagagtcaaagattcccggtccatggtttgaatttggaaagagagaatttctcttttacttttctagtagatctgaaaattattttaattttgctaaggtgaaccggtgtgagctgagatctactccctccgtcccaggaagaagggattctggaagcccaaggtagttttagaataaagagtaaaagactaaactaaccttagtactagtacatccaattattagttacaaataaagtattactactgccacacattaataaaatataattagtactccatactcaaacacacatggagatacagggcgccaaggtgccaaataatttgaatgaagagttaagcgccactttattggcgggatgtaatacaaatttagcacaccccaccacaacaaaccctacaagtttcaaatctgaagtttccctcccactttatcacttcataactctgcaaaaacacaagtttccctcccactttatcccttcataactctgcaaaaacacatccatggctttagatctaaatatagcattagatgatggagatgaacatgctatacctaacctcaatgaagcagtggctgaagaaacagcagcggctgatcaggaggatgaccaggttggaggtgatctccatggaggtgccaaccgtgagcttcctggaggtgatttccaaggaggtgccaaccatgtgcttccttttgatctcaacttgcatgcatctgaccaaaggagaaatacatctaggtaaccttgtaaacatgaatagaaaataaatgatctttgtagatatggcttgcataaatcactctaaaatctttgccatttctctgtaaaaatgatctataacatgtgcattgatgcaattgctatcttcttggaacaaaattggtctttgataagcttgagaaaacaattaggacttgattttttttctttgatatttaccaactcaattctgtcaagagttgagcataatgaaatttattcccttccataatatcagaggttatactagattctagatatgctagattctgcatggatagtttggttaggccatgtttatttcaaggtgaaaagtttttaagtgtcatatcatatatacgaacacatatttaaagtattaaacatagtataataacaaaacaaattacagattccgtctgtaaactgcaagacgaatttattaagcctaattaatccgccactagtaaatgtttactgtagcaccacattgctaaattatggcgcagttaggcttaaaaaattcgtctcgcaatttacacgcaatctgtgtaattattattttttctatatttaatactccatatatgtgtccaaaattcgatatgatagggtgaaaagtttttctttgtaaactaaacagggccttagccaagctctgtggatttggttgcccgatggccaataatgaagcccataagtaaggccatgtttagatcatttagtccctggatattaaacttgtcccttactgttttgatctaggaacttcagtaaaaaggactaaaagcacgtagaccgagggagaaaaaagagagtggttatcattttagtccttataaatacctctaagagggtctaatagattttagttccaatatacacctttaatcccttttagtcatccctatttagattcttaaggattaaaagtgactaaaatggagggattaatagattactccatgaccaaacatgacctaagaaaacatgaatgcagtttacatttaactatccttcgagatagtcacgtctacaaactaaacctatttttgaacggaggatgtataatgaataaaaactgaactactttctatgaaactgaactagtgatctaagggcgaggtcagcgaaggtgaatagactcatctgcctaaggcttttttaagtatacagacacacatttaaagtattaaacgtagattaataacaaaacaaattacagattctgtctgtaaaccgcgagatgaatttattaagcttaattaaaccgtcattagtaaatttttactgtagcatcacattgtcaaatcatgtcgtaattaggctcagaagatttgtctcgtgatttacatgtaaattatgtaattggttttttttccacatttaatgctccatgcatgtatccaaacatttggttttgatgtgatggaaaagttgaaagtttgaagaaaaaattgtgaatctaaaggcctaattttaatagaaacgttcgcccaacatatgtttgcatctcgagcctcataactgtagtgggagtatttgatacacacgtatacgactgttccatcttgttttaattttcgacaaaaatattgataaattttttgatctttaagcctgaggaacaaaaccgtatagtcgtgcgattttactttcaaaatgacgataaaaattcaacgaatgtcaaatgtcaaaccttgatttctcccttccagaagtcgagagtttttgaattcctcaacttgccgtcggcttgtccctcttcccgcgtgttgaaatcatcttcccttccagaaagccaacgccttcatctgatcatctccttggccaccaagaaatgccttcgtcgaacaccttgccacgccacgccgcgcgcgcgcccatggccctctcctgcgccgccgagtgcgcgctctccctcgcctgcgcgcgctgggcgctccgccgcctctccctgtccggcgccgacgacagcgcgtcctggcccgcggcctcgccctcctccttcgcgcccgtcccgcgcgcgtgccgctccgcgctcgcggcctggcagcaggggcacgacgaggcggagcaggcgccgacgccggcgccgtcgcggctgtgcccgccgtaccgtctctcccacgaccgcgcgcgcggggaggtcgtgctcgccgtgcgcgggctgggactcgcgcggctcgaggactaccgcgtgctcctcgacgccggcgggcccgagccgttcgcggccgggcacgcgcaccgcgggcttctccgcgccgccgtgtggctgctcgaccgggagggccccgcgatccggcggatggtggcgaaggccgggccggcggggtgcaggctcgtgttcgtcggccactcgatcggcgccggggtcgccgcgctcgcgaccgtcgtgacggtaaggtgctggctggagcggctcggcctccgccgcggcgacgtgaggtgctacgcgatggcgccgccgcggtgcatgtcgctcggtctcgccgtcgagtacgccgacgtcgtccactccgtcgtgctacaggcaagcctagcctcccaacaacattgttgcctctttccccttagctgatatcgcgtccatttctagcattgtttatcgaacattctgcaataagaacggaatccgacctcgattcatttcgttgcaatgattttggaattcgaatcgcacactcaattcttgaatttggatgcaggacgatttcttgccaagaactccagcgcctctgcaacacatcttcggatcaattttctggtaattaaaacagctaaaaatactcttgttatccatgtgttccaacggcgttgattactggttgttccagctgttgattcaccaatttttttagaacaagtgattcaccattttttctgtttcttgcattgcagtttgccgtgcctgctgtgtttcatttgcatgagagacacgtttgtgtcagaagagaagcttaaggatgcatctaaactctacgctccaggaagagtctttcatatcgtggagagggagaactgcaggttaagggccaaaattccaaaaattaaaacttttttaaaattaaaaaaacaaaatccttgtgtgctagtatggcattagacattagttagaagcttccgaagattagctgttatatttacacttgattttaattggcattgtatccacattggctgctatgcagatgtgggagacttccgccgcaggtcagaacggcagtgccagcagagggcagatttgagcatgtggtgttgtcatgcaacgccacttctgaccacgggattatttggatcgaaaaggaggctcaaaaggctttggatgtgagtaatttcgtctttgcacatgcctgcctgtcaatagtaaaaaaaaattatccctctttgtaaccgatcaattattctttcttccctttttacgaatcggcacaagacaatacccgtttcattgtatagagtaggagaaaaagtggtataaccaacatgttgcatggctttctttaccaagttgttgttcatccttagcaacatgatttcattaatcattttacctgatgtttaatttcttcgcatgttcctttttttcttttctttcgtttgctgtcctgcatgttctggttgccaatcagttaatggagcaagaagaattgacactacccccatcccagcaaaagatgctcagagtgaaagaaacggaatcactcgcagaccaccaaaagctcagtgcagggaatccacaagaagacgacaccctctcctcctcgtcaccgttcagtagccctagaacttcgacgacatcatcattgcgcagcgaatcgtcgtcgacgaggagcgagtgggatgagctcgtggagatatttctgagtgaccatgaagaagacggtgatggtaggacaaacatgtgtaaccgggcaggttctttgccttgctgtaaataaaagaatgttgaatagaatttttagagtgtaaatgaactatattgaaattagagtgtagatgaggggtaccgaacagaattcggcggaggtcaatgagaagtgcaccataagcgcg

SEQ ID NO: 4189 - DNA, 8126 bp, Oryza sativa
  unsure (1)..(8126): unsure at all n locations
gcatgggttgtgatgcacctctnnnnnnnnnnnnnnnnnnnnnnnnnnnnnnnnnnnnnnnnnnnnnnnnnnnnnnnnnnnnnnnnnaagcagaagataatcatgacactgaaagaccagacaaagccactaacatcattttgttgccaagttctcatattgatactaactattaagagaatgcaaatatgcagtgatatgtaacaaaaatgccactcacgagacacactcccattcccctggattgagttgacggtttgttggtttctcatggcactgaaggcatcttgtattctttgcaaaattcaaaaagttgcacctgaaaatataagatcagtacaggtgcaaaaagaagactattccaactccgagtcaatcttataaactagagatttgtgaaacctcaccttttgcatatccaatcaccctttttgagaggaagatgctcttggttctcatggagcagctgatacctctcttcaaattctccattgcagcgtaaacattttatattctttgcaaagttcaagaagttgcatctgacaataacatatgacattataaagcgtggcattatcacaaaatgtatatgtgattaaaaggctccaacatacttgggacaattccaatcaccctgcttcataggaatagaagattgtccttttggcatacggtgtgtgggcttttcagtgctggaaccaggacccatggaatcgaacccaacaatctcattaagtaggctcttaatggattctttaacggttttgtttagacatgctctgttctccacattgccagtaactgtgtcaagcccataagtcaaaaggatgcgcataacatccacagttcttccaatttcctccttccgagcctttacatatgccctctcgcatccaccccttaaattgcattggctgcagacctgtcagcataagctgatgctggagaaatgctatataacatatagatttataagcagcattaaaatactaattttgtcatcaaactattgtaagcatgcagaagtttcttctctccatttgtgatcctaattataatgttgcaatttttttcataacccaatggtttgaagattttattcagaaatactgctactaggcaattttctattcacaaacattggtaactgacaatttcaaaataaaagtaatagagaaaaatacagtacatgaaaataaataattgtgtatttattagttacctctccttcatcaaggcctacatgagcacgtaatcgcttcccagaattaacaaccttcctgtcaatgctggggcacccataccggagagcaacctggatatcccatcttgatagatgcctgcaacaaaaagggtttcagctctatatgcaaggcacatgaatatcatacgccatttagaccacctcgagtgcatcaggctacctgaccaagaaaatgcaactatattgacggggcatttccacaaacacctcgcgtgcgtgcagctaaaccatagccctatcaatgacaatcgcatactcaagtgacaccggcgcaccgcaacatccagagcaaagaagcacacacattggcgactcctacgagctgaagcatctcacctgataagctccggccgctctcgcccaaaccggaggcaggcggtgcggataacgttggaatccttggacggcgagccagccgcgccgccggcgaacacggaggcgtcgaggtggcccctctgaaggaggagctccatcagcgccacccactccggccacgggtgcgcgatatccacggccaccggcgagcgcgcgcgctcgccaccttttggctcctctcttgtttccggtgacggtggctgtcggccgggctcacggccatcaaactctgagcgaaggaaggcgagcctcgggtccggcggggccggcgggcggaggtgggagaaccgccggagcgccgccgcggcggcggcggcggggccgacgcggtggcgcatcgcttgaaacttgcgcaaaagcaagcagccgtaaagccgtggacttgctggaaatggaaaattccaaccggttccaggacccggcccggttgagaaaactggcccaaccgggcccagttcagtacaaatagtttgggccgacaatagattttatcattgggctttttggcaccaattttgctatatattttgcgacaaatttcgagaatacttgtcctcgggcgatcgggcggggggagcaaaaatcgggcgctccccccacccccgcccccgcaggcagtgatgtcgttgggccccaccacaatacctgcccccacctgcaacaaatcaaccacatattttggaaatcctctattaagggaatttgattttttttttgttccacaaaaaatgtttcaccgagtgtactcacaatgttttactatgtatagatctaatgttgtagtgaactgaaatctttcattgcaacaaaaaaaacccacatattttggaaaccccctattaagggaattcgttttattttttgttccaccgaaaaatgtttcacctagtgtagttataatgttttactatgtatggattaaatgttgcagtgaactgaaacaatctttcgctatttgctgaaacattgttttcatataaggtgaaacaacactcaatttaaacgagtgaaatattttcgatctacttagtgaaacaattccgatataccaggtgtaacatcgtgcaacatttaaaaataattcaataataagctaaaaaaaatttcgtcggaatatatccatgtgtggtcttgtttttaagatttaattgcaacaaatttaatggtgcaatcagataatgatttggataagtaatttaagagataaatcagtttaaagaagtttgcatgacatcatcgcccgatttttctccaaatgatcgggcacctgagccgtagaggttcccaacaaattttctcttaaaaatttgacagatgtaattacagtacaatcatagtgtaattacactgttatcagggttatggataccacatacctaatagtagttgactaaatctcagcaggacccaccacttaccatgtcatatacggaaacaacctgcgaatataggaggagttccggataaggaaagacaaccagagttctatatggaaacgacaaagactactcggattgtatccatactggtttccctagttctacttggataaggggacataaatacaaggccccttaggaggagagggggacatcgacgacacacccaccacaatctacgggacaacagaggccacaacatacaaactaacatacgccaagacaagacgctggatatcgactttagagataagcacggctagtcccctacggtgtctccggatactgttaggagagacatagcgttatctctgatctcgccgagcacgaactcgaggaggaagactaccctgttgtcgactacgagtcagagcttcagaccgccatgtcgacaaacacttatataagctaccccaaatattgtaccggtgtgattatggtgaataagagcaatatcggcttcggccaacagaatgtagggttattacctgaccattcaagggcccgaacctgtataaaaatccctgtctctatcttttacctcagtctcgcgtatatcctagtaccaacgatccccatactatgcaaataccggaatcgcgacatcaaacgtcgacaactataacttgcatataattacacactttcaagaatctccccgtaacatgttttttgggtaaaatgaaggtcgtgggaacaaatcctctcacatatgtgtgctgtgattttttttcttcttcatcagaacaaatcttataatagatctaatgattcaaaattacatggaacttatatacaagttactgtgttatatacaagttatagtgtaattacactatgattgtactataattacatctgtcaaatttttaggagaaaatttgttgacaaatgtataggtgatcccttttggcacaacttcaactccaggtttttcttgagctgggaatttctagttacagacattgttgaagttggagatgggtgcaggttaagattgttagtaacacattgtgtatttatttcggactgaaataagagaattttgtagtttaagccactttagtttagtttataaaccctattttctataaggacgacttgtgcttgtattttttattgcacacgactttccctgtgtagaaatatcaagaagttggagacatcagacgtgctaaaacaaggcctaagttttcatttggataaaggcagatttttttttcttgttatgcaagtgcaaggtaggccacctaatatttgtgagaacagcaaaaaatccgtgcactgaaacggttttgaaactgccataacgtaagtagcatttgcgaagttattgtagcttgtttgtcacaattcacaattagagattcaaatggtctctcagaaaaaaccctacttatccaaatggcatgccaccaaggcaccaatgtttaacaaaattatcgtttggtacaaatgacattaagccatgaaattagcaagtagcagacacagttatggtcatgactcatcaaccactgattgaaaaggcaatacatgttcccttgcttggatcttcagaagaacagtcaatagcccagctgcccccaaacacaagcagcatatggaaacatcggctacaaaaggttctagtactagattcacaatcttgagcacaatagtggtactcatttctacactagtttttctcctaaagtgcgtcatacctactgtcaacaaaacaaaaggggcccttccaccttccagtgcgctaggcaaacatcatcgtcgtctctgaacgacatagaagacctcagaatgctcggcacttcagcttgtccatgagaaggtgcgcaacagactcgtaaccttgctcccgcgctgttgttaagggatccaaaaatagataggatttaggaccatcaagaacaacatgtatcatggtagaattagcattgacagtatggataagcctcatatatcaagttgtggacgcagaattaccgtcgtatatggcaattccagttggtgataacttcctcttcttcaagcagatggagctgcatagtttttatgaaaaatcgagcaagtgagcatagtcatacattccttcagtttgatattgggatgaaatatcaaagctttgtaagaatcatatacctgttacatatccagaatttcttggtacccttctcctcaatacagtgagggcacatccagttcttgttcttcctgacctcatccatgtctgataccacatctcaaaatcagaagctttaccaacacaataagctgaccaacaacaatggcatttcttgacagcatgaagcttaccttccccatacctcactttcaggcaagcacggcacagtattccataagaagaatggcaagaggagcaatccgtcttccctgtcaaagattgacacagaaaaggagttgactattgcaatcaagctgcacataataattgacaccaaaaaattgacctttttactgcttcttttttacctatgcaaggctggttcaggtctccttccccgcagcgcttgcagccctcctcgccgcacaatttcttctgcctaagatcacacgagaagagactttctcaacaaatcatacgaaaactatgaagaaattttctcaacaagtcacagtatgaaaactatggtacctagcattcttgattaagaacaagatgaggagcactaatcggtcgtaaatgttgacagtggggagaatctacctgcagaaatggcagcaaatcccaagaacagggtcgtacacggcgcccctccccttgctgtcacacctccgctcctgcaggatccgcaccctctccttgtcgatcaccaccatcgccttcttctcttcttgctcctcctcctcctcctcctcctctgcttcctccgcggcaaacttactcaaagatcctaagagagagagagcacaagaatttgttcccatctcaggcagccagatgccatggagattcagcatttcagcgaacgcggcagcgagagggaccaacctttcagaggcagcgccttgtgctccgtcgtctgcccgttaagccgggcggaacggcggggacccgacgcggatccggccggcgccgcggcggcgatggcgaccaatcggccggagcggcggagcggggtgaggacacgcggcggcttggggttcctcctcggggttgtgccgccgatcccggcgcggcggctggctgctgccgaggcggacgcggaggcggaggcgatggcactgaactccccggcgcagcggcgcaggccgagcatctccatccgtgcctgcggggactcgcccaagaatcagcgcggcgggcgagccattgccatcgcgtccgcgcgcgagagattcctcatccagagaggaaacccgaaagttgatgatcgaggagaaggatgcttaccaggttctcggagatgcgggcgtcgcggacgctctcgtagtcggacttgccgccgagactccccatggcggtggcggcgctcttcggttcggtggcggggcggcttccggagattttgctgcggttgtcgtggtggcttcgcgtggctggttagtttgaatgctactacgatatagagtaacggctagtttttgtgtctgtgtgttcaccggcgaaatgtggtcaccggccgtgtcatggtgataagtgatgacaaatttttcagctgctcttcagtttattaatccctcgttataattcgttttaactttcatcaaagttaaactactttaaatttaattaagtttgtagataaatattgtaatatttacgacatcaaattagtttctttaaatcaataattgaatatatttttataatatatttgtcttgagttaaaaatattacatttttttctacaaaactaatcaaacttggaactgtttgattttaaccaaagtcaaaatgacttataatctgaaacagggagagtaaacacaatcaaattttaaattctaacttgaaagttgtttttaatatttgttttcatcataatttatttttcaatattggatttcaagtcattaagaacacatatataaaatatgaattcatataattaaattttagttagaaataagtgtcacaatattacaattatttgtgggcgaaacgatgaataatgttgtctttattcttttttttcaatatgatgtttttcttttacccattttaccccatacaagcttgatagaaattagaaatatatatagtgataaggtaactgaataatttttgtgaagagaaaaattactactagtacccatatggtggatcaatactatggagtactacttaggctgcgttcgatctctttgtttttgagagagatttttgacacacgtaaaacgaaaaatcccattagcacgtgattaattaagattaataactatttgaatcttttaaataacttctatatagaatttttttaaaaaaacatatcatttaacagtttgaaaaacaacgaggaagttaaagtttcaagttgagaaataggagtataacttagccttactagtatctgggacaatagtacactggtacggatggattattggagcctctgtatattaacattcaatcgagttgatcgtgaggtcgaattggaataaaatttaaccatcttctagttcatttacactctaatttcaatatagttcatttacactctaaaatttctatgcaacaatcttttatttacagcaaggcaaacaacctgcccggttacacatgtttgtcctaccatcaccgtcttcttcatggtcactcagaaatatctccacgagctcatcccactcgctcctcgtcgacgacgattcgctgcgcaatgatgatgtcgtcgaagttctagggctactgaacggtgacgaggaggagagggtgtcgtcttcttgtggattccctgcactgagcttttggtggtctgcgagtgattccgtttnnnnnnnnnnnnnnnnnnnnnnnnnnnnnnnnnnnnnnnnnnnnnnnnnnnnnnnnnnnnnnnnnnnnnnnnnntaatgngggncaacaaacgcac

SEQ ID NO: 4190 - DNA, 901 bp, Oryza sativa
  unsure (1)..(901): unsure at all n locations
gcaaatggtggtaacggttttatgctgagaagggtgaagcaaatgagagcatggcgaagaaggttggttggcacctagaagatctgtaacttccgcgtgaagcagagacccctaaaaatgctggcaatgcacgctcaaccgttcttggtggctcctccaccaggcatgcctgtcagcttgatttggactcagaaatcttctcttgctggggagcatgccgcagcagggaactttgacactgcaatgaggttgcttagccgccagttgggcataaaaaactttgctcccctcaagcccctgtttgttgatctgcacatgggcagccactcatatcttcgtgcacttgcaactgcccccataataccaatcgctgttgagaaaggttggagcgagtctgcaagtcctaacgtgagaggccctcctgcacttgttttcaccttcccacaaatggaagacagactcaaggctgcctataaggccaccacagatggtaagttcccagaagccctgaggcagttccttagcatcttgcataccatccctcttatcgtggtagactcgaggagggaagtggatgaagtgaaagagttgatcgagattgtgagggagtatgttcttggcctgaggatggaacttaagaggaaggagctgagagatgatgtcaaccgccaacaagaattggcggcttacttcactaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaa

SEQ ID NO: 4191 - DNA, 756 bp, Oryza sativa
  unsure (1)..(756): unsure at all n locations
ccgcgaggttagacccctnnnnnnnnnnnnnnnnnnnnnnnnnnnnnnnnnnnnnnnnnnnnnnnnnnnnnnnnnnnnnnnnnnncgttcctggccttgttgtttcgttgataggtcggtggtttgcaacattccatttgttatgttaaacttggtggtgaccacacagttcagcaaattttgcatctttgatttcttgaatgctgttatcctaagtgcaagcaatgttcctcacctggccaaacgtgacaacgtactatactaccgttgaatctagaatttgctgggaagctgagaacgcactgtctccgctcttaaaaaaaaacaatctaaaacagtccccccgtccttagaaaaagccaacctaaaataggatgcgaaattttattatctcatactccctccgtccttaaaaatgctaggatgctgatatttttttgacggagggagtaatacagttctagaatttgctgcgaggatgggaaccaatgtttgctgtcatctagaatctacatggcgttaatgtatcacgggctcggtgtatttaggccctgtttagatctcatcctaaaactttacaccatgtcacatcgaacgtttgaacacatatattaagtattaaatttgggtaaaaataactaattatacagattgcaacttatttgcgagacgaatcttttaagcctaattgctccatgatttaacaatgtggtgctccagaaacaattgctaatgatggataattaggcttattan

SEQ ID NO: 4192 - DNA, 746 bp, Oryza sativa
  unsure (1)..(746): unsure at all n locations
ccgcgattatattagcactnnnnnnnnnnnnnnnnnnnnnnnnnnnnnnnnnnnnnnnnnnnnnnnnnnnnnnnnnnnnnnnnnnnnnttgaattgtggttggagatttgacatttattttgcttggtatagatcattacaaaaatggctgccgctaatggagtaagacgtgtttgggttggacaaaacagcctcatgtctactccagctgtatctgctgttatccgtgaaagagttggtgcagatgtaagatttattttacaaagattaactttttgcagtgtgactgttagtactcactgcttattttctctgtgttaacaaattaccttactggtgctttatcaaatcatcaaaaaatagggatcaaaggctactggtgccttcattttaacagctagtcacaaccctggtggtcctactgaggtatcacagttatgatgtatctctgctgctaatcaaagtggcacgattttctggggttatcagcaacttttcatttgatctttgcaggacttcggaatcaaatataacatggaaaaaggggggacctgcccctgaattcggtactgataaaaccttttttaatacaacgaccattactgaatatcttatcgcgaaagaccttcagatgtaagagtgacgctgacctggtagttttggtgttggtttgctcccaggattgaanatatgttcaatctttattcttgcccattgcaggtgatattcttgtgaagggcactacc

SEQ ID NO: 4193 - DNA, 810 bp, Oryza sativa
  unsure (1)..(810): unsure at all n locations
tttttgaaaatatcccgcatatttaaactcgcctggaccccttagttatggaaggacctatatataacttttgggaccttgtcaaggccaataaagtgggtttaaaccatcaagcctctaaattcccttcggaacattttccaataaaaatgctatcaaatgaaagtttttcaagccggtgggtaattgggggcaaaagccccaataaatcgtatctccacgtgcccgactaagagaccaaaaaataattaggtgttattaccatgcttgtagattctttgccattcatctatggaatactatttatcaatatatatggcataaaaagcaacagcattcaagaaaagggcttaataaaatatcttaccccccatgtaggtgctctttaaaaactcggtcaaacgcacgacacatgtccaatattgtgtcaagttgtgcctgtagattatgataagtttatgagtcagcatgatgtagacatggtttgcgaatagataatgtgctagggtgccattcaaatgaatgttgcaggttgtggcacgaacaacatgaacctgaacacttgcagaaagttacaacaagcaaagtacggtttttcttaccccagcatcacctccaattggcctaccaaggcgatccaactcagcttcaatttcatcaattgttttgttaatcatggctataatacttggaatttttgctctgatcacagcctctaagtgctgnnnnnnnnnnnnnnnnnnnnnnnnnnnnnnnnnnnnnnnnnnnnnnnnnnnnnnnnnnnnnnnnnaagncgttctataatgcgcg

SEQ ID NO: 4194 - DNA, 804 bp, Oryza sativa
  unsure (1)..(804): unsure at all n locations
atgggnattgtggaacnncattgannnnnnnnnnnnnnnnnnnnnnnnnnnnnnnnnnnnnnnnnnnnnnnnnnnnnnnnnnnnnnnnnnnnnnnncaacggcagcataaaggccagccgtgcaggcggaaacaccagtcggcagcggcgaaggcaggccggtcggtgaagacgtagacgcccaacaacggcggcataataggccagccgtgcaggcggaaacaccagtcggcggcggcggaggcaagccggtcggtgaagacgtatacgcccaacaacggcggcataataggccagccgtgcaggcggaaacgccagtcggcagcggtcgaggcggccggtcggtgaagacgtggatgcccatgaacggtggtgtgaccaaccaaccgtttaggcgaggacaccaatccgcggcgactgaggcaagccggtggtggagtcgtaaaccgccaacaaccacggcttaataagccagccgtgcaggcggaaacaacagtccgcggccgacgaagtggccggtccgtgaagaacttgattgccattaaccggtgtgtgaacaaccaccggttaagcgaagacacaattcggcgggaacgaggcaagcccgtccgtgaagacctaaaccccacacacgcgcggattataaggccagcgtggaagcggaacaccaattggctggcggacaaggcggccggtcgtaaaaacttacaccccacaaccgttggattattaggccaacctggaggggggaaacaccatcttggggttaacaaggcgcccgttgtggaaacacttaaaccccct

SEQ ID NO: 4195 - DNA, 1226 bp, Oryza sativa
ttcacttgatttacgccactcagtaaatgcattagacaaggatgtgcctgcagaaatagaacaatctttagtgccacaaggaaatggtaaacaagaaaaatcttttgtcaactgtaattctataaggttcaaaggaacatgacctcttcttgcttaagcacttgtgaggcaagtttcaagctgagcaaagttatcttggagtcaaaaatcaacgaggggaatgcgacattgtaatatactttccaattcttcagatcagcaaatgatatcacaaggaaccttagtagcaaagcaggattctcttctactttgccagatttaatatcatgcaagatctgcaacacatattacatgctttaatttttttttaagaaactagtagtgttagtggtaatgctagcaaaattccatgtcaagcatgtaccttctttgcttcagctttcagtagaagtgctctgtccaagttttggaatcctctcatgttattagtgtttagtagggtccctgggactggacaattgttcctatcgccaaaggaattggcagaaggtggcagtatcgattctgggcatatcctaaagaggcttgcaattttctcatattggcgtggagtataataacctagcaataaagttcagcaaacttgttcagttgattgagaaatcaaaccatgaaaaaaccattcacacggcaacacatggacgaccaaactaaaaaaccaaaatgacctagcaaaatttgaattatatttgctaattgctagtacttctcttaggattctcaacagacaatctgaaatacatcactgtttgggtgctaacagcaatattgcagaaagagcaatcagtaatgacaacaaacagtagggcttcgggctagaaattgatcattaaacaacagaagaagttctaaaatccaaattactatacacccattacgacgacaaaatcatgaactcccgcacggagaccaactcaatgtggcattcaggaaaacctcgtatcgccgcaacctctccctaaacaatattccgctcacaaaccaccaactcaggcgagcgaaacccctaatctacaagcatccacactcggcatcgccacccataagcaaacaatacggctcttaacaatcgctccgacgaaccaccaccgcgtccgaattccatgggggaagcctgggagacgcggggatacgcacgcttcccgttccccgctcgagacggcagg

SEQ ID NO: 4196 - DNA, 9765 bp, Oryza sativa
acgtccagcttgaggcggcggagcgcgtcccagaagcccgtctccgcgcagacgccgatcgccgccgcctgcagcggtcggggcgccgccgccgccgcctccgcccgcgccgcaatcgccgccgtgtcttctccctccgcggcgctggactgcgagctctcccttcttttttttttctctctccttcgaaattaaaatctgtaaactgtaatcggatggttgctttggcgtgtgtataaaaactttggaggtttcgtttcgtggaagagttcgattccagctaatataatacgcctagcaagctgaggtggtagtatgtttacaatttgtgactggtgaggcagtatgtttacaatttgttgggttttaaattttaatttgagaggcaattgcttatttaaccctattatgaaatctatctatcaaattgaccctactatttaaccctgatttttgaaaacaaacaccccgtctgaccctgcttctacaacaccgttaagaatcatttttttaaaaaaataaatataataaattttcgtagtgaccgaaataccctccaaccttatccacatctctgtgtatcccatcccatatcattctctctctctcgtatcccttctctctttcccccggcgagtggcggcggcaacgcacggtagtaagcggtggcaccggttggtagagggagggagcaccggtggcagcggcggaccgtggagggagggaggggcatggatctgctgcggtgccggctgtggagggagggagcaccggcgacggtggcaggccgtggagggaggtaggggatccgcgcagacggtggttgcgtatgccggcggtgggagtcagttgcggctgcttcgcggggtagcggtgggaggctactgctgagcggggcggcggcaggacttggccgcggctgctgctgagtgtggtggtggtgggaggcagccgcggctgctgctgatgcggcagcggcgggactcggctgctgctgcgcgtggcggcggaactcggctactgctgctgcgcgtggcggcggtgggaggcggccgtggctgctactgagcgcggcggcgacgggactcgactgctgctgctgtgcatggtggcggtgggaggtggcttctgctgtggcacatggtggcagcgggatgtcggcggttgctggtgtgcgcggtggtggtgggagcgcggattcagctacaactgtgtatatgcttccttgaatttgttggacatgaatttggttgttggttttgactttaactatgtatattcttccttgaatttgttggacatgaatttgttgttgtatttgactttaactgtgtatatgcttacttaaatgcaattttggatcacaaaatacgataatatgctgttgaaattttttaaaaatcttctataattgtgtcaacaatctgtcaaaattgatatcaaatttatcaaattgaattgttcacctcaattcttcaaaattgataacatggtcaaataagcaaggacaaaagagataatttgtccatagcttaacaccgttaactcaccttaacggattagggtcagatagtacattcgtttttgaaaagaagggtcaaataagcaaacttcaaaaaagtagggttaattagggttaatttggtagttaggtatcgaaacagggtcaattactaaaaataagtaattgccccttaattttaggaccaattttgcataaaccaaagaaaaaaaatcaaaattttgccaaacataattctgcaagtgtattttacaagacatttaggctctttgatttaaaagaaaagtataggtattttgtatttttttaggattataatcctatataggatttatttttcctatatgaaatgatcttgatgtcgcctagaggggggtgaataggcgattttttaaataaatgcgaaagctaaaacaaaacaggatcggattgtctgatatcaggtcggatagtcctatgtgatcagatagtctgaactgagatcagactatctgacctgcacaacaacaatacaaacaagagaacaacctaagagctctagattcaatccacaagcaaagaggtgagctcgaccaataacaatattagcatagcacaaagcaatggtacaagaaggtaaagagagtgagcatatcaccgaggtttacgcgccaatgtatttcccggagttcaaatccttgaggggattctagtctctgttgaggggctcgcaaagagccgggtctttttcaaccctatcctcgtgaggttgcacaaatgcactcctccttccactaagggtatctcttttcttgcggaggcgagatccggccttcacaaacttctcttggccaaccacacgtagatcggtggcccaagaacgacacctagccgtctaggaatcctcaacctccaagagtaataaacaccacacgactcttggacaaatcctagtgctcaagataaagagaaacacacactaggctcccaaacaccaaatccacacacaaagatccaagtcacaaagaacaagggggatttgagatagagagggagagagctcaaagatccaaagcacttagcacaaagctcaacccaaagcaagattggaatgaaatcagtttgggcaaccctagaaaagggttggtggggggtttatatagatcccccaaaatgtgaccgttggaggggaatctttcagcccacgtcggatagtccgatacaagatcggataatccgatattttaaaccttcaaggcaacgagaaacagagaacgaagttccatgaaatttcggactttccgagacatcgaactatctgatgttaaatcagagtatctgatattttagaagcaaaaacttcgtcctcaaacagagactcaagttctatgaaatttcggagtctctgtatcatcgaactatctgatccaacataggatactccgacacttagaaaaactcactcgaaaggatttttcaaacaaagacagagaatgaagttctgtgaaaaatcggatagtccgatacatctgctcaagtaaaaatgcaataactttttactccgaactccgatttcgaagatcttggactctatggaaagctagtttcgtgggctatcaaacccaatataaaacatggtccaaaaccttcaagagatgttgaaaaacttgcaatgaaacccgatgtaagtgttgtgacaagtgaaacaactcgggattaaaattttggcttaggtttttcaactcacacaaacatgaagcattttgagcactagtattcaaccaattatatgcatgtggtatccctcttaatagtacggcatcctaaactcaaatttaaaaagcaaagttataccaataggagtaccttcacaccatattgtttcttcacttggagggttaccaacgtcaaggtcatttgatcattgggaagatctcatcttcttgatctttgacatttcatcttccatttctcaaatgattaatacggataatccatggcttcaaatggcctcgcacggttcatcacgacacagtcttcactcgcccttcaccaccggtttcggttcgtcggcgctaagccccttgcttgcccttcaccactgcatggtccattgtagctaagcgtcgcttgcgcttcaccatcttgccataggtagtcacttcatacccgcatcttcaatatcttctctttaattctcatccatctataagtctatttcctagcttcttcattgttctaatcacttgcttatacactcaataagtgcattagtcccttaatcgtttgtcatcaataaaccaaaacccactaggggcataaatgcactttcactatatgaccctttgaaataaagaattggaaactattgaatcatatgagattcctaaagaatgtctcaatccatacaaatttaggaggatttttacgtattgacaacctgttaattatgtatataaggactcggctgctgctgcgcgtggcggcggtggaaggcgaccgtggctgctactgagcgcggcggcgatgggactcagtagcactatacaatagttaaaagctctatacataggtcccatttatatggactatttttgttatatacattattgttacccttagaaaaacacacgcggtttaacgatttgagaaacgtgtgcgtgggaaaggaggcagtacaagttaaaaagaggtaaagatgggaagaaacgttgtaaacagcagcaattttgtacttatgctgatatcttttcagataaaacgattgaggacacacatctcatttgtcgtataacgcattgttcaaagagtacatacgtactccgtagtactttttattgatgcaagaatttaaaaaaaaaaaagctaaccgtgaacacacacatgcatgagcacacacacgctcatacacagctttatttatttatttatttatttatttatttatttatcatactggaccatatccagaaatacttgcatggacgtacacttgctagatgtatgcctatatcggggtttcagcttaaccgattgtgggggtctttgccactgtgtcgacccagatgcgaacgcgattctcgtcgaactcttgagtgacgatggtgcctaccggaaccacctcaatcttgagatctggacggtctgctttgatcttctccttggcctccttgatcgtccggcaaactagctcgggccactccgtcttgggggtctaagaggaactcatcttcgcaaggaaacaatcgagaagatccaagttgcctgcaaattatgagtggttaattcatgattactgcatcttcagatcatcaaagaaacacctttctatgttaattacttgttgaatcatattttgttctttaaaattgttgcaaatgggaccttaattagagcctcatcttttcgcttatgtttatgcttattaattaaaatttaaatttttaaccttaaatttggagctgatttcaaggttttttttatcgaagtttatttttcagcctttacttttaaatcgctaagaacatacacataaaagttttattcataaattatttttctttacaaatatgccgtgaataagcgaaacgatgactccaaacgccactaatcaaaaaacggaacctctcctcatgtgtagattcaaataataaagaacctaaacaggtagacacatacggtagagacaggagtacgtacttggtaacttgaattgatcgatgcttcttctctgcagtgggttttggttttgcaccgcgatgtgtggatatggatttggatttgtgtaacgtatatgcgtgcatttataggaccatatgaacggagcaatttggtctaaaaaaaaacacagcacaccaatacatcgagcaacgtgtgtaaataacgaagtttcaaagcgggccggtacgtggactagtcattagtggataggcttcaatcttcatgcatgtgcacccacgtgtagaggggttgttggatgcatattcaacgatttggacatggggacatttggccatatggtgcgtggctacttgtgggttgcagatttgaattttgacgatgaaccttgcacatatagagctgagtataattaattcttctaaacgcatttggagctaggaagatttaattaatttcgagctaaataatagtagtagctatgtggcgcagagaggaaatgaaaccataatcatggtagaaccaaaaataagcattagtgatatgtcagtgcttagctattcgatgcatttaacaggcagcggcaacaagcttggatggatttggctgcctgctgcagtgctgctctaagctatagctccatgctgataactggccgagtccatctctgatggtaatggtgcagaagatgaacaggaggaggggatgaaaaaaaaaaaagaagacatggacaagttggttcatcgaagaaatacacatgtagtggcatatttgaaatacctattaaattaagcatgtctaaaattccataaattgtagtggtatattttagtattgaagaagttacaatggcatgatccaatgaatcatatttatatccacgttgcacattgtaaatttgacctgtaaaatgtttattaatcatatcgttttctgcaaatctgggcaccaagtggtatatgcagaagagtactaccttaacaaattgacactttctttctctgactagtagagtctccaccacacacacgtgccaccctttacatccgtgaattttctgagtccagaaggattaataagtctacaagtatatctcatctcagcaaactgggaagcctatccattaacggcaccgaaaaattgcacgttttgcttcttttctcatcttataaatacaccacacaactccatccctcatacaccaaacgcacacacaacttaagaatcgatcaatagagcatctatcattctgctggacaataacacccgtttcagtctcgatagcaagcagtttcaattggttgtaagtacctgttctgatcttaatttgatgaaagagtgtttcgaattaagtgccttgcgtgtacacaacaacaaattaatcctagctatatttgcaggaattttgcttcattaatttgctgtgaccagaatgagttcatcagacagcaagccatgtggtggtcttaagacggagtggccggagctagttggcctcaccatcgagcaggccaaggcgaaaatcaaggctgaccgtccagacctccaagttgaggtgctcccagtaggaaccatcatcctgggagtggtcgtcccgaaccgtgtcatcctctgggtcgacactgtggccgagattcccaagattggctaattagttttaagctgtgtctagctataagtgtaatgatacaataatgaaaggtccttgctttttatatatatctgatgcatgttgtaatgtgataaataaagaaggtataaataaagaagatagtatgtgcatgtacgtatgacagtttcatggccaacatgcgcacatgtgagattgtaatttgtaagatatattttcatgaatctctcacgatcatttgcatttagcattgtcatttcagccataatcccttcaatctataaagttatgacccactaagtgcaaatgagatcctaaagcattgtcatttcatatattgatggaatcagacatccaatccaaaacaacactactgagactattttttgtccctttttttttttttggtttcagaggactggaacttttttcaactacaacagaaaaaagagcggtggcagacagatcaagcagctacatatcaaccaaaaaatagaaattacatctgatgatttgtattttctactgattttgtccctgtggtttcgatcgacctgatcctcttgcttcctctaatccaatatagtgcatttgatctggaatatatgggtgtgtctcttggtatgagttttggtcctgcctctcttcacccttcacgtgtcttgctttgtcttgagaggcaacacataatgtcataaagcccaaagcccagatgcatgaaacaaaactaattcgattttatggattaaaagttcttttcagccaaagatttatattgttcactcagagcggaagtcacggcagcctgccgacgattataagcccaaaatattttgacaaaatcccaaaggcacatgcatgcaaaccagtcaaagagaagatcacagtgcatctctctcacatggcccagatattagcccaaaacactacacaaagcccaaagcccaaagtagtccaaaacaaaaagactatgggcccaaaaccttcattcgtttttttttttgcgcaagctcttttttcctttttgtgtttcagcatgccgttggatgcataattcacggcgcacagaatcgactgacaaccacccaaaattgcaagcgattgcagaataggcgaggcgcctacaaattaggcgcccgatttttttaaaaaaaaaattggtcgctgtttcaccaagtagatcgaacatgttttactaagtaggtcgaaaatgtttcaattttgtaaaaagctgaaacattaccaacaacgtatgaaacaaccgtttctaaaaaatcgaccgttgtttcaccctatataaaaataatgtttcagtaaatagcgaaaaaaatattttaattcttaaaaaaaagtagtgaaacacagtaagatcactggataaaagaatttggttcaacgtatgcaacaaacaattaaaagccactgcaatacttaaaccccgtgtacatcaacaaaccacgtgtacattaagatgaaaatatgaaactataacaaaatccactgtaacatttcatccatacacaataaaacatcatttcatccatacacaataaaatatcatgagtacgttagctaaaacattgttggtgaaaaaaaaccggatttctcttaatagggtgtttctgtaatatgtgggagatttgttgcaacgagacgcgaatggtggaggcgagtgggaggggcgcgcgcgggggcggtagggggggggggagcgtccccattttgagcattttcgcagaataggctgtccgaacgatcataatcacacaccaaaatatctcaaatcggttataccaaacggtgatagtccgactagatgtaaaccagagacttcactggattttattccctctcgcgccaaagttacgacataacgtctcgttaagacacgaataaacgtcacgaattccaacgttgatcgaattttacatgcacaaaccagcagcagcagggttgtgaacttgtgacccaaatgatatgagatgagatccttacacacatcgtcatggcaatatggcacgtatatctaggcgaacttggcgagctcgtcggcgaaggcggcggcgtgcggctcctcgacgcagcggagcatgaggcggatgccgcgcttgggcgccggcggccggaggtagatcaccgacgcgacgatgttgacgtcgtcgttgagcgtgaacacgtacccgggctcgccgaacccgtagtccacctcgttgaaccccacgcggctccagtccgacaccgtcaccgtcccgtagtccagcggcacgtcgtagtggtcgccgccgccgccgccgccgagccagtccgtgaaccgcgccgcgagcgcctccttcgcctcccgcaccacgcccaccacctccgccagcgccgcgccccgcaccgcgccgcggtgacgggcgatccccaccgggtacacgcagttgccgtagtacccgtccaccgccgggagaacgccggcgagcaggtgccgcgtgctggcggcgaacccgaggcggacctcggcgtcgtcggggagcgacgacgcggcgagcgcgcggcacctgaacaccacggcggtcacggcgtcgaaggtggagcaggcctggccgccgcccgtcggggaggcgctgaagtcctccttgatccgcgcgatggactccggcgagacgtccaccacctgggtcacgaagttgaacgccgtgaacgacggcggcggcccgcgcggcgggggcttcggcgggtcggggatcgcgtcgcggtcccacaccgggggcaccgacggcgccgggagcccccgcgccatctcgcccgccgccttgagaaactgcgccgcgccctgcccgtcgaacaccaggtggctgaagcagatccccaccgcgaatccgccgcaggtgaacttggtcacctgtgcaaagcaacaagatctcgaattaatcagcgcctaaaatttctctcgctggattcaaccatcaatcga

SEQ ID NO: 4197 - DNA, 12109 bp, Oryza sativa
  unsure (1)..(12109): unsure at all n locations
gcgctcgaggttgttcacgtcggcgagcgtgcagctcgccgtggcctccacgaaccacaccccctcgccggtgcagtccaccaccacgtccccgggggccggctccgcgatccggccggccaccgggtagtacggcacgagcgccctcgcgaacccgtcgcgcatcctggccacggcgtcctcctggccgtccgccgcgggcccgtcggtcgccggcgggaacacctggatgaagtccaccgagacgcgcaccgcggcggtcttgtcgatggacgacagcggcagcgcgccgcgcggggtgggccccgcgggcgggaccagctccggcgccgacttggagacggtgggctccgcggccgcggccgcggcggcgacggcggcgacggcggcggcggcggccatgccctccccctctctctctctctctctctcgtcggtaggtggagtttggcgccgcgctggctgggctggtgctttgccgctttccctccccaatgaatggaagtggttgttgctaagtggcgagcacgagctctcaatgctcagtgagagtggttgacttcttttttgcctttctttttctcgtgtggaattttcaggcatttttgttaggtatagatgattagatctgatctgtgacaaactgaggacagtgtttcagtgggttggtagctcctcgtggttggaagattagtggacttcacatgaccatacatgtgttcttactgttctcccccctaagattcatttctgaatctgctcaggtgctgagctccatcgggccctgacgaacttggaacactactgaagctggatgatcaagggctagtcttctaaactctaatgatttcatcgttacccaaaaaaaaaaacttgtgtatctttaaactgtccttagtgatttaaaaactaatgctggaaaataaacaacaatcgaaaagcctaaaggtagactttaaaattaagttttaaaattttaatatttttgttgtggctaataagccaaaagacaaagccatgatgctagtctgactgcactgtactgagaatgtttcatcacacagagttatgaataggtttcacagattggtggtaaataggcatatgatgttactacgacatgtgaaatatcttcctgcgtatatccacagaatgacaaataggccgtctcaggcttgaccatataggtggaaaatgaaagataatgttcatgtaggactatattgtacaaattcttgaaatcaatggaatcatttgttctcaactgtaacagtactgcctcaacaatgtcaatcaatgtataatgtagtatggtaacaacaatacagaatacaaacacgatccaccttgttttatttgtaaccaagttcaagaagcggctattcaacacaccagaatacaacagctctcaacgctgcgaagtgtaggcgtataaacacgaagttacctctatgcaagcttctgcaactcctcaccgaaaaccttggagtgctgagcctccacgcactgcagcaccaacctgattccctgcttcggcttgggcggcttcaggtagacgacggacggcacaatgttcacatcatcattcagggtgaacacatagctcggctcgccaaacccgtagtccacctcgttgaacccgacatggctccaatctgtgacgactagtgtgccgtaatccagcgacacattgtaatggttctccttggcaccaccgctcatccaatcgaggaaccgtgtcgagagcacatccttggcttccctgatcgctgtcacaatctctacgagcgacgcatccttgacctcctggctggttttggcgaggccaccagggtagacacagttaccgtagtagccgtcgactgaaggcagcacattgttcagcaggtgacgtgtgctagcagcaaaacccagacgaacatcggcatcaggtgcaaagtcaatagccaaagtacgggatttgaacatcatggcagtgaccacatcgaaggtggagcatttctggttggtctcacttgcgacctggtccttgacacgcttgatgctatccaacgagatctcaatgacggatttctcaaagttgaatgcagtaaacgatggaggtggtcctagaggtggcttgggagggttgggaatggcatccctggcccaaattggtttgagtgatggctcagggagccctcttgccatctcaccaactgctttcaggaactgggctgcaccttgcccgtcaaacaccaagtgactgaagcaaatgcccacagcaaatccaccgcatgtgaacttcgtaatctgaaggaaaggaaattgaaaaactaatcattcaaatcacagaacatgcaaattcagtaactagtctaatacaggccatgttacaatgtcaacttagtgtcagactattttaacaggtagtggtaccaaggatgtgtggcatgaacaacatttacatgaaaattgtcatcgacttagtacctctttagcatccaacatgaaaaaatttcactgaacttagaacagaaagttaaaacattcaacctattgagaagcacgcataatgtcatcatgtgaatcaaaccaaaatctatttgtaactaagtactccctctgtcccaaaatatattttgggacggagggagtatcatatcatagtatccaaaaagcattaggggtatgtgaaccctcatcctcatccttgcagccttgaatgtaattaagctatgtaggtagaaaggacagtactatgtgaaccctcatcctcacaagcttggaagagaaagcatggcaatgatttgcaaggttggatatcaattctcatgaactacctaacagattggatcagcccaggcatgccatgtcatcatgagaccatctcttcgtcacatgcaagcttggaactatggaattcactaacagcagcaagcaaaaatgaaaattccggtgtccagacattgagcagttgcagcatctgttgctttcgatatcttgtacaaaattttccaaggcttattgtctagctgttagagtttgtgtcaaatatgtgtatgttcaatctagaaattgagcagacagtgtgattggccttgttaaatttcgttgagggccttaatatatctcccagaaacacttcaggactcaggaattgagcagtttgtgtcaaaggttttgttaaatttcgttgagggccttaatatatctcccagaaacacttcaggactcaggagcgtgtgcggttcaaagtcgggtaatgcaactcaagcagggcataagactacgagagtgtcggatgatccagtcggttggtccatccatccaacggttagaaggcgaggagagaagtgccaccaggatgaggattgagggaaggacacacaccgcgcggtccagttcacctcaccgcgccaccggagctatagatcactttcacttgggatcagtagtgcgtgatactgtatacatacaccaagtcagaagtttatgctagtagtactacgtcttaaagcaagtcagaagtcatcagcaagttcagattggtcagtcacactgtctgcagagtggagtcagtcacacaattgagcagttgcagcaagttcaatctagaaattcagctagaccttttcctttcacaccattgccgccattgacatccccacattaccgagtcaacgatagcaatggtgaccaaccctcctcacccccacagatccacaacccccaacctctcaggagtcagatccagaccaaatttgcagtggaaaatttagctcaagtaacaatgggtgatggaatccgtacctgcgcgaggagcacggtgtcctcgacgcggacctcgggcggcgggcgagggagcagctcctccttggggatgcacagggggcgctcgaggttgcgcgcctcctcgagcgagcagctcgcctcggcctcgatgaaccacaccccttccccggtgcagtcgatctcgggctccccggggaccggctccgcgatgcggccggcgacggggtagtagtggacgagcgccctggcgaaaccctcccgcatggcggcgaccgatgcggcctggtccttggcggcttcggcggaggaggggaagacctggatgaagtcgacggagacgcggacggcggcggtcttgtcgatggaggagagcgggagggagccgcccggggtgggccccgccgggggcaccagcgccggcggcgacttggtgacggcggcggcagccatggcgcggtcgatcgggaggagggaggaagcgaggcagttgagctcgcgcgcgtgtcgcgggagaggaattgattaattaggcgtcgtgcgatgctgaggcggtgaggctttgagtaggaggagtaggtggcacactgggccactgacaccaacccgacgactttgttagttggacttgtcgttaaccgcttcagtaatcagtaaaagtatcgttaattagccgagctcgaggacgcgacgagttgcgcgcggagaaggcgaacccggcgatggggaggggagggtgcggtgccgaattgccgatgaggtcgacgtgaagcccgaggctcgaagacggttgtgttgcggaggtggagcggggaggaggaaaccgcggtcgcaccggcggcgacgagaccgagagggaggggcgtgcttcggatgcggtgggcggtggggagagagtgagcggagcagagcgcgtcggcggcggctgggccggtgagagcccccgttcgtggatggaagcctagaggccgaacccgatatttgttgggaaaatgtggcccatctagcagaatttttttccggaaaaagtacaccgaaggtccctcaacttgtcatcgggataaaaaagcgtcctcgaaccgcaaaaccagatatatggggtcccttaactatacaaaaccgatcacccgagatccttcggtggttttgactccagttttggtctacggggcggctgagtcagcgtgggacccacgtgggtcccacatgtcaggtgtccacgtcatctctctttcctctcttctctttcccttcctcccctctctgctctctctctctcgcaggcagggccgatggtgaacgggttgagcagcggcactgcaacggcggcggtggccgcgcacacagccatggacgacgttgaagtggtgagcgtacttatcggccagtactacaacgggctggtgctagagctcgtggtacaccgctctcgcccgccaacgccgcctctccgcagcaccagcaccagccagtcatagtactagccgataagtgcactcaccacttcaacgccgtccatggctgtgtgtgcctggtgcttcggctcatggacttcgccggcgttggtcttcacgacggcggcgtcgggtgtctccccgcgtgagcggtcgacgaggcgcgtggcctcggcgaggtcgtcgcgggcgatgaggcggcagagcctggcattgggggacgacgcaatgggggcctcgggcctcgtggcggcagcggcgaggtaggcgtggtgtgcgcggcggcagtcgctgtcgccgccgaccaccgtcgcagtgccgctgctcaacctgctcaccatcggccctgcccgagagagagagatagaggggaggaagggaaagataagagagtaaagagagatgatgtggacacctgacatgtgggacccacgtgggtcccacgctgactcagccgccatgtagaccaaaaccggagtcaaaaccaccgaaggacctcgggtgaccggttttatatatttaagggaccccgtatatctggttttgcggttcaaggacgttttttatcccgatgacaagttgagggaccttcggtgtactttttcgtttttttcctagctggaacgggccaaaactggtgtgaatacttccggcccaacctcgcttgccctctcctctcaagtctcaagaccatgggaggggaaagccgaaaaggcccaagaggccaagaaatgtaatttgtctcgatcccttattcctccttttctcttaaaaaaagggcattgccactcgaatgacagttttagtaatattttttaattttttatatcagttttataataccgattcaaaccagtggtaaatttataattttctaaaaaaaaaagtataccttcctctttcttttttttttcaaaactttatctttctgtagttatttataattaatccatttacaaattttctgatgttgacgatgggcaacttagctttgctgacaagggaaatttaactatatgtcactatcaaaatttagcaactttctaagtgaccctcaattttaaacttatgaaattaccaatagaaagataatgtcttaccgtccttggatctgggtcaacgtcacccgctccatcccacattccctgaccaccgttgtagcctctcatgctctgcctctggcttcctctgctattcacgacgtgccacatagatcttcactcaaagccctaatcatctctgttgggacatgaaaaggcctcccaagctcgctgctcaagggtggccttgcattgtcatctgccagatcgcggaatgggaggcccctacctccacgtcgggcctcctttgcacgaagctgaccccctaacctgctccctattgccccgtcatctagagactgctacaacgggtccctggctgggatgtggaggtcgccagcatcatgggctccctcgcttcattgctcccatctctaagatggcccgngtnnnnnncnnccccccccccccccaacaaccaccacccttatctcccttgccgcaccactacctacgcctactgagctagcaactgtttttgggtcgagcctccaccactgctgccctctctaccttgtctggctggtgggggtgatgaaggggaggagagagctaacttgtggatcccacattgatttttcacgttggtaagccgcacatgcaaaattcgcaaatagttaaaaaaaatcaactctacctattggcagttttgttatgacaaaattaagagaggaatatttgaagatttgttaaatccaatagtgacaaataattaattttccccgatggcacatcctcattttacacccattgacacccaccgagtacaacattatagttgctcatttcactcgtcgacctcattctttttagctaccacacaaaattatcatcacggattatttgcttcaagtctcttaaattatttttttaaaaaaattattttcgtattgtgttgcttgaaccattcggagctaatatttgttaatttcatatttataaatatttaatttatcatatggagcgtgactaatgctgaggtggatgtacagtaaaggtggaacggtgcaataatagcaggttaagtctacagttgatcaacatactttaattagaaaaaaaggaatatcaatatatcttgctcatcacacacggatgtcctccgagttgttgatgaaacatgaaagcattgtgtgtgagacaccactcagccgactacaatggcgaagcgccttttcttctcgctctcgatagatcacattcacaacaaaaagcgcaaaaagcgcgccattatttatctggggctggcactctggccaatctgttctttttttcgcgccagtgcgcacgcagcgtaatctccgtcaatttatctggctcaaaacttttgaccttcgtgtgtgcaacgcaccagcagagggaggcagatcggctattcggctcccatcataattgggttggaaaccaaacgggtaatttaagcgtacaacgcaatgcaagtttaaaggagctagctagccaatggtggatcgataccatcgccgatctatggatatagatatagatcgataatggtgtatatcgacagcgactcgggtcccttttccttttttttccctcctcctcacatcatccatcatttgatcgatctgatcgcaacgatatagagccatacaccaaaacgaacacagccaactgatgactgatcgctcattggttgtgcagacaaagagtttggccaatggaattatcggctagaattagctcgatcgacagcaacatgcatcgtcgccgacctcatcggacccctcctgcccgttccatttcggagattcgatccactcatccacgcgctgaatgcaatcctagctgctggatgatgatgtacagaggatcgatgcatcatgcatggcatggagcattacttctgttgcgcaccgccgccgcgcgtgccgggcgatcgatcgaccagcctgcatgcatgcttgcacgccgtagtggcgggcaaccgccgcaaagccaacggcgccgcattcttcatcgcgacgacgatggcgacgggcgacggcctccgttttaaaatggtttgacaccgttaactttttagcacatgtttaaccgttcatcttattaaaaaaatttgtgaaatatgtaaaactatatgtgcacatgaaagtatatttaacaatgaatcaaataatataaaaagaataaataattacttaatttttttttaataagacgaatgatcaaacacgtacttaaaaaattaacggcgtcaaccattttaaaacaaataaagtatattaggagacccggggtcacattttagccggcgagttagcagcaccccgcgttctctctgctgccgcgcactgatgagatgctgcttgaaaatttgatctgcttcaaaaaaaaaaaaaagagatgctgctgcttatgtttgggacgtacgctgtgcacggtgcaccggatggtcgagatgcatggagaaatatgtatagcttaagtagctagcgcaaacatgtaaaggaccattgaattaaaaaaaagacatctaaaaattatccacatcataataaataaaatttttactcgtgatataacatgatgtagataaatcttaaacatctattcccttcgtcccaaaataaatacagttttatactattcacgttcggtcaaacgttgggcacggatatccacggctgcacttattttggggcggaggtagtactctttattcaacagtagtttctagttttacgttacacgtgaagtttatgcttccattttctcgggatggatgggaatacgagagtgagatcgatgtcagtgcatgccacccatgcagtatagtttgtaaatactggaacgggatactcaaaagtcaaaatgtatgaatttagctccatgaattactgtttggaataaaatttgttttggaaagctatatgcagacatgtttggtgtagcaaaattttaagctcaacatggtcatgccatttgcggtgacggtgtgacatgtgcggtacaccccaccatgcccacgacacaataaggtgtgttttctgaatcctttcactttctgctgcttcagagaggaaaaaaaaagattgtgcttttggccagcgtcaatcaaaagcctcccagctggttgatgttttattttttccttttcgatagatggtatgttgtgctttgctactatgtaaagataaatgatttttgaagatacacgagccatagaaaatatacaaaagaacagaaatatgagcgatgctacggtgctctctactggtaatatactttataaatcagtaatttattagttcaatgattaaggataagtttgttatttatgtttattttttcagctagatcgatatgtggtaatccattaccctagcatcgctcatattccatcgaaaaagcccaaaaaaatgtggaaaaatgtttagtcactgctaaatgatgattatgcctctccacactttttttaacaatgatgtttctttatgtttctattacttctaactaaggtgatatatatagatctaaactcttcgatcaaataagatcaatagttaatatttctttctactaccaatgaatagcaccataaatggcttaaagctcttcacttatatgcccaatagtttttcaattgaaagttgaagctacacgaacgtaccgtaattacaacaataaaatgaatgttaaccgaagagaactaaatgtctttataactctttagtttcacatcatcttattcctcctagctctctaattgatgatccaaaggtcaagatttttttaggtggtgtggcttaatgcatatttagttttttatttcaacgatatagaatacatagatcgcgcaaaagaaacatatgcacgtacacgccactagacgtaacaccatactcatgcacccacgaatacattcataatatagtaatacacgcttatagagatggagacctatggcaactacctagtattactaaaattctaataaaacttcaccggtatgtgcgtaatatttatgagcatccagatttaaacaataataagcgaagctataatcacctacatacaactttatcaccacgtcagtgacacctcctttttatttggttaatattgggctgttggccctcgtatgtatctcggaatgaaaattctttgagattcacaagagctactttcactagccttgagaacgtgtcgtttgtatgtttttagttaaactttaaaatttgacagcaattatcgtttaaaacatgagaaaaatctaaaaattgccattgacaaacacccaaatccaagagttgtatcaacgagtgtgagtttcataaaatgttatagtacaatcgattttgtcccgaagatatcatcatcgttagagttccatctattccacattgttaaatacactgttcattctatagcacttaacgatgatatttctatatcatagttgcttgaatgatggcatttcatgaaactcgtacttatggatagcattttttagaattggacgtttatcaatgacatttcttatatttctcttaaaatattttgatttgatacatgaagctcatacggtcatatatttctcaaaatatacactcttacaatattgtaattttatggatttttgaaatacattttataggaaattgatggttacaattaatttcgaagattgtaccaatgtttcatatttaaatgacatattaccatgatcgggaggagtagatggatctaatttaagtcaaattgttggcttacatccataatgttaaaaaaaatgctagattgccagctatgaggttttagattgtgggggagaaaagtagttggtggaacggtagggacaaaaggtaattaaattcgagtgtgcaagttaacaaaggtttggtaaaacttgtaaagctgtactatgttaaaaggttgctctatcataaaatgtggagttgcgtattatgcatacatcgcttttagcttccaccaccttgttcttcattgtaccgagcaaaattcaacttcacaaaactaaacccagttgaaaagaattcgtcagctgaaaaaaaaaagaacatctcaagacatcaagaatctcaaaccttgataggagtacattattcatttcctccacttaacgaatacaatatgattagcttattttgttttgaatgcagaaatggaagatttttgggtaagaaacaggaaaatggctgcgtcctgacaattgattagcacttgattttctagcagagctaccctttttgtttcaataaaacaggtgcaaattaggcatgcctccaacctgctgcatgtactttgacctttgtcatcactgtctcacctcatatgattagcatcttaatcttgcttttcccatctacctctagaagagaccatcaaaatggcaaatctaacacgaatgcgacagtttcttccctatacttggaaaaggacacaaacaaaaagggcaatgataaataaattaataatacttgaaaaacacaatcacaaagtaacaagcaaacaaaaaaccacctgaccatcaaattatttctcccaatttttcatacataagaacatccaattccaccagaatttgatcaatatctcccatacatacaatttaattacatatatatatatatatatatatatatatatatatatatatatatatatatatatatatattcgtattatcctactcgaacccaagatgaaaatgtctcagagaaaaaaaagcacagcaaaaaaagagaagaaaaaaaatgtcgaattcagattgagcaattactatttgcattttttttg

SEQ ID NO: 4198 - DNA, 3152 bp, Oryza sativa
cgtaagtgagggtgaaggcgaagaagcccagcctcgactggaggtcgccggcgcccaagaagacggtgccgaggaacgcgccggcgaggagcgactgcgccatccgcgccgcgaacagctgcggcgtccgcagcaccgtcttcgcgaaccgcgccgacaggatgcacacctccgccgccgccgagttcgcgtacggcgcggagctcgcgcgccgccgtgacgaccccgacgcggcgtccgcgtggctcgcgtccgccgtggtgacctcgggcttgagggagtcgatgcactccatggcgtactcgaggacgttgacgtggggagggatgccgtggccggaggcggcgaggctagcctcgaggaagccgagggagccgtggtggcggacggcgccgtcggcgaggaggacgacgcggtcgagcagctcgaggatgcggaacccgggctggtggatggtgagcacgacggtcttgccgtgcgcggcggccatgtccctgagcatcttgacaatgtggagcgcggagccggagtcgaggcccgaggtgggctcgtcgagcagcagcacggccgggtcgtgcacgaggtcgacgccgatcgacacccggcgcgatcgccgcggacaccctccccaccctcgacccggccacgtgccgcagcccgagctccgccatcagcttcctcgccctcgccaccgcgggcccgccattcccgccgaccgccccgcgcagcctcagccgcgcgctgtacaccagcgactcctccacggtgagcatcgggaacagcgcgtcgtcctgcgggacgtgcccggacacccgccggaacctcgcagcgtccatggcgcgcccgttcaccagcacctcgccggcgaccaccctcgccgggtcggccgacccggccagcacggacagcagcgtcgtcttcccggcaccgctcggcccgacgatcgccaccacctccccgggcggcgcctcgcacgtcacgcccctcaggagcaacctctcctccccaccgcctccaagaaacaacctcgccgccgcccccctcgccgggagcacgtacgacaaccccctcgtctcgaggcggtacctcgacctcctcctcccgccgccgacgacggcgacaccaaccttccccagcgacatgggcggcgacaccgtctccctcggagacgccacggccgcggacgacatgtatgcgggggactagagagagtacgaagtgtgcaagcgaggaggagggagagagtcgctggtcggatgagagtgaggtgagctacccgaccaaaccaaagtgtccaagcaaaccaaacccctcccctcctctcgcgcgcgcgtttgagctgtgggcgtgtgagagatttcgcgcgcgcacggtctctcttaacctacgcccaccgcacggacgtttttaaggggggtttttctgtcacacactgatgatttggggcttgcttgtgaatcagggggaagtgacgatttgggggcataacacccaagcttctgaaattggtgtactgggacggatcaacgcatggcactatttttattttccatttcaaatttctcatgccggtgatcacctcacctgtgtttgtagttagttgggttgctatagttgtaatagtttatttttctaccgattacgtcagttaagtgtcgtcccggtgctcgatctgagaattagggggtgatattacggggcatctttggttcaattggttgcctataggctaataatcagatcatgatctggacgtttgccaaatggaagggtatgctatttgcttcagcttttagtggccaacttttgggcagctggttttgatttaaagtatatttgtatttcaagaatcaaaagtattttatttactttggaatttatccagtgagcaaactactagttctatctttatcttccaataatccaaacaaaaattccattgttgatgcgttgttttgacatgaactcctctatggtatatttattaattatattgtctaggtgtatagtcaagattattttttaaacagtatcaccttttttttctaaattgtatttccacatgtgtcttttgttttaatttacaccattataatttaatcccccgccatacttttaaaatttccacatgtgtcaaaccgtatattcttctctcattaacatggtacttaggacataggattgaaccaggtctttttaccatactttttcttacaagtcgttttcaccgcactctaatgttcgcttcgttctcaaatatttctcaaatgtcaaattttatgcgtggaagttagatgattatatatttagcatgcaacatgcttcaatactatggtataatttcaaatatttacaatttagctgctagaatagttgtggtcaaaatttgagtataaatagtatgtggtgacaagtacccgggaatggatatacactatcatagaacaaaaataacgtgtgagattagcctacacttaccaatggccgtggtatatatccatgtgtcggtttttctctataaaagtaaaacgactgccactgtgcttcaatacgatatataatgctctcaatatttttctaatatatattctccctgtattgaattttgttaagacattttaattttgaaaagtcaaactctgtggattttgatcgacaaatagctcaattacaaatgtgtttagtgcatagacctgcaccgatagatttatacttcaaagtgctttcgcacaatgtagtctatatccattaaaaatacattttatgggaaattaattatcaaacttcattcttgaagaacaatttcaaaaaaaaaaaacgtcctctaaaagtcaacagagcaactcgtagatattattatgtggactgttttttaacacttatataactaacataaataatagtagatgcataagtccaaaattaagcttgtgtggaccatgaatttattagttgaacctgttactcatccccatacattatattacataaacaaggcattactcaggtttctactttctcctcctccatgttccttttttaaaatttcctggggagatttccctttcttattgtcgtccgtatttgtactgtagtcatctccaggaaaattggccctttcgttttgatcatgtcatcgtcaacctgcagcc

SEQ ID NO: 4199 - DNA, 13342 bp, Oryza sativa
aactatgtctagactgtgttccacgtatactttttttttcttaaaaaggctaatctggataactatgtctagattttttatcgtaggtaaaatcacgtagccatttttttttttttttacggagggagtaccgtggagagagcactggagcccggactctgcagggtcggatcgatcaccggtgactgctccgggttggtgcggcgccctgtggctgttgcttacttgcttgtgcgacgcgcgcgcggggcaacggcgcagctgcgcgaggcaagaaaatgtttggccaatttctttttcttgttttttttttctgatgagctgcaccattgactgggcggcagatcagccagttggttggaggtggcttcaccaccaatggcgcgcggcagcatggcagcttgccttcctctgatgatgagatggtgatgatgatgatgatgcagccggccgtacaggtttagagctaagcagagtacatggcggatggctactccctctgtcctaaaatataagtattttttaactctgatatagtttctgagatgctattttcactaacaatatatataaaagtaagatgttttaaattaaaagagtggtatattatgatagtttgtttaatgataaatctaataacatcaattttatatgattgatcttttttatttttttattaatgatcaaagttaaaaatatttgacttatcactatgctaaaaatgcttatattttagacggattgagtacttttttttcccttattgagattttcggagatcgagcatctgctctgctcgagtgacgatgtgcaaaaggacaaggatcagtagcagttacaaaatgcgagagaagaaacaaatagcactagacttcgaagggaaaaccgagaattcgaattcagtgggcagcggcaggctcgatcacgatcgtatgctcatgtagacatgtacttagtactttgtcaatggtcatgatggggagaatttaaatccaagaaacggaggtatagtacattggtacgcaataacgcaatggagcaagccgataaggccatggcgtggccttccttttgccaaaaaaaaaaaaatagtcaacacagagctacgtgcggtcatcctttggttgcatctgtcctgcgagatactgacgggccggccaatcaccaatgtgacatgtctgtacagtgcagcatgaagaatttctccatacagaggagtactccacagggtataccactatagcttagcactagcagtcgcacagccacagctcacagtataaacgcattgcattgccataggaaagtacccagagattaatgtgagacccagagattgccatatgtctcaggtcaggtccccgtcaaagactaataaaataaaatcctgagccaggtagatcggagttgtcgtctgatcaaacctgattttcaccaagggttcatcgtttcgtccacggtagctgcaagcaacaaactgctgttacaagttcccaatcctctcaaattcagacatgcttttttttttaaaaaaaattgcaggtcaggtacgcgtcggctcgctgtttggggatcaccattagcctagtcttgctgttgcaggttagccatggatgcactgcacgcagtcacccgagaacacaataaaattgcaaagcatatgcatgctcaaacttgcaggcaacgacatgcgcagctggctgggacgctggggtaggcgctttgcattcatgaagctgcagatccgatcagcgtgcagggggggggggggggggtataatccttgctggtgatgagtgattggcgtgcacccaaacaaacagtccgaggaaattgaggggcgacgtgcagtgcaggccgggcatgctctcactctcactccagtacctgtactgctctgtgtgtttattgcctgcggttacatgtctggatttgtgggtggacttggcgtggagtgattgggagagatgaggtcgcccttgccttaaaaaaattggaggattttgccgtaatgccatatgggcatgcacggtggatgcaggcatgcagcccgaaattaagtactctccgttaaaaaaaacaatttctaagagtgtatctgaaatatattcatttagattcatctgtataaggttttttttttttacataggaagtatagaactatttaaagacttgagcaggttttgttgcgtgtagatggtctaagaactcgaaatgaccagaggactctgtgattgctattggtgaaaaggcacggatcgattctcacctatctgtcgtatttgttcggaaaatgttttgaaaccatgcatggaagaatatatggtgcacggtacaaacacaagcgctcgctttgacgtgtatatcacctatcactgaaagaataattagttagctgtaaatacaattatccgtgtcaaagtttaggacaggtggcaaatgtatggtttaattggttatcgtttgcatttcagcttatcattcacacaagcttaattttggacttatgcatctactattatttactacctccgtcccaaaataagtgcagtcgtggagatccgtgtctaacgtttgaccgtttgtcttatttgaaaaacttatgaaaaaaactaaaaataaatagtcacccataaagtattattcatgttttatcatctaataacaataaaaatattaatcacaaaaaattttcaaataagacgaacggtcaaacgttggacatgaatagtgcaaaactacacttattttgggacggagggagtatgttagttatataagtgttaaaaaactaaatttaatttttttcaagcttaatttcatacttaattttgatgttatttgttataatttattctagcattgacttttaagtccataacgacacatataaaatttttatctataattattatttttcctccaataaacgttaagtgtcttataatcagttgtaggatgtctttttggagagaacgttcacatacctaaccgcaaaatattgattatagtctcgattctatttttttcctattctgaatttcagttacaaatacgctctcattgagcggctttagcaggacccctaaacacaggtctcaaacaaaacaaaaattgagggttaaggtttaaaaactagatccatccctactgaagcccctaaatcatctcgaaattatttcatgccaagcccctcagtcttaagggctggcgactgtggatggatcttgcgcaactccggatcctttggcccactctagccgccgcgcctctccgacctgctccagcgaggatggagcctagttgatggattgagatcctctaccttcaaagacaccattcctttgtcactgacaggacaggtgtatccatgattcattgaactcacatgttagtgacaaaggcacctagctctgaaggtagagaagcctgatccctagtcgatcagcatcgtgcttggagcattggcctgatcatcgatgaagcataggcgttctctatatggactctatcttcttttggttttcatttttgtcaggtcatgtattttctcaagtgaaattgcaagtataggtgtgacgaacacacacaatcaaccatgtacttgatcaaggagctcaaatcaacctagtctttgcaatttctgtagctagcactggcatcatcacgaactccggcacaacgatcagcgcatcgtcagggtttagagggacaggagatgcagaatcagatagctaggtttgctatgagatcagtctgctctgaaatattcatcgatgtatactttcttgttttgagtaaaccggcatatgtcgaaatagaagaaaaaataaaatgaagactgagaaatgagagctgttaccggacttaaaaggtgatcttagggttctcacaaatggggtaacccatatatacattttaacaactttaaaatatgaaatattgatggagatgctctagactggacttctttcaaagccttatatatctccttcacaggactcctcgtctcttcgtctcatcgcctcgacctcttgtctcctcgctgctgccatgccgccaccctagcaggccgccggagtgccgtgcggctgcgaggaaggcggcggcagggcttcggcgggacctgcgacggacagtgggattgggtctggggtttgcccccagatctggcggcgcgctagtgcgagagacggcagggccatgggcggcggtggcaggccaatacctggttgcgcatggtagcagaggtggtcaggagaacagcgccgcggcaggtagcagcgagctgtcgacgacgccatggcggtgtttctttgggaggcggtgggcgctgcggaggacgttggcggcaggtgcgacggaggatggtggcggcggatgcggcggaggacggcggcgacctaagcgtcaacggccaaccctcggcagggagaaggcagatccgacggaggtggttccgtaggtagcaacgaccctaggaatggcggtggcctgcgagtccaagcagaatacctcctcggctgtggcggcagcggcctaattgccagtgcaaggatctcggcaaggaggaggcggatcaagcggaggaagatctcatcggcagtggaggcctgggagtctgagaggcagaggaggattccgacgatagtggcggaggcctaggaattcggcgaagcggaagcggatcctttcagctcgcgtttggtcggctgtggccttatcggcggagcgtggcatcaactcacttgaatcggatgaagatgatatgaactgagatttgcagcgacaacgcactagggacggtggcgactagacgtcctccactcgtcaattttggccgtttaagtagaggatgtcaagaagcaaggatgtggcgagatcgtaggtttttcctttttgttgtgtgttctcctttttaatgaggtgtgagtctaagtgctcttctatcattttgactgtgtatatccctcgtgtttatagatgccggattaatgaatttagaatccattattagaaaaacatatcgcctttacagaagaacaaattataatggaaagaattttggaaaagggacaatgacactagcagcttaattttcctttgtttatccgcgtgcgaaacggatgtaaagttgatagtatttggacatgtacatccgtgtcgtgtcaatggttttcaaatcatctcatgttttcattactatctgaatcatgcttttgagatggtgcatgccgtcatgcgccaaaaataatatactctcaagttacccggttccttttcaaatacttaactctattgaccaaacacatacatatccatctagccaaactatatatttcatgttttcattactgtattatttttaccatgcttttgagatggtgcatgccgacatgccgtcatgcgccaaaaaagtactctcaagttactcggttctttttcaaatacgtaaacatataaccatgcagtcatattttagatctacagaaaagaaaatgaaagctccacagtgtctcaatcaaaaaataaccaggagtgggtgatataagctgggaaatggaaattttaaataaagtgattttggaaacacgcaatggaagcagatctcttactcatcacctcagcaaaaactagtttttctgaggaatggacatgcctagggatgtaagcgggacgacctatgaacctatttatatgttaaataaagggtaatccgcgggttttcacgtcatggctcagcttgctgcgtttatagaaaagcaagtgggttaatatataaacccatttataagtcaaattagtaggtaatccacgagttaacccgcgggtcactcactaattttgtctataaacgggttctcgggttggcccgcttacatccctagtcacagtacaattaagagatttgactaacataacaacataagtcatggcgtgtaactacagcagacgtatcaactccaaaatgaaaatgattaattagatttatgccactgtaaatattgaggttttaaaatataccattataatttacgtatttgtaacaatgccacgatcacttgtttataatttcagttgtaccattaagatatgtattttacctgtatttgataaaaatgtcctcaccctctggtggtcgagcgggacaggtggaccggcggcgaagctctctcgagcagatcaagatgatggagctcgagtgcgacaggtggacaatggtgcagctccagcgcggcggcgcttccagatccgtagttggggaggcgcgggctctttctctcctccccccttcctcattcatacagacggcaaccacgttcataccagctaacattagatacacgtgttctacccaaaggccaatcctttcgatgctctatcaacttgctgccattattctgctcgactacaagaagaacaagcttgtcaggatgtatcatcaatccatcccccgccggcgacccaaggatttatcccaacccagactcgtcggcattactcccattgatgccatccccccaccgaggccaagctagatgctggagtgcagcagcgcgcacagtgcagctacggtgacggtggtggtgggtcttgggctcgccacgttctcgcggatttggcggcccctgccccgccaccgccgctcctcccctgggagcccatcgccgtcagttccaacttccacctactgcttcgaagaaggagagggaagatgaatatgtgagatggggagaagaccaggaagaagacgtgggcaattttatcctaaaattttagaaaatggttgaagggataggtagtgaaaaaaaacgtatactacacaaattataatggcatggatcctgtaaaaaatggtgaataagattgattgagcgggagggattgagcgagagagaattgcacacaagaatgtagagaatgaatgaacggaattctttattgatcaatgcggtacaatatatagatggggaaggggtggcaaccggagacacgatggttgggaaccatcacgtccgttcccaaggagcgcctagggaaggcgcggttgccttcggttgcgatccatccttttatatggatgagatcacctgttgtttcataacactcccccttgatcgaatccagctttaatcattgctctttcactgttccagatatctgtaaagataatcttagaaataattatagttaaatacatcacgtaaaactcatcgaaaacccagtgggaaaaataaggagagaaccgtgatatatattattgactattttagatctatgagtaaagctcatagtatgatccaaaatagtataatgtctacggttatcatttagtaaaaaccctagtggggaaaagccaaatgataagaaatataacttatgttgatattacctcgttaaaaactttggatgagaaaacctaaagggtaaaactcatacaaaggaaaaagagtataatataacgaaaataggttattttccagaggaagatactccccctgaatcctgcaaatttttatgtcgtatcataccaattccttcgacacatttaaagaatgtggagtatggtagagattttgtgaataaatcaacaagattatcacatgacttagtttgcaagatgtttatctctccatgttgctgaagctcatgaggataaaataatttaggagcaatatgcttagtgatgttgctcttaatataactagtttccatctgaacaacacaagcggcattatcttcatagataatggtaggtgattccaatgaaccaataccacaagatgttaatatgtggttaaccattctgcgaagctatatacattcacgtgatgcctcatataatgcaattatttcagaatgatttgtggaagtggctaccagagtctgtttagaagacttccatgaaatagcagttccaccttgtaaaaatacgaattatgtttgtgatccagcattgtggggatcagatagatagccagcattagtatacccaattaaagttgaatcctggttctttttaaagaaaagtccaagatctcttatgccattaagatatcgaaagacattcttaactccagtccaatggcgtttggtatgagcagcgctgtatcttgctaatagatttacctggaaagcaatatctggcctcgtactatttgcaaggtacatcagtgcgccaatagcactaagatatggaaaatcaggaccaagtacatcctctccatcttcctttggtctaaatggatctttctccacgtctagagatcgaaccaccataggggttttagaaggatatgacttgtccatattaaatttctccaaaattttctgggtatatgcactttggtgcataaggattccagaaggtaaatgctcaagttgtagacctaagcaaaatttggtttgacctaaatccttcatctcaaattccgtctttaaatgatgacgtgcttcattaatatcttgtgtattgcctatgatgttgagatcatcgacatataccgagataatacaaaatcctgtgggggactttttgataaagacgcacgggcaatcatcatttttagtgtatccctttagcgaaaggaattcacttaatcagttgtaccacatcctgcttgattgttttaagccataaagtgaattctgcaacttaacacaatacatgttatgatttaccttctgattcgggatgtcgattccattaggaaccttcatgtaaatatcataatcaagtgacccataaagatatgctgtcactacgtccatcaactgcataaatagacgattttgtactgccaatgatattaaatatcggaaagttataccactcataactggagagtaactttcgttgaaatcaacgccaggtttttgcgtaaaaccttgtgctacaagccttgctttatatctcaccacctcgttgttttcattccgtttccggacgaaaacccatttgtatcccacaggaaagataccacgaggagtaggcattacagccgagaatacatctcttttgtaaagcgaggctaattctgcgtcaattgcgtccttccatttgttccagtcagagcgcttttggcactcttttatagacctaggttctggatcaacttggagacaatcagcaatttgttcagaaaaattaatgtcgacaattgtagctcttctatcaaaagattctccagtttcagagtagttgatggcaatttcatcaacccttatagactcatcgtgatctcccgaaacaatgtgtatatggtcttccaaattcctagtctcagcattgtgcaccaccaagctaggttgcagactatcacgatctgcttgatatatagtatcaatttggtgtgtaacaactaaaggttggtttgcatttaccgtctttctttgcttattagcaattgtttctcgctgggtggccatacttcttcctctctttttagtgagtggaagttgagtggttttatttggtacctctactctttctggtgcattctgagcaggaatgaaagatttagtcacacatttataattggtaaatgcatctggcaggttatttgcaagtctttgcaaatgtataattttctgaacttgaagttcaatttcagtagtacgtgggtctgaggctggaacaccctgggcatcccaatcaatttcctggcattctttctggtacttgaagtctccccctaatgccgggaaatgttcctcatcaatgatagagtcagcgaaccgggcagtaaatagatcacctgttaagggttctaaatactttatgatcgacagagatttgaatcccacatagatccctactttcctgtgtgggcccatagcggtacgctgtggtggtgagatcggtatgtatacagcacaaccgaacttacgcaaatgggaaatacttggaggattttcacgtactaactgcattgggaaagtttcatgatatgcagttggtcgtagttggacaaggtcagcagcgtgcagaactgcatgaccccaacacgacgaaggtaatttgcaattcatcaataatggttgagcaataagcttaattcttttgatcaatgattcagccaaaccattttgtgtgtggacatatggaacagagtgctgaacctgaattcccaatgccatacaataatcatcgaaagcatgggatgtaaattcggcagcattgttcatacggattgattgaatcctatgttcagggtaatttgccttcagccttataatttgagacattaatttggcaaaggcatggtatcgtgtcgatagaagacacacatgagaccatcttgtagatgcgtcaatcaaaaccataaagtacctgaacggtccagatcttggcacaatagggccacagatatctccttgaatgcgttcaaggaatttaagtggttcggctctaattttgagataagatggtctcaaaattagtttcccagtagcacatgcagtgcatacgaaatcagaggatttgggaaatttgtcagtgatcaaatgatgaccaacagagttgccaataatttttctcatcatcccgataccgaggatgcccaagtcgatcatgccaagtgtggaatgcatcaacattttgaaaaattactttatacgcaacatgtgcaatgggcttaatgtatgtatagtacaatcccgatgtgagagatggaattttctcgcaaatgcgtttgccatatccgtgttgtttggttaagagaagaaattcttctcgattatccatatgggtttcaatgtgaaacccattttgacggatatatctataacttagtagggtacgagttgaatcgggatacaataaagcatcctcgattgtaatttgtgtacccattggaagtgtaataattgctcgtcctgagccaactatcacagtatcgcgcccagcgatagtcaaaacgttgccttctctctttttgagagtttgaaagtatttgatctccctaagtatagagtttgtggtatcactgtccaaaagacataattcctctccaatcggagcgatatccttagacatctataatgaaagaagaattacttgattaagaattctttatccaatatatatacatacatacaataattaaaacatcagatacatagtatgatgtttacatatgttaatagtacatactctaatgactagcaagccatacaaccttacaatataagggagttcatacttatctacttattacaaccaatattgtttggcaaacttataggatatcaatatactatttcaagcacattgagataagagcagcttcatctccaagtgggacgcaccgagatcattgcaaatctccaagtgggtccgttgagcagtattcgatgaacatatcgtccatcgcagagagtggagcgacatcttctgggacaacattgaggttgctctctggttgaacaggagcctggtgagaacttgcaacctcagggcgctctttatgtgtaagattgaagtgggcttcaaatcttgggttctcagaagattttttgtccttgagggatttttggtacaagagaaacaagatatttcgggatgcggcagtctttagcgacatgagtgtcagatccacacctgttgcaatgcttgttgccattgctacgaggttgtggtgccttacccttcccttttcctttctttcaacccttgaatttgcgcctgttgttgttgcgtttgcgctttccagtcagattcttaggattatttgaagaatttcccttgaatcctttcttattctcagcattattctgtacattgaagtgcacctcaggtagtggagcagagcccggtgggcgctgttgggcattctttaaagaaagctcatggtgtctttctgcctgagtcaatgtatgtataagcagagaacgtttctggaaattgttagcgtgatactgttgagtcggtatcctgtcctccggaagcatagttgatagagttttctctatcttctctgcctcagttggctcttgttcgcaaaacttcaacctggaacaaatgttatgaacaacatggttgtattatgccacagttttaaagtcctgtaggcgtaaatgaacccactcataattagcctcaagccaaatgagttccttttgctgatcatagcgctcttttagagctttccaaaggttgagagggctcgtctctaacatgtattaatgtttaagatccttgtgaatgtagagtctcaaaagaaaaagggatgtattgagcttcctaggctcaatttccgggtccccatcattgggttcctcaattgtatttaaaatcccccgagaggcaaaattgattttgatatcagaagaccatatgggatagttagtcccatcgagggcgagttcgtcgaactcttttgttgccatgtccctacaatcatggttaacattatcaatttacagaggtaaattaataaaaacatgatattaaggttgtaatctcaatgcgaaatgtaagacttcatattttgtaatgtttcgaaaaaaaatgcaggtaatggacctgacaatttgagttagaattcgaaattaggtggcacaatgtggataatctccaagtaattaaacagtggagtagatctcttaatagtgggcaagttatacttgctgcctaaaacacggtctccaggcaaatatattctgttgaatataccacaaccaatgtttaggactccactaccttgtgctcaaccaaaattcaaataatctcatttttcaaaacttattcttggaaaataacacatgtgggtaatcatcatgagatgtagacctctgtgagatgggcaaggtgctcgttgcctaggttatgaccagtgcggccaatttgtaggactccatcgggtaatcatctcaaaatgtagaccacttgatgatgggcgagatactcgctgcctaagttatggtcgatatgaccaaagtatagggctccatcgacatgtgattaatttccgagtcaaaatgtgaagtggaacatgcattaaatcctccattaatcatgttgtacataattaagagaatttactaaatcaaagtacaaaatttatagaattttgtaaattaataaagcgagaaagtagagcatgtcttgaaataaaatgcaaaagacatgttattaagacaataaatttagtgaaacagggtatttgaataaacacctatgttaattaacacataacatcagcggtctgtaggaccattacataattacttgtacaactaatgaactatttcgactaaattatataaaacacaagggactaaaacgaaattgctgctaaattagtaattaaaactaaaattaaatgataaattgggtg
